United States Patent 11,098,302 (IDENTIFICATION OF POLYNUCLEOTIDES ASSOCIATED WITH A SAMPLE) - sequence listing, part 29

SEQ ID NO: 97211 - DNA, 817 bp, Homo sapiens
  misc_feature: GYAE6OF01E5C38.38.53.E09.1.454.CMB.1.raw
  modified_base (213)..(213): a, c, t, g, unknown or other
  misc_feature (213)..(213): n is a, c, g, or t
  modified_base (809)..(809): a, c, t, g, unknown or other
  misc_feature (809)..(809): n is a, c, g, or t
tcagtcgatcacgtcacgaccggtgctcgatttagagagagtgtgttgggtttggggagagctgctcagttaggacccagagggaaccatcggaaaccccagcgcagcttctcttcctcctgctactctggctccagactaccacgggagtaaattgtgttcgacgcagtctccaggccacccttgttctttgcctaccggaaaggggaaacncgaccctaccccttctccgtggccgacgggcctaggtacagtacgtgtagcgagccagtccttacgtacgtccgttaggtaccaacggaccgtaaacggtaaacccgtcggacccgtaccgggtccctacccggacggtcccttacctacgttacggtttccggtttaggctaccgtactccggaggtccggtaccgggacctacgtcggacctaccgtacccgaaggtaccgttacgggttacgacggggttacggaccgggttagggttcgggggtacgtaacggggtaacctacgggttaccccttacgtaaccctttaccgtaaccgtaacccgtaacgttacccgaaacccggtaaggttacccggtagggtacccgtaaccgttaagggttaactttagtttaccggaacgttttaattttaaccgtcgtacgtaagtacgttagtaacgtacgttaagttaccgttacctttcgtacccgttttcgtacggggttaccggaagggtacggggttaaccgtgggtaaccgaacttaggtaaaccctaagggttacggtgaccgtcgacccgtagtaaccttggtctttanccgttacg

SEQ ID NO: 97212 - DNA, 814 bp, Homo sapiens
  misc_feature: GYAE6OF01C8DV5.38.53.E09.1.454.CMB.1.raw
tcagtcgatcacgtcacgaccggtgctcgatttagagagagtgtgttgggtttgggggagagctgctcagttaggaccagagggaaccatggaaaccccagcgcagcttctcttcctcctgctactctgctccagataccacggagtaattgtgttcgacgcagtctcgacggcaccttgtctttgtctacgaaggggaaagcgccctaacctctccgtgccggacggaccagtacaagtacttagtacgctaagcgacgtacttacgttacgtccgtacggtaaccaggaacaacgtaaaaccgtcggacccgaacgggtcctaccggaacggtcctacctcgttaacgtttcggttttacggaccgtacctaacgtaccgaacggaccggtaacggggacccctaacgggttaccggtaccaccgttaaaccccgaacgtaacgtaacgggtttcgtaaacggtcggaaccgggtaggttaccggggtacgtaacggggaccgtaacggtctttaaccaacgttactaccgaaccttactaaccgaaccaacggtaaccggtacgggaaactaccgtttaaggaaacgttttaacgttacggttaacgttagtttttaacgttacgttagtaccgtaacgtaacgttaagttactttaacgttaacgttttaccgtttaaactttccgttaccggttacgtttacggggaccgggtagggtaccgggagggtacgtaacgtaacgaaacgtaaaacggtcgtaacgggtcgtaccgacgtactacgttaatttaccgtcgttaccgttaccg

SEQ ID NO: 97213 - DNA, 696 bp, Homo sapiens
  misc_feature: GYAE6OF01D2RKK.38.53.E09.1.454.CMB.1.raw
  modified_base (203)..(203): a, c, t, g, unknown or other
  misc_feature (203)..(203): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggaagaaattgtgttgacgcagtctccaggcaccttgtctttgtctccgaaggggaaancgccaccctctcctgcgagggccagtcagtactgttagcagcagctactgccgtggaccagacacgaaccgtcggccgagtcctcccgaggtcctcctctagtttcgtttggtcgctacgtccgacggtccgacgggaccctacgtcggacctacgtaccgaacgtacggtacggttcgtagggtcggcgtagggtcgggtacgacgggacgtacgtaccttctaccgtcctacccaacctacgtcccaaccgtaacgtaccggtacgggtaacgtacccgttaaggtaaaggttttcttttacggacgtttttaaagttttaacgttcgttacgtacgtaacggtacgttaagtttaattggttaacttttacggtttacccttcgttaccgttacggtttcgggacgggtagggtaccgtagggttcgaacttacgaaccgtaaagtacggtgtacggctacgtacaccgttattccgttgtccgttaccg

SEQ ID NO: 97214 - DNA, 949 bp, Homo sapiens
  misc_feature: GYAE6OF01CWTY9.38.53.E09.1.454.CMB.1.raw
  modified_base (190)..(190): a, c, t, g, unknown or other
  misc_feature (190)..(190): n is a, c, g, or t
tcagtcgatcacgtcacgaccggtgctcgatttagagagagtgtgttgggactgagctggattttccttttggctattttaaaaaggtgtccagtgtgaagtgcagctggtggagtctggggggagacttggtagagcctggcaggtcccctgagactctcctgtgcagcctctggattcaaattttaangataatgccatgcacgtgggtccaacaagctaccgaggggaacggcctgggagtgggtctacgtaagtggttagttggaacaggttcggtaccatacgcccttagtcggcggtactcgttggtacggaacgggcccgtatttccgaaccctcttcctacccgaaggacgaaaccaaccgaccgaaaggaccgtcccttccccgttagttaacttccgttagaacctaaaagttacggaaaaccgtacggttccgtaggaaccgtacccgtagggaacgggaaccctaccgggtttccctttacgtttacgttttaccgttacggttacgaaacccggttaaaaacccggggtcccccgggttaagtaccgggaccgttaaacgggtacgtaaccggttaaaacgggtttacgggtttttacccgttttacggtaaccccggttttacccgggtaccggggggtaaccccggtaaacccgggggggtaaaccccccggggttacccgttaacccccgggtttcccgtaccccggttacccggtaaccgtacccccccgttacccgtaaaccccgggtaacccgggtacccccgttaaacccggtttccccgggtttaccccccgtttcccccccgggttacccgggggccccccgtccccccgggtttacccggtaccccggttacccccgggtaaaccgggtaccccgggtacccccgttaaccccccggtacccggggtaaacccggtaaccccgggg

SEQ ID NO: 97215 - DNA, 730 bp, Homo sapiens
  misc_feature: GYAE6OF01EIUIH.38.53.E09.1.454.CMB.1.raw
  modified_base (202)..(202): a, c, t, g, unknown or other
  misc_feature (202)..(202): n is a, c, g, or t
tcagtcgatcacgtcacgaccggtgctcgatttagagagagtgtgttgggtttggggagagctgctcagttaggaccagagggaaccatcggaaacccagcgcagcttctcttcctcctgctactctggcctcccagactaccacggagaaattgtgttgacgcagtctccaggcacctgttctttgtctccgaaggggaanacgccctaccctctccgtcgcgagggccagtcaggactgttacgcacgtcacgtacgttactcgtcgtacggtaaccgacgtacacggaaaccgtggacccgaggtcctacccggaggtccctaccgttctaccgtttcgtttacgggtcgtaccgttacctaccgtaacggtaccggaccgggtaccgtaacgtcgggactaaccgttaccgaacgtacggtacggttcaacgggttcggacgtggtcgggtacgacgggacgtacgtaccttcctaccgttccgaacctacctacgtacctaaccgacgtacgtcggtaacgtaccgtagtaaacgttatttcggtaactttaaggtttactaacgtcgtagtacgtacgtagttacgttcgttaacttacgtttccttaacgttaccgttacggttcggacgggtaggtaccggacggttagaaccgtaacgtaccgtaaagttacggtcggtaagcccgtacgtaccgtaactacggttcttaacgtcttaccg

SEQ ID NO: 97216 - DNA, 701 bp, Homo sapiens
  misc_feature: GYAE6OF01DL6KN.38.53.E09.1.454.CMB.1.raw
  modified_base (316)..(316): a, c, t, g, unknown or other
  misc_feature (316)..(316): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggagaaattgtgttgacgcagtctccaggcacctgtctttgtctcgaggggaaagcgccaccctctcctgcgagggccagtcagtactgttagcagcagtctactacgcctaggtaccagacaacgaaaccgtggccaggcctcccgaggcctccgtctagttcgtttggcnctactcccgagcgacgggcctaacgtggacctactaccccgaaggtacctacggtttcgaggtcgggacgtagggttcgggtacgtacggggactaacggtcctttacgaccttcgttaccaacctacgtacccaaccgacggtaacgttacgggaccgtacccgttaggaaagtttacgtttcgacgtttaagttttacgttaccgtgtacgaagtctaaggttatacgttattaccgtttaccttcgtacgttaccggtttacgggacgggtacggtaccggtagggtacgtaacgtaacgttaaaccgaaacggtacgttcgggtaccggtaccgttacggtaacctaacccgttatttacccgttcgtttaccgttacccg

SEQ ID NO: 97217 - DNA, 833 bp, Homo sapiens
  misc_feature: GYAE6OF01ASE63.38.53.E09.1.454.CMB.1.raw
  modified_base (310)..(310): a, c, t, g, unknown or other
  misc_feature (310)..(310): n is a, c, g, or t
tcagtcgatcacgtcacgaccggtgctcgatttagagagagtgtgttgggactgagctggatttttccttttggctaatttttaaaaggtgtccagtgtgaagtgcagctggtggagtcgtgggggagacgttggtagagcctgggcacggtccctggacgacttccttccgtgtgcacgtcccttcgtaggtacttcgtacctttagcagctatcgccagtggacgtcgtcgggtcccgccgacggtccgtaccggacggggaccgggttcgtagggtcgggttcgggtccctacgttaaccgtttaanaccgtaaaggttaagttcgggtaggttaccgtaaccacgttacgttaccggaacgctacggtaccgttccggtagggaacggggttcccggttacgaaccctcttacctaaccgaacgaacgtaacctaaactaccgaaacgaacctaactaactactaaccgtagaaacctaaagtacgaaacgacccgtaggaacgtacgacggacggaaccaccggactaagttaattacttacggtagtacgggagggtaacgggggacgtacgggtacgtaccgtcgggtaccgggaccgaccgggtaacccgtggtacccctaccgtccgtccgtaccgaccgtacccgtaaccgaacccgggaaccgtaccccgtacgttccccggttcccgttaccccgtaccggccccgtaaccccttacccggacccgtaaccggccgtaccccgtacccggtacggggttccggacccggccgtacccgggcccgggttacccggtcgggccttcccgggaccggttaccgg

SEQ ID NO: 97218 - DNA, 748 bp, Homo sapiens
  misc_feature: GYAE6OF01EE86T.38.53.E09.1.454.CMB.1.raw
  modified_base (196)..(196): a, c, t, g, unknown or other
  misc_feature (196)..(196): n is a, c, g, or t
tcagtcgatcacgtcacgaccggtgctcgatttagagagagtgtgttgggtttggggagagctgctcagttaggacccagagggaaccataggaaaccccagcgcagcttctcttcctcctgctactctggctcccagataccaccggagaattgtgttgacgcagtctcagcacctgtcttgtctacgagggaancgccaccctctcctgccgtacgggccagtacgagactgttacgcagcagtctacgtacgccgtgtaccagacaacgaaaccgtggccgaaggtcctacccgacggtcctccgtactacgttcgtttcggtcgtactacgtaccgaacgaccggacgggtccctaacgtcgggacctaccgtaccccgagaaccggtacggttacgacggttcggacgtacgggttcgggtacgtacgggacgtacgtacccgtactaccgtactaccctaccgtactaccgtaaccgtacgtaaccggttacggaacgttacccgttaaggtaaacgtttagttttaccgacgtttaaggttttaactacgtaggtaacgtacgttaaccgagtttaacgtagttaacctttaaccgttttacccgtcttaaccggttacggtttaccgggacgggttaaccggaaccggttaggggtacgaaccttacggtaaacgtaaacggttacggtcggttacggacttaccgacgtaacccttaggtcccttgtttccttaacccg

SEQ ID NO: 97219 - DNA, 871 bp, Homo sapiens
  misc_feature: GYAE6OF01DSO6J.38.53.E09.1.454.CMB.1.raw
  modified_base (106)..(106): a, c, t, g, unknown or other
  misc_feature (106)..(106): n is a, c, g, or t
  modified_base (333)..(333): a, c, t, g, unknown or other
  misc_feature (333)..(333): n is a, c, g, or t
  modified_base (833)..(833): a, c, t, g, unknown or other
  misc_feature (833)..(833): n is a, c, g, or t
tcagtcgatcacgtcacgaccggtgctcgatttagagagagtgtgttgggtttggggagacgctgctctagttacggacccagacgggaaccagtacggaaacccngcgtcagcttctcttcctctgctactcgtggctaccagtactaccgacggagtaacttgtcgttcgacgtcgtacgtcctcgacgtcctaccgttcgttactttacgtaccgtaccgggtaaggggtaaactccgtacccgtacccttccgtaccgtcggaccggacgggtacctagtaccgtaaacgtacggttagtacgcgacgtacgactacgttaacgttacnccggttacgaacgacgtaacgtaaccgtaaccgtcggtaccgaccgtacctaccggtacggtccttacggtacctttacggtttccgttacggacgtaacccttacggaccgtacggttaaccggtaacggaccctacgttaccggtacgtaaaccgtacccggtaaggtaccggttaacggtccggaacggttacggggtacggtacggggttaccgggcggtaaccgggttaactacggttaaccctcccggtacgttacccgaaccttaccggtaacggtaaccgtaacggtacggtaaccggtacggtacccggttaaggtaacgttaacggttcgttttaaccggtactttacgtttacgtaccgtaggtacccgtaagttactaagttacgtacgttacgttaccgttacgtcgttacgtccgggttacgaaccgggtcgtaaccggttacggtcgtaacttaacggtaaccgtacggttacgtcggtaccgtntacccgtcgtaacgtttcgcgtttaccggtcttacccg

SEQ ID NO: 97220 - DNA, 772 bp, Homo sapiens
  misc_feature: GYAE6OF01BSHC6.38.53.E09.1.454.CMB.1.raw
tcagtcgatcacgtcacgaccggtgctcgatttagagagagtgtgttgggtttggggagagctgctcagttaggacccagagggaaccatggaaaccccagccgcagcttctcttcctcctgctacgtctggcctcccgagatacccaccggtagtaaagttgtgttaggacgtcgacgtcctaccgaggcccacccttgtctttgtcctccgagggtaagcgcctaccgtcgtacgtggacgtaggaccagtcaggtacctgttagcaggctagtccgtaacgttacggccgttacggtaaccgacgtacctaaaaccggtaaacccgtcggacccctaacgggtaccttaccccgaagggttccccttaccgttacgtacgtttaccggtttacgggtaccgtaccgtaaccgtaccgaaggtacccggtacggggtaccctaacgggtcgtaccgaccgttaacccgaagtaccgtaacgggtttcgaagggtttccgaccgtagggttaccgggttacgtaacgggaactacggttaaacccttaccgtaaccgtttacccgaccgaacccgttaacgtaccgtaccgtagtacggtaccggacgtaccgtaagtacgtaagttcacgttagtttacgtacgtacgtcgtaagatagtatagtacttacgtcttacgtcgttacgttacggaccggtaggtccggtagtagtacccgtagtaacgacgtaagtcgagtcgcgtaacgttctagttcgttgtacgttcg

SEQ ID NO: 97221 - DNA, 890 bp, Homo sapiens
  misc_feature: GYAE6OF01D2CNO.38.53.E09.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
tcagtcgatcacgtcacgaccggtgctcgatttagagagagtgtgttgggactgagctggtatttttccttttggcttaatttttaaaaggtgtccagtgtgaagtgcagcgtggtggagtcgtgggggatacgttggtagagcctggcacggtccctgacgactctcctgtgcacgctcgtgtattactaaatttanagaataacgncctaatcgacgacgttcgggaccagacgtccgtaccggaggggaacggtccgtggaggttcggtcctaggtagttggttacgtgaacgtagtcggtacagtacgtacctagtggcggtacttcggtcggaaggaccggtacgtactaccgaccgttactccgacgaagaccgaaccaccganaaggctccctccgtgttacntacaacgaatacaacgtgttaccgagaaccgtcgtaacgggacgttacccggtacgtttaccgttttaactttcgttaccgtaaccggttaccgtaaaccgggtaacccgggtcccggttaaggtaccgggtacgtaaggtaacgtttaaccgggttaaggtttaccgtttacccggtttccgtaaccgggttccgggggttaaccgggaaccccgggggttaacccgggacccccggttttacccgggttaaccccttacccgtaccccggtaaccgtcccccggttaacccgtaccccgggaaacccgggttacccccgggtccccgttttaaaccccggggttcccccgttttacccccccgggttttcccccggaacccggggttcccccggttacccgccccgggtttaacccggaaacccccggtaggtaacccccggacccccggttacccgaccgggtaacggaacccccgg

SEQ ID NO: 97222 - DNA, 547 bp, Homo sapiens
  misc_feature: GYAE6OF01B8CD4.38.53.E09.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
tcagtcgatcacgtcacgaccggtgctcgatttagagagagtgtgttgggtttgggagagctgctcagttaggacccagacgggaaccatggaaaccccagcgcagcttctcttcctcctgctactctggctcccagataccacggagaaattgtgttgacgcagtctccaggcaccctgtctttgctccgaaggggaaangcccaccctgtcctgccagggccagtcagactgttagcagcagctacttgcctggtaccagcagaaacctggccaggcctcccgaggcctcctgacttctttggcncatccagcagggcccatggccatcccagacnggttcagtgcagtggtcngggacagcttnactcgcaccntcacagacnggacgcctagaacgtattttgactagtttattactgtcagcagtatgtacttagtttaccctcttacacgtttcgggacggtacgggaccgtagggttacggaactagtaccgaaaagtacgtggtaggacctcggacaccgtaagttctcggttcttacc

SEQ ID NO: 97223 - DNA, 1052 bp, Homo sapiens
  misc_feature: GYAE6OF01D2N5C.38.53.E09.1.454.CMB.1.raw
  modified_base (211)..(211): a, c, t, g, unknown or other
  misc_feature (211)..(211): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctcccagataccgaccggagaaattgtcgttgaccgcagtcctcgaggccaccctgtctttgtcctccgaaggggaaacncgccctaccctctcctcgcgtacgggccagtccaagtacgtggtaacgcaggcacgtaccttaacgttcgccgttaggtaaccagtacgaacggtaaaaccgtcggaccgtaacggtccctacccggaacggtcccttcccgttacgtacgtttccggttttacggtccgtaccttaacgttcccgaaggtaccggtaccggggtaccctaacggtttccgggaacccttacccgtacccgtaacgtaaccgggttaaccgggttaccgtacgggtcggtaccgggttacgggttaccgggggttaccgtaacggggtaaccgtaaacggttaccctttaaccggtaaacccctttcgtaaacccccggtaaccgttaaccttaaccccgggtaaaccgtaaaccgggttacccggggtttaacggaaccccgggtttaaacccggtaaacgggttttaaaagtttaccgggtttttaccgttacccgttttaaaggttttttaaccttaacccggttttaaccggaaccggtacgttaaccgggtttaatttaacgggtttaccccgtttttaaacgtttaacccggtttaaccccgtttacccgttttaaacccggggttttaccgggtttaaaccccgggggggtggttaaaaccccggggggttttaaccccgggaacggggggtttaaacgttaaccccgttaaaaaaccggggtaccttaaaaacccgggggttttacggttccggggttacccggttaaccgggttaaccggttaccccttaaacccgggttaactttttcccgttaaccggggttttccctttaaaccccggg

SEQ ID NO: 97224 - DNA, 704 bp, Homo sapiens
  misc_feature: GYAE6OF01A13GJ.38.53.E09.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
tcagtcgatcacgtcacgaccggtgctcgatttagagagagtgtgttgggtttggggagagctgctcagttaggacccaggagggaaccatggaaaccccagcgcagcttctcttcctcctgctactctggcctcccagataccaccggagaaattgtgttgacgcagtctccgaggcaccctgtctttgtctccgaggggaancgcccaccctctcctgcgagggccagtcagactgtagcagcagcctatcgcctaggaccagcagaaacctggaccaggcctaccgaggtcctcctanacttcgtttacggngcagtccgagtcgacgggccacgtcggcacctaccgagtacgcggtacgaggtcgcgtaggtgggtacgtaggaaccgtagtaccttacaccttccaccgtacctacgtaccaaccgtacgtaccgtaggacgtacgtaagtaacgttacgttttcgacgtttaagtttacttacgttacgtactacgtacgtaaggtttatagtttaacgttacgtttacccgttacgttcccgttaaccgggtttacgggacgggttaccgggtaacccggggttagggttacggaaccctaacgggttaaaccgtaaaccgggttacgttcgggtaccgggtacctcccggtaacccgtaacgttccggtttaccttccgggtttcttaaccccgg

SEQ ID NO: 97225 - DNA, 710 bp, Homo sapiens
  misc_feature: GYAE6OF01BY56Y.38.53.E09.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
tcagtcgatcacgtcacgaccggtgctcgatttagagagagtgtgttgggtttggggagagctgctcagttaggcccagagggaaccatggaaaccccagcgcagcttctcttcctcctgctactctggcctccctagataccaaccggagaattgtgttgacgcagtctcaggccacctgtctttgtctcgaaggggaacncgccacctcgtccngaccagggcctagtccagacctggtagcagctagtcctactagccgtgtaccagtaccaagtaacctgccaggcctccgaggtctccnctactcgttggtctacacgtccgagccggacgggtaccncgtagcctaactcccgagtaccaggttcaggcgcgtacggttggtaccgagggactaacgtccgtactcgttacctaccgaccgtataccgaaccgtaccggtacgtacggtacgtacccgttaggtaacgttacgtttaccggttacgttaacgtttacgttaacttacgttcgtaaacgtacgtaagtttataaccggtttaatttaaccggttccgttacgtacgtttaacggttccgggtaaccgggtccgggtaaccgggtagggtaccggtaaactacggttaaaccgggtaaacgtcgggttaggtaccggtacgttaccgtaaccgtaattaacccgtgtttaccccgttgttaccccg

SEQ ID NO: 97226 - DNA, 656 bp, Homo sapiens
  misc_feature: GYAE6OF01B5MI1.38.53.E09.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (537)..(537): a, c, t, g, unknown or other
  misc_feature (537)..(537): n is a, c, g, or t
  modified_base (637)..(637): a, c, t, g, unknown or other
  misc_feature (637)..(637): n is a, c, g, or t
tcagtcgatcacgtcacgaccggtgctcgatttagagagagtgtgttggggtttggggagagctgctcagttaggacccagagggaaccatggaaaccccagcgcagcttctcttcctcctgctactctggctccagactaccaccggagaaattgtgttgacgcagtctccgaggccaccctgtcttgctccgaggggtaaacngccaccctcnccgtgcgagggccagtcagactggttacgcagcagctacttagccgtgtaccagcagaacctggccaggcctcagctcnattcgttgcncanccagcgacggccagtgcctatccccgaagacctagggttccagggttcgacgacggttggggccctgggaaccgtggtacctttacccaacgttcctacgaaccacgtaccgaaccgaacggtaaccgtcgggtacgtacccgtaaggtaacggtaaccgtttttgaacttaacgttttagtaccgtagtcctaagtcgtaagtagttaggtaacttacggttttaaccncttaccgttacgttacggggacggtaacgggtaccgtagggtacgtaactaacgtaccgaaacgtacggtcgggtacgccgttacggaacctaaccggtntttacgtacgttctaaccg

SEQ ID NO: 97227 - DNA, 744 bp, Homo sapiens
  misc_feature: GYAE6OF01COTLE.38.53.E09.1.454.CMB.1.raw
  modified_base (149)..(149): a, c, t, g, unknown or other
  misc_feature (149)..(149): n is a, c, g, or t
  modified_base (174)..(174): a, c, t, g, unknown or other
  misc_feature (174)..(174): n is a, c, g, or t
  modified_base (661)..(661): a, c, t, g, unknown or other
  misc_feature (661)..(661): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctccagataccaccgganaattgtgttgacgtagtctcaggcncctgtcttaaaaacgtctaccgagggaagacgccaccctctcctgcgacggccagtacagtactgtacgcacgcacgtctactacgccgtacggtaccacgacaacgaaccgtcgaccgacgcctaccgacgtcctccgtctacgttcgttcggtacgcctacgtccgacggccgaccggtaccgacggttacgaccgtaccgtacccgaacggtaccgtacggttaccgaggtcggtacggtacgggtcgggttacgggtacggtaaccgtacgtaccttaccgtaccgttacctacccgaccgtactacccggaaccgtaacggtaccggtacgggaacccgtaccgttaaaggttaacgtttcgtttaacggtactttaaggttttactacgttcgtacgacgttacgttaagttacgtacgttaacttttacgttacccttcgttaccgttaccggggttcggaaccgggtacggtaaccggnggttaaccgactaaacggtaacggtaaacgtgttacggtcggtacctacgtaccgtacttcttacgttcttccttagtccccg

SEQ ID NO: 97228 - DNA, 559 bp, Homo sapiens
  misc_feature: GYAE6OF01EEVJ3.38.53.E09.1.454.CMB.1.raw
  modified_base (219)..(219): a, c, t, g, unknown or other
  misc_feature (219)..(219): n is a, c, g, or t
  modified_base (281)..(281): a, c, t, g, unknown or other
  misc_feature (281)..(281): n is a, c, g, or t
  modified_base (357)..(357): a, c, t, g, unknown or other
  misc_feature (357)..(357): n is a, c, g, or t
tcagtcgatcacgtcacgaccggtgctcgatttagagagagtgtggttgggtttggggggagaggagccccagccctgagattcccaggtgtttccattcagtgatcagcactgaacacagaggactcaccatggagttgggactgagctggattttccttttggcttattttaaaaggtgtccagtgtgaagtgcagctggtggagtcgtgggggganacttggtagagcctggcaggtccctgagactctcctgtgcagcctctggattacaaatttangataatgccatgcacgtgggtccacaagctccgaggggacgggcctgggagtgggtctcaagtgttagttggaacnggtggtaccatagcctagtgacggacttcgtggtgaagggccgattccaccgatcctccaaggacgaacaacgaccaagacgtcctcccttgtactctgaccaaatgaacagtcgtagacgacgtggacggacaccggtccttcttactttctctgaacgaaacggccccggtatcggcacggtagctaaggtcggtttacg

SEQ ID NO: 97229 - DNA, 793 bp, Homo sapiens
  misc_feature: GYAE6OF01CB9FL.38.53.E09.1.454.CMB.1.raw
tcagtcgatcacgtcacgaccggtgctcgatttagagagagtgtgttgggacgtgagctggattttccttttggcttattttaaaaggtgtccagtgtgaagtgcagctggtggagtctgggggagacttggtagagcctggcaggtccctgagactctccgtgtgcacgcctcgtaggtacttacaaaatttaatgaataatcgcctaagtgcacgtcggggtaccaactaagccgtaccgaaggggaacggtccttaggttacggtcgggtactacgtaaggttcggttaaggttaggaaacctaggtacggtaaccagttaacggtacctaagtcggacggtacttcgtgggtacggaaacggggccgtaactttaccaaccctagtacctacccggaagaacggaacccgaaaccgggaccaaaagggacctacctaccccgttagtaactctaacggaactaaaagtacgaaacgtagtactaacggaaccgttaacgtaggaaacggacctaccggtacctttagttactttactagtacgtaacgtaaaaccggtcccgtaagtcggacgtaagtacgtaacgtaagttacggttacgttaccggaccggtacccgggaccggtaacccggggtaacccgggtaccgtaaccccgttaccgtccgtaccgtacgtaccctaaccgaccgtaccggtacccgtacgtcccggttacccgtccccgtacggtcccgtacccgtcgacccgtaccggacgtaccgaccgaccctacggcgtacgacccg

SEQ ID NO: 97230 - DNA, 515 bp, Homo sapiens
  misc_feature: GYAE6OF02IZOHN.38.53.E09.1.454.CMB.1.raw
  modified_base (202)..(202): a, c, t, g, unknown or other
  misc_feature (202)..(202): n is a, c, g, or t
  modified_base (302)..(302): a, c, t, g, unknown or other
  misc_feature (302)..(302): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagactgttagcagcagctacttagcctggtaccagcagaaacctggccaggctcccaggctcctcatctttggtncatccagcagggccactggcatcccagacaggttcagtggcagtgggtctgggacagcttcactctcacatcaccagactggagcctgaagtattttgctagtttattacttgtcagctagtatgtattagtttacctctctacgtttcggcggtagggaccgtagggtcggactagtcaaacgtactggtaggctcgcaccatctgtcttac

SEQ ID NO: 97231 - DNA, 515 bp, Homo sapiens
  misc_feature: GYAE6OF02G0TQS.38.53.E09.1.454.CMB.1.raw
  modified_base (332)..(332): a, c, t, g, unknown or other
  misc_feature (332)..(332): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagactgttagcagcagctacttagcctggtaccagcagaaacctggccaggctcccaggctcctcatctttggtgcatccagcagggccactggcatcccagacnggttcagtggcaggtgggtctgggacagacttcactctcaccatcaccagactggacgcctgaagtattttgctagtttattactgtcagcagtatgtattacgtttacctctctacgtttcggcggagggaccagggtgactagtacaaacggtactgtcggactcgctacctatctgtctc

SEQ ID NO: 97232 - DNA, 528 bp, Homo sapiens
  misc_feature: GYAE6OF02GTZT4.38.53.E09.1.454.CMB.1.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagctccctgtatctgcaaatgaacagtctgagacctgaggacacggccttctatttctgtgcaaaaggccccggtatggcagtagctaagaggttctttgactcctggggccagggacccgggtcaccgtctcctcagcctccaccaacgggcccagtccggtccttcccccgtggccgccctgcctccagggacgccacctccgagacgcacagccggcctgggctgcctggtcaaggctacttccacgtgactcgactgagcggcg

SEQ ID NO: 97233 - DNA, 575 bp, Homo sapiens
  misc_feature: GYAE6OF02H5I9F.38.53.E09.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngcccaccctctcctgcagggccagtcagactgttagcagcagctacttagcctggtaccagcaagaaacctggccaggctcccaggctcctcatctttggngcatccagcacgggccacgtggcatcccagacaggttcagtgcagtgggtctgggacagacttcactctcaccatcaccagactggacgcctagaagtatttgacttagtttattactgtacagcagttatagtaattacgttttacctcttacgtaccgttttcgggacgggtaacgggtaccgtaggggttacggtaccgtagtaaccgaaaccggtaacgtaggttacggccgttacgaccgtaacctacgttcttacgttctttaccg

SEQ ID NO: 97234 - DNA, 669 bp, Homo sapiens
  misc_feature: GYAE6OF02JQXB1.38.53.E09.1.454.CMB.1.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctcccagataccacggagaattgtgttgacgcagtctccgaggcaccctgttctttgtcctccgaaggggaaancgcccaccctctcctgcgacggccagtcagactgtacgcagcagctacgttagccgtaggtaccagcaacgaaaccgtggaccaggcctcccgaggcctcctacattcgttaggcnctacgtcagcgacggccagtcggcactcccgagacgtaggtcaggtcggctaggtcgggtactggggactacggtacttctactcctaccaccgtatacccgaacgtacgtaccgtaggtacgtccgttaaggtaaacgtttcgtttacggactttaaggttttaacttacgtcgtaccgaagtactaaggttactaggttaactttaccgtttcctacgtaccgttacggtttcgggacggtacgggtaccgtagggtccgtaacgtacgtaaccggtaaacgtacggttcggtaaccggtcgttaccggtacctaaaccgttgttacccgttacgttccttaaccg

SEQ ID NO: 97235 - DNA, 540 bp, Homo sapiens
  misc_feature: GYAE6OF02F6OPR.38.53.E09.1.454.CMB.1.raw
  modified_base (506)..(506): a, c, t, g, unknown or other
  misc_feature (506)..(506): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagctccctgtatctgacaaatgaacagtctgagacctgaggacacggccttctatttctgtgacgaaaaggccccggtatcggcagtagctaagaggttctttgactccgtgggccgacgggaacccggtcaccgtctcctcacgcctccaaccgaacgggcccagtccggtccttccccgnggccgccctgcctccgaggcgcacctccgagacg

SEQ ID NO: 97236 - DNA, 829 bp, Homo sapiens
  misc_feature: GYAE6OF02G9RI2.38.53.E09.1.454.CMB.1.raw
tcagtcgatcacgtcacgaccggtgctcgatttagagagagtgtgttgggtttggggagagctgctcagttaggacccagagggaaccatcggaaaccccagcgcagcttctcttcctcctgctactctggctcccagataccaccggagaaattgtgttgacgcagtctccaggcacctgtctttgtctccgaggggaaagacgccaccctctcctgcgacgggccagtcagactgttagcagcagctactagcctggtaccagcaagaaacctggaccaggcctcccgaggcctcccgtctacttcgtttgggtcgctaacgtccgaaggccgacggggccctacgtcgggacctacttaccccgaagtaaccgtagggtttaccgaagggttcgggacgtaacggggttcgggggttaccgttaggggggaacctaacgggtaacctttccgaaccgtttccgtacccgtaaaccctaacgttaccccaaacccgtaacggtaaccgttacggggaaccgtacccgttaagggtaaacgtttaacgtttttacggacgtttaaacggtttttaacgtttaccgttacgttaccgtaacgttaccgtaaggtttaacgttaggttaaacgttttaacggtttttaaccccttacgtttacccgtttaaccggtttttccgggggaaccggggttaacggggtaacccgggtaagggggttacggaaccgttaacggttaaacccggtaaaaccggttaacgttcgggtaccgggtaccgttacggacccgtaaccgttacgtttccgtttacggttaccctttaccg

SEQ ID NO: 97237 - DNA, 561 bp, Homo sapiens
  misc_feature: GYAE6OF02IT2ED.38.53.E09.1.454.CMB.1.raw
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (428)..(428): a, c, t, g, unknown or other
  misc_feature (428)..(428): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagactgttagcagcagctacttagcctggtaccagcagaaacctggccaggctcccaggctcctcatcttggtgcatccagcacgggccactcggcatcccagacaggttcagtcggcaggtgggtctgggacagtacttcgactctcacatcaccagcnggacnctagaagtatttgctagtttatactgtcagcagttntagtattacgtttacctcttctaccgtttcgggacggtacgggaccgtaggggttacgaacgtacgtaacgtaaacggtaacgttggtacggtctacggtacctaccctagttccgttacggttcctttaccg

SEQ ID NO: 97238 - DNA, 555 bp, Homo sapiens
  misc_feature: GYAE6OF02IWK7O.38.53.E09.1.454.CMB.1.raw
  modified_base (201)..(201): a, c, t, g, unknown or other
  misc_feature (201)..(201): n is a, c, g, or t
  modified_base (401)..(401): a, c, t, g, unknown or other
  misc_feature (401)..(401): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagactgttagcagcagctacttagcctggtaccagcagaaacctggccaggctcccaggcctcctcattctttggtgcatccgagcagggccatggcatcccagacaggttcagtgcaggtgggtctgggacagacttcactctcacatcaccagactggacgcctagaacgtnttttcgacttagtttacttacgtgtacacgtctagttatgtattacgtttacctctacgtacgtttcggacggtacgggaccgtagggtacgacgtagtaacgaaacgtacgtgttacggacttacggacctaccgtagtcgttcgtcttaccg

SEQ ID NO: 97239 - DNA, 517 bp, Homo sapiens
  misc_feature: GYAE6OF02GHW56.38.53.E09.1.454.CMB.1.raw
  modified_base (201)..(201): a, c, t, g, unknown or other
  misc_feature (201)..(201): n is a, c, g, or t
  modified_base (398)..(398): a, c, t, g, unknown or other
  misc_feature (398)..(398): n is a, c, g, or t
  modified_base (507)..(507): a, c, t, g, unknown or other
  misc_feature (507)..(507): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggtaccagcagaaacctggccaggctcccaggctcctcatctttggtgcatccagcagggccacgtggcatcccagacaggttcagtggcaggtgggtctgggacagacttcactctcacatccaccagactggagcctgaagtntttgctagtttatactgtcagctagtatgattacgtttactctctacgtttcggcggtacggaccgtagggtgactagtacgaaacgtacgtgtacggctacgcacctntcgtgtcttc

SEQ ID NO: 97240 - DNA, 584 bp, Homo sapiens
  misc_feature: GYAE6OF02IYNLY.38.53.E09.1.454.CMB.1.raw
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (372)..(372): a, c, t, g, unknown or other
  misc_feature (372)..(372): n is a, c, g, or t
tcagtcgatcacgtcacgaccggtgctcgatttagagagagtgtgttgggtttggggagagctgctcagttaggacccagagggaaccatggaaacccagcgcagcttctcttcctcctgctactctggctcccagataccaccggagaaattgtgttgacgcagtctccaggcaccctgtctttgtctccaggggaaangccacctctcctgcagggccagtcagactgttagcagcagctactagcctggtaccagcagaaacctggccaggcctccaggctcctnatcttggngcatccagcagggccacgtggcatcccagacaggttcagtgcaggtcggtctgggactagacttcacgtctcgacngtcacagactggactcctagaacgtagttttcgacgtagtttaattactggttacagtcctaggtattgtattacgtttaaccgtcttactacgttttcggacggtaacgggtaccgtaggggtcgaccgtaagttaccggtaaaacgtaccttagggtaccggtacttacggtaccgtaaccgttagttaccgttacggttcctttaaccg

SEQ ID NO: 97241 - DNA, 513 bp, Homo sapiens
  misc_feature: GYAE6OF02JG5CW.38.53.E09.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggtaccagcagaacctggccaggctcccaggcctcctcatctttggncatccagcagggccactggcatcccagacaggttcagtggcagtggtctgggacagacttcactctcacntcaccagactggagcctgaagtatttgctagtttatactgtcagcagtatgattacgtttacctctctacgtttcggacggtagggaccgtagggtgtacagtacaaacgtactggtacgctacgacacctatctgtacttcg

SEQ ID NO: 97242 - DNA, 772 bp, Homo sapiens
  misc_feature: GYAE6OF02IE7OW.38.53.E09.1.454.CMB.1.raw
  modified_base (206)..(206): a, c, t, g, unknown or other
  misc_feature (206)..(206): n is a, c, g, or t
tcagtcgatcacgtcacgaccggtgctcgatttagagagagtgtgttagggtttggggagaaggctgctcagttaggacccagagggaaccatggaaaccccagccgcagcttctctttcctcctgctactctggctcccagactaccaccggagaaacttgtgttgacgtcagtctccaggcaccctgtctttgctccagggaangccaccctctccgtgcacggccagtcaggactgttacgcagcagctacgtacgcgtgtaccagcaacgaacctggaccaacggcctcccgaggcctacctctattcccgttttagggcgtaccgtagttcccgagtaccgacggggcccctaaccgttcgggacctacgttcccccgaaggtaccgtacgggttacgaggttcggacgtagggttcgggtacgtacggggaactacggtacctttaccgacgttacctacccgaaccgtaacgttacccgaaccgtaacgtaccgtacgggtacgtaccgttacggtaagttacgtttttcggtaacgttagttttaacgtttaaccgtagttacctaacgggtactaaggttaacttacggttaacgtttacgttttaacccgtacgttacgtttaaccggttttcgggaaccgggtaaccgggtaacgttagggttaccggaacgttaacggtaaccgtaaaccggtaaccggttcggttacgtaccggttacgacccgttaaccgtcgttacgtttaccgttcctttaacccg

SEQ ID NO: 97243 - DNA, 534 bp, Homo sapiens
  misc_feature: GYAE6OF02IK29G.38.53.E09.1.454.CMB.1.raw
  modified_base (202)..(202): a, c, t, g, unknown or other
  misc_feature (202)..(202): n is a, c, g, or t
tcagtcgatcacgtcacgaccggtgctcgatttagagagagtgtgttggggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggtaccagcagaaacctggccaggctcccaggctcctcatctttggtgcatccagcagggccactggcatcccagacaggttcagtggcaggtggtctgggacagacttcactctcaccatccacagactggacgcctagaagtattttcgctagtttattactgtcagctagtatgtattagtttacctcttactacgtttcgggacggtacgggaccgtagggtacgactagtacgaaacgtacgttggtacggctacgcctaccatcgtgtcttacg

SEQ ID NO: 97244 - DNA, 581 bp, Homo sapiens
  misc_feature: GYAE6OF02GFF4S.38.53.E09.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagactgttagcagcagctacttagcctggtaccagcaagaacctggccaggctcccgaggcctcctcattcgtttggncatccaggcagggccacgtggcactcccgagaccaggttcagtggcgtaggtcgggtctgggacagtccttcactctcaccntaccaccgagcgtaggactcctagaagttgtttacgacttaagttttactacgttgtaccgtagtctagttagtagtatttaccgtttacctcttacgttacgtttccggacggtacgggtacgtaggggtacgactacgtaacgaaacggtacgtggtacgcgtacgaccgtacctagtccgttgttcctccg

SEQ ID NO: 97245 - DNA, 624 bp, Homo sapiens
  misc_feature: GYAE6OF02IZNLD.38.53.E09.1.454.CMB.1.raw
  modified_base (176)..(176): a, c, t, g, unknown or other
  misc_feature (176)..(176): n is a, c, g, or t
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgtagtctccaggcnccctgtctttgtctccaggggaaagngccaccctctcctgcagggccagtcagactgtagcagcagctactagcctggtaccagcagaaacctggccaggctccaggctcctcattctttgggncatccgagcgagggccacgtcggcactcccaagacgaggttcagtggcaggtggctgggacagtacttcgactctaccacctatccaccgacgacgtacgggacgtaccgtagtaacgtagttttcgacgttagttttaagtttacttggttactaagtactagttagtacgttattaacgttttaccctacttaccttacgtttcgggtacgggtaacgggtaccggtacggggtacgggtactacgtaaccgtaaacggtaacggttaggtacgggtcgtacgaccggtacctaacgttccgttacggttccgttactaccg

SEQ ID NO: 97246 - DNA, 700 bp, Homo sapiens
  misc_feature: GYAE6OF02JWZWJ.38.53.E09.1.454.CMB.1.raw
  modified_base (199)..(199): a, c, t, g, unknown or other
  misc_feature (199)..(199): n is a, c, g, or t
  modified_base (308)..(308): a, c, t, g, unknown or other
  misc_feature (308)..(308): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccagggaanagccacctctcctgcagggccagtcagactgttagcagcagctacttagcctggtaccagcaagaaacctggccaggcctcccgaggctccctcacttcgtttcggtcnccgaacttcccgaaggccgaacggggtcccctaacgtcgggcctaactccccgaagtaccgtaacgggttccaaggttcggactacggttggggtcctagggggacctaggtactttccgaacgttcctaccgacctagtaccaaccgagtaacctggaacgcctagaagttacgttttacgacgttagtttacgttacgtcgttacagtctaagttacgtagttaattacgtttaccttacttaccgttaaccgtttcgggtaccggtaacggggtacccgtaaggggtcgtaacgtaaccgtaccggtaaaaccgttaaccggttcggttaacggtaccgttaggtaacccctaaccgttaccgttaccgtttaccgtccgtttaacccg

SEQ ID NO: 97247 - DNA, 764 bp, Homo sapiens
  misc_feature: GYAE6OF02IT7F7.38.53.E09.1.454.CMB.1.raw
  modified_base (105)..(105): a, c, t, g, unknown or other
  misc_feature (105)..(105): n is a, c, g, or t
  modified_base (219)..(219): a, c, t, g, unknown or other
  misc_feature (219)..(219): n is a, c, g, or t
tcagtcgatcacgtcacgaccggtgctcgatttagagagagtgtggttgggtttggggggagagcgtgctcagttaggacccagagggaaccatggaaaccccancgcagcttctcttcctcctgctactctcggcctcccagataccgaccggaagaaattcgtggttcgacgcaggtcctccaggccaccctgtctttcgtcctccgaggggaaagngccaccctctcctggcagggccagtcagtacctgtacgcagaccagctacttagccgttaggtaccagtacaacgtaaacctggaccaggccttacccgaaggtcctccctactacttccgttttggtcgccgtaacctaccgtaggtaccgtaacggggccctaacggttcgggtacctaccgttcccccgtaaggtaaccgttacgggtttaccgtaacgggttcgggtacgtacggggttcggggtttaccggtaggggtaaccgtacggtaaccgtttaccgaaccgttccctaccgaaccctactaccaaccgtacgtaccgttcgggacgtccgttaaggaacgttaacggttttgacttaaggttttactacgttacggtactaggtccaagttacttaggtaacttttaccgtttaaccttcgttaacgttacggttttcgggacgggtaacggacccggttagggtacgtacgttacggtaaccggaaacggtcgttaggtacgtcgtacgacctacgtacgtcgttactacgtcg

SEQ ID NO: 97248 - DNA, 668 bp, Homo sapiens
  misc_feature: GYAE6OF02JBXBF.38.53.E09.1.454.CMB.1.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (395)..(395): a, c, t, g, unknown or other
  misc_feature (395)..(395): n is a, c, g, or t
tcagtcgatcacgtcacgaccggtgctcgatttagagagagtgtgttgggtttggggagagcgtgctcacgttaggacccaggacgggaaccattggaaaccccagcgcagcttctcttcctcctgctactctggctcccagataccaccggagaaatttgttgttgacgctaagtctccaggcaccctgtcttgtctccgaggggaaagagccgaccctctcctgcacggggccagtcagactgttagcagcagctactagcctggtaccngcagaacctggccaggctccagctccncatcgttggtgcagtccgagccaggccaagtggcatcccagacgnggttcagtggacagtcggtctcgggaacaggacttcgactcgtacctaacngtaccaccgaagaccgtggactccctagaaagttagttttacgacttaaggtttaacttagtacgtactaacgtacctaaggttaagttacgtaagttaaccggttttacccgttacttaaccgttaaccgtttttaccggggaccggtaaacgggttacccgtaaggggttcgtaaccgtaaacgttaaaccggaaacggtaaccggttagggttaccgggtaacttccgggaccgtaacccgtacgttaccgttccggttactttacccgg

SEQ ID NO: 97249 - DNA, 517 bp, Homo sapiens
  misc_feature: GYAE6OF02I9B2W.38.53.E09.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (508)..(508): a, c, t, g, unknown or other
  misc_feature (508)..(508): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgtagcagcagctactagcctggtaccagcagaaacctggccaggctcccaggctcctcatctttggncatccagcagggccatggcatcccagacaggttcagtgcagtgggtctgggacagacttcactctcaccatcaccagactggacgcctgaagtatttgactagtttattacttgtcagtctagtatagtattacgtttacctcttacgtacgtttcgggacggtaggaccgtagggtcgacacgtacgaaacgacgtgtgcgtcgcactntctgtctcg

SEQ ID NO: 97250 - DNA, 705 bp, Homo sapiens
  misc_feature: GYAE6OF02HCAXU.38.53.E09.1.454.CMB.1.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagccttctggattactaaattttaatgaataatcgacctatcggactacgttcggggtacccgaacaacggcctaccggaagggggaacgggcctaggggagttggggtcctacgtaaaggttggtttaaggttacgggaaacgtaggttacgggtaacccaagtttacggccctttaagtcggaccggtacttcggttggtacgggaacggggtcccgtattacccgaacctactcctaccgaagacgaacgaaccgaccgaaagacgtacctcccgtagttactcgtagacctaaagtagaacctagtacctggaacgaccgtaggaacggaaccgtaccggtccctttacgttacttttccgtaccttacggaacccgtaaaaccgggtacccccggttagttacgggacgttaacggtacggtaaccgttaggtacggttttccg

SEQ ID NO: 97251 - DNA, 510 bp, Homo sapiens
  misc_feature: GYAE6OF02GKILR.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagactgttagcagcagctacttagcctggtaccagcagaaacctggccaggctcccaggctcctcatctttggtgcatccagcagggccactggcatccccagacaggttcagtggcagtgggtctgggacagacttcactctcaccatcaccagactggagcctgaagtattttgctagtttattactgtcagcagtatgattagtttacctctctacgtttcggcggtacggaccgtagggtgacagtacgaaacgactgtcggctgcaccatctgtctcg

SEQ ID NO: 97252 - DNA, 552 bp, Homo sapiens
  misc_feature: GYAE6OF02G8YLF.38.53.E09.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggtaccagcagaaacctggccaggctccaggctctcatcttggncatccagcagggccactggcactccccagacaggttcagtggctaggtgggtctgggacagtacttcactctcaccatcaccagactggacgcctagaagtatttgacttagtttattacttgtcagtctagtatgtaattacgtttacctcttcgttacgtttccgggacggtaacgggtaccgtaggggtcgaactacgtaacgaaacggtacgtaggtacggctacgacctactcgtctacgttccttaccg

SEQ ID NO: 97253 - DNA, 594 bp, Homo sapiens
  misc_feature: GYAE6OF02I8YF9.38.53.E09.1.454.CMB.1.raw
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
  modified_base (471)..(471): a, c, t, g, unknown or other
  misc_feature (471)..(471): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctctagggaagggcctggagtgggtctcaagtgttagttggaacagtggtaccatagcctatgcggactctgtgaaggccgattcaccatctccagagacaacgccaagagctccctgtatctgcaaatgaacagtctgagacctgaggacacggccttctatttctgtgacgaaaacggccccggtatcggcagtagactaagacggtttctttgactccgtggggccaggggtaacccgggtcaccgtctcctcncgccctccaccacgggccccagtccggtccttcccccgnggcccgccctcgcctccgagggccncaccccgtccggacgacggccctacgacggcccggccccgtaggggccctcggcccgttcgggtaccaacggtaccttacccgttcccgaccgtgacgtccgtacgtggaccggcggtaccgg

SEQ ID NO: 97254 - DNA, 526 bp, Homo sapiens
  misc_feature: GYAE6OF02FGP9N.38.53.E09.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctntcctgcagggccagtcagactgttagcagcagctacttagcctggtaccagcagaaacctggccaggctccaggctcctcatctttggncatccagcagggccacgtggcactcccagacaggttcagtggcagtgggtctgggacagcttcactctcaccatcacagactggaacgcctagaagtatttcgactagtttatactgtacagtcagttatgatttacgttacctcttactacgtttcggacggtaggaccgagggtcgacacgtaacaaacgacgtggtcgctgaccacctatccgttgtcttaccg

SEQ ID NO: 97255 - DNA, 551 bp, Homo sapiens
  misc_feature: GYAE6OF02H8FGP.38.53.E09.1.454.CMB.1.raw
  modified_base (259)..(259): a, c, t, g, unknown or other
  misc_feature (259)..(259): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctcttgattcaaatttaatgataatgccatgcactgggtccgacaagctccagggaagggcctggagtgggtctcaagtgttagttggaacngtggtaccatagcctatgcggactctgtgaaggcgattcaccatctccagagacaacgccaagagctccctgtatctgcaaatgaacagtctgacgcctgaggacacggcctttctatttctgtgacaaaggcccggtatggcagtagctaagagttctttgaccgtccgggccacgggacccggtcgaccgtctcctcacgcctccaccgaacggcccacgtccgtccttacccccgtcggccgtcccgtcgtccctccgacggacgcctacccgtccgtacggagacccg

SEQ ID NO: 97256 - DNA, 539 bp, Homo sapiens
  misc_feature: GYAE6OF02G4YA9.38.53.E09.1.454.CMB.1.raw
  modified_base (301)..(301): a, c, t, g, unknown or other
  misc_feature (301)..(301): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagactgttagcagcagctacttagcctggtaccagcagaaacctggccaggctcccaggctcctcatctttggngcatccagcacgggccacgtggcatcccagacaggttcagtggcaggtgggtctgggacagcttcactctcacatcaccagactggacgcctgaagtattttgctagtttattactgtctagctagtatgtattacgtttacctctactacgtttcggcggtaggtaccgagggtcgaacgtagtacgaaacggtaacgtggtacggtacgtcgaccaccgtactcgttacgtcttac

SEQ ID NO: 97257 - DNA, 522 bp, Homo sapiens
  misc_feature: GYAE6OF02GAJBH.38.53.E09.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
tcagtcgatcacgtcacgaccggtgctcgatttagagagagtgtgttgggtttgggagagctgctcagttaggaccagagggaaccatggaaacccagcgcagcttctcttcctcctgctactctggctcccagataccaccggagaaattgtgttgacgcagtctccaggcacctgtctttgtctccaggggaangccacctntcctgcagggccagtcagactgttagcagcagctacttagcctggtaccagcagaacctggccaggctcccaggctcctcatctttggncatccagcaggccatggcatcccagacaggttcagtggcagtgggtcngggacagcttcactctcacntcacagactganctagaagtatttcgcttagtttatactgtcagactagtatgtattacgtttacctcttactacgtttcggacggtacgggacgtagggtacgactagtaacgaaacgtacgtgtacggtctacgacctaaccgtatcgtagtccttacg

SEQ ID NO: 97258 - DNA, 551 bp, Homo sapiens
  misc_feature: GYAE6OF02JEXEM.38.53.E09.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (386)..(386): a, c, t, g, unknown or other
  misc_feature (386)..(386): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctctccgtgcagggccagtcagactgtagcagcagctactagcctggtaccagcagaacctggccaggcctccaggctccnatctttggncatccagcagggccagtggcatcccagacaggttcagtgcaggtgggtactgggacagtcttcgactctacaccatcaccagactggacnccgtagaacgtatttcgacttacgtttattacgtgttcagtactagttaatgtaattacgtttacctctctacgttcggacggtacggaccgtagggtacgaacgtacgtaacgaaacgtacgtaggtcggtcgtacggaccaccgtatccgttagttccttacg

SEQ ID NO: 97259 - DNA, 582 bp, Homo sapiens
  misc_feature: GYAE6OF02HTYMP.38.53.E09.1.454.CMB.1.raw
tcagtcgatcacgtcacgaccggtgctcgatttagagagagtgtgttgggactgagctggattttccttttggctattttaaaaaggtgtccagtgtgaagtgcagctggtggagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagctccctgtatctgacaaatgaacagtctgacgactgaggacacggtccctttcttatttctcgttagacaaaacggcccggtagtggacagtacgactaagaggtttctttagtactccgtcggggaccgacgggaacccgggtccaccgtcctcctcacgccctccaaccgaacgggcccagtccggtcccttcccccgtcggccctaccccgtccctacccaacgacgccacccgtccgtcggggctaaccgg

SEQ ID NO: 97260 - DNA, 683 bp, Homo sapiens
  misc_feature: GYAE6OF02JKDP3.38.53.E09.1.454.CMB.1.raw
  modified_base (392)..(392): a, c, t, g, unknown or other
  misc_feature (392)..(392): n is a, c, g, or t
tcagtcgatcacgtcacgaccggtgctcgatttagagagagtgtgttgggtttggggtaggagctgctcagttaggacccagagggaaccatggaaaccccagcgcagcttctcttcctcctgctactctggctccagataccaccggagaaattgtgttgacgcagtctccaggcacctgtcttgtctccaggggaaagagccacctctcctgcagggccagtcagactgttagcagcagctacttagcctggtaccagcagaacctggaccaggcctcccgaggtcctaccgtctattccgttttggcgcctaactcccgaggccacggggtcccaacggtgggactaccgtcccaaggacctaggttccaggtcggcaggttcgggtcnggggaactagtacctttcacgttctaccaccgtataccaaccgacgtacgtacgggacgtccgtaaggtaacgttacttttacggactttaacggttttaagtttaccttcggttacgaacgtacctaaggttacttacggttaactttacggtttaacccttccgttaccgttaaccgttttcgggaccgggtaacgggtaaccgtagggttcgaacgtacgttaacgaaaccgtacggttcggtacggtaccgtcggacctaccgtagttccgttacgtacctttaccg

SEQ ID NO: 97261 - DNA, 674 bp, Homo sapiens
  misc_feature: GYAE6OF02J2QL6.38.53.E09.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccgaggctaccctgttctttgtcctaccgaagggaaancgcccaccctctcctgcagggccagtcagacttgtacncagcagctactgcctggtacngcagacctgccaggcctcccgagtcctctactagttcgttgcnctacnccgagccgacggcctcgtgaccacctaccgagtacgtaggtcaggtcgcgtaggtcgggacgtagggactcgtaccttccgaccgtcctaccgacctacgaccgtaacgacgtacgtcggactaccgttaaggtaattcgtttacgaactttacgtttaactacgtcgttactacgtattacggttaacttacggttaactttaccgtttacctacgttccgtttaaccggtcgggaaaccgggtaacggtacccggttagggtaaccgtacttaaccggtaaccgtaaacggttgttacggtaccggtaccttaccggtaccgtaaaccctttcggttccgttacccgttaagttcccg

SEQ ID NO: 97262 - DNA, 527 bp, Homo sapiens
  misc_feature: GYAE6OF02GFFEA.38.53.E09.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (422)..(422): a, c, t, g, unknown or other
  misc_feature (422)..(422): n is a, c, g, or t
  modified_base (513)..(513): a, c, t, g, unknown or other
  misc_feature (513)..(513): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctntcctgcagggccagtcagactgttagcagcagctacttagcctggtaccngcagaaacctggccaggctcccaggctcctcattcttggtncatccagcagggccagtggcatcccagacnggttcagtggcaggtgggtcngggacaggtcttcactctcacatcacagctggacgctgaagtatttgctagtttattactgtcagcagtntagattacgtttacctcttcgttacgtttcggcggtacgggtacgagggtcggacagtaaccgaaacgtacgtgtacggctcgacaccgtntcgtcgtcttaccg

SEQ ID NO: 97263 - DNA, 556 bp, Homo sapiens
  misc_feature: GYAE6OF02HKWJ1.38.53.E09.1.454.CMB.1.raw
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
  modified_base (479)..(479): a, c, t, g, unknown or other
  misc_feature (479)..(479): n is a, c, g, or t
  modified_base (517)..(517): a, c, t, g, unknown or other
  misc_feature (517)..(517): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcactgggtccgacaagctccagggaaggcctggagtgggtctcaagtgttagttggaacagtggtaccatagcctatgcggactctgtgaagggccattcaccatcctccagacgacaacgccaaagngcctccctgtactctgacaaatcgaacngtactgacgacctgaggacacggtcctttatatttctgtacgacgaaaacggcccggttagtggcagtagactaagacgtttcttgacctcgtcgggccacgggacccggtccaccgtctcctcncgcctccaccgacggcccacgttccgtcccttccccgnggcccgcctcgcctccgacggacgccaccgtccgagacg

SEQ ID NO: 97264 - DNA, 633 bp, Homo sapiens
  misc_feature: GYAE6OF02H05CA.38.53.E09.1.454.CMB.1.raw
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcactgggtccgacaagctccgaggggaagggcctggaggtgggtctcgaaggtgttagttggaacaggtggtaccatagcctatgcggactctgtgaagggcattcacatctccagacacaacgccaagacgcctccctagtactcgtcgacaaatcgaactagtctaggacgacctaggaacggaccaccggtcctttacttaattttcgtgtacgaacgaaacggcccggtatcggacgtaggtacgtacgtaagtacggtttctttgaccgttccgtcggggacccgtacggggtacccggtccgtaaccgttccgtacctcgaccgtcccgtaccgaaccgacgggtccctacgttcccggtcccgttccccggtccggcccgtcccgtcgcccgtaccgacgggaccgacccgaccgtacccgacgaccg

SEQ ID NO: 97265 - DNA, 576 bp, Homo sapiens
  misc_feature: GYAE6OF02HMASQ.38.53.E09.1.454.CMB.1.raw
  modified_base (204)..(204): a, c, t, g, unknown or other
  misc_feature (204)..(204): n is a, c, g, or t
  modified_base (434)..(434): a, c, t, g, unknown or other
  misc_feature (434)..(434): n is a, c, g, or t
  modified_base (468)..(468): a, c, t, g, unknown or other
  misc_feature (468)..(468): n is a, c, g, or t
tcagtcgatcacgtcacgaccggtgctcgatttagagagagtgtgttgggtttgggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngcccaccctctcctgcagggccagtcagactgttagcagcagctacttagcctggtaccagcaacgaaacctggaccaggcctcccaggcctcctcattcgtttggcgcctatccagccgaggccacgtggccactcccagactaggttcaggtggctaggtcgggtctgggactaggtacctttcaccttctacacctataccaccagacgtggacgccgtagtaagtntttcgacttaagtttattactgtacagtcagttntagtattacgttctctacgttacgttcgggacggtaagggaccgtgggtacgactacgtaacgaacgtacgtggtacgcgtacgaccactacgttcgtcgttctaccg

SEQ ID NO: 97266 - DNA, 642 bp, Homo sapiens
  misc_feature: GYAE6OF02J06YJ.38.53.E09.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (310)..(310): a, c, t, g, unknown or other
  misc_feature (310)..(310): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccgganaaattgtgttgacgcagtctccaggcaccctgtcttgtcctcgagggaanacgcccaccctctcctgcagggccagtcagactgtacgcagcagctactagcctggaccagcaacgaacctggaccaggcctacccgaggcctacctctattcgttggtcncatccaggccgagggcccacgtcggaccacgtacccgagaccgttacggtcgaggtcggaccgtaggttcgggtcgtacggggactacgtactttaccacttccacacccgtatacccgaccgaacgacgtacggacgtaccgtaagtaagttactttacgcgtttagtttaacttaccgttataccgtagtaccgtaagttacttagtaacgtttacgtttaccttccttacgttaccgttcgggacggtacggtaccgtaggtacgactacggtaacgaacgtacgtacggtacgtacgtacgtacaccgttgtactcgttaccttaccg

SEQ ID NO: 97267 - DNA, 611 bp, Homo sapiens
  misc_feature: GYAE6OF02F72ZM.38.53.E09.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggtaccagcagaaacctggccaggctcccaggctcctcattctttggncatccagcgagggccacgtggctactcccgagactaggttcaggtgctaggtgggtctgggacagtacttcactctacacctataccaaccagacgtgggacgtcctaggaacgttattttcgacttaaggttttacttacgttgttactagtactagttataggtaactttacgtttacctcttacgtaccgtttcgggacggtaacgggtaccgtaggggttacgaacctaggttaaccgtaaacggtacgttggtacggtaccgtacggtaccctaaccgtacgtttaccgttcgttaccttacccg

SEQ ID NO: 97268 - DNA, 593 bp, Homo sapiens
  misc_feature: GYAE6OF02GBSDN.38.53.E09.1.454.CMB.1.raw
  modified_base (585)..(585): a, c, t, g, unknown or other
  misc_feature (585)..(585): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaaagagctccctgtatctgacaaatgaacagtctgacgacctgaggacacggtccttctatttctgtgacaaacggccccggtatggcagtagactaaggtaggtttctttgactccgtggggccacggggtaacccgggtcaccggtcctcctcacgccctacccaccgaacgggccctacgtccggtcccttcccccgtggccctacccctccctaccgaacgacgccacccgtcggtcggggacacgcgccggcccgtcggcgtcgccgtcggtacgacggtccttaccttcccgagtcgacgtacgacgtcggacggtcggcgnggtaccgg

SEQ ID NO: 97269 - DNA, 683 bp, Homo sapiens
  misc_feature: GYAE6OF02I7NPU.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggagaaattgtgttgacgcagtctccaggcaccctgtctttgtctccgaggggaaagacgccacctctcctgcagggccagtcagactgttagcagcagctacttagccttggtaccagcaagaacctggaccaggcctacccaggtcctccgtctattctttgggctacgatccaggcgacgggcctacgtcggtacacgtaccccgagtaccgtacggttacacgggtcggcgtaagggttgggtccgttaggggaaccacgggtaacctttccgaacctttcgtacccaacctagtacccaacggtaacgtacgtaaccggggactaccgtagggtaaactttcgttttacggaacttaagtttttaacgttacgttacgtacgtaacgtctaagtagttacgtaactttacgtttaccttcttaccgttaaccggtttcggggacggtaacgggtaccgttagggtacgaacgtacgtaacgaaacggtacgttacggcgtacgtagaccgtaactactccgttagttcctaccg

SEQ ID NO: 97270 - DNA, 668 bp, Homo sapiens
  misc_feature: GYAE6OF02H34ZB.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctctgcagggccagtcagactgttagcagcagctacttagcctggtaccagcaagaaacctggaccaggcctcccgaggccttccctctattccttttgggcgcactcccgagcgacgggcccacgtcggactacgcccctagaccgtaggttcaaggtgggtcaggttcgggtcgtaggggactaagggtaccttcgaaccttcaccgaaaccctacttccgaacccaaggtaccgttacgggacgtacccgtagtaaaacgttcgtttttcggacctttaaggttttaactttacgtcgtacgacgtactaacggttagttgtaaacgtttacgttttccctaccttacgttaccgtttcggggacgtacgggacgtaagggttcgaacgtacgtaaccgaaacggtacgttacgcgggtataccggctaaccgtaccttcgttcggtacctttcg

SEQ ID NO: 97271 - DNA, 546 bp, Homo sapiens
  misc_feature: GYAE6OF02HUKYI.38.53.E09.1.454.CMB.1.raw
  modified_base (201)..(201): a, c, t, g, unknown or other
  misc_feature (201)..(201): n is a, c, g, or t
  modified_base (297)..(297): a, c, t, g, unknown or other
  misc_feature (297)..(297): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggtaccagcagaacctggccaggctcccagctctcattcttggncatccagcacgggccacgtggcactcccagacaggttcaggtgcaggtgggtctgggacagacttcactcacaccatacaccagactaggacgtcctagaagtattttgacttagtttattactgtcagtctagtatgtattacgtttacctctcgttacgtttcgggcggtaacgggtacgagggtagactacgtacgaaacgtacgtggttacggtctacggacctaccgtagtcttcgtcttaccg

SEQ ID NO: 97272 - DNA, 659 bp, Homo sapiens
  misc_feature: GYAE6OF02IPHSK.38.53.E09.1.454.CMB.1.raw
  modified_base (203)..(203): a, c, t, g, unknown or other
  misc_feature (203)..(203): n is a, c, g, or t
tcagtcgatcacgtcacgaccggtgctcgatttagagagagtgtgttggggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgcccaccctctcctgcgagggccagtcagactgttagcagcagctactagcctgtaccagcaacgaaacctggaccacggtcctcccgaggcctacctctacttcgtttggtcgctactccgaggccgacgggccacgtcggcactccagactggtacaggtcgcgaggtcggtcgtaggactagtaccttcacgtctaccacctactaccaaccgagtacgtcggactacgtagtaagttacgtttacgacgtttaagttttacttacgttcgtacagtacctagttatacggttaacttttacgtttaccctcgttacccgttaccggtttaccggggaccgggtaacggtaccgggtaggggtacgtaaccgtaacgtaaccggaaaaccgttaggttaccggtacggtcgtaccggaccgtacccgttcgttccgttaccgttcttacccg

SEQ ID NO: 97273 - DNA, 633 bp, Homo sapiens
  misc_feature: GYAE6OF02JI38Q.38.53.E09.1.454.CMB.1.raw
  modified_base (199)..(199): a, c, t, g, unknown or other
  misc_feature (199)..(199): n is a, c, g, or t
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtcttgtctccaggggaanagccacctctcctgcagggccagtcagactgtagcagcagctactagcctggtaccagcagaacctggccaggcctccgagctcctcatcgttggtgacatccagcgtacgggcccatcggacactccccgagacctaggttcaaggtcggcaggttgggtactgggactaggtccttacactccgtcaaccntacaccagtactggacgctagaaagtntttacgactagtttacttactcgtactagtctaagttacgtacgttaactttacgtttacccttacgttccgttaaccggttttccgggagggtaaaccgggtacgttaccggggtacgtaaccggtcggttaaacccgtaaacggtacgttacgggtacgggtacttaccggaccttaacccggtaacgttccgtttaacgtctttaacccgg

SEQ ID NO: 97274 - DNA, 689 bp, Homo sapiens
  misc_feature: GYAE6OF02FQHHC.38.53.E09.1.454.CMB.1.raw
  modified_base (200)..(200): a, c, t, g, unknown or other
  misc_feature (200)..(200): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcacctgtctttgtctccaggggaaanacgccaccctctcctgcagggccagtcagactgttagcagcagctacttagcctggtaccagcagaaacctggccaggcctcccgaggcctcctcactttcgttttggtcgcacttcccgaaggccgacggggcccacgttcgggaccacttcccccgaagtacgtacgggtttaccaggttcggaccgtaggttggggtaccctaggggaccagtacccgtttacacttcctaccaaccgactacccaacccgtaacggtaccgtacgggacgtcccgttaggaaacgttacgttttgacgttagttttaactacgttacggtcctaggtacctagttatagtaactttacggtttaccttcgttacgttaccgtttcgggaccgggtaacgggtaccgtaggggttcgaaccgtaacgtaaccgtaaacggtacgttaggttacggtcgtacgacctaccgtagttccgttacggttccttaacccg

SEQ ID NO: 97275 - DNA, 659 bp, Homo sapiens
  misc_feature: GYAE6OF02HUCA8.38.53.E09.1.454.CMB.1.raw
  modified_base (319)..(319): a, c, t, g, unknown or other
  misc_feature (319)..(319): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagacgcccaccctctcctgcgacgggccaggtcagactgttagcagcagctacttagcctggaccagcaagaaacctggccaggcctacccgaggccttccgtcacgttcgttttggcnctactccagccgacgggcctacgtcggacacgtccccgaagacctagggttacaggtcggtactagggttcgggtacgtaggggaacagtacctttaccacgtcctacacccgtataccaaccgagtaaccgtggacgtccgtagtaagttagttttcgagttaagttttacttacgtacgtacgtagacgtaggttattacggttattaacgttttaccctacttacgttaccgtttcgggacggtacgggaccggtaggggtacgacgtaacgtaaccgtaaacggtacgtaggtacggtactaccggacctaaccgtattccgttacgttcttaccg

SEQ ID NO: 97276 - DNA, 577 bp, Homo sapiens
  misc_feature: GYAE6OF02ILSLU.38.53.E09.1.454.CMB.1.raw
  modified_base (313)..(313): a, c, t, g, unknown or other
  misc_feature (313)..(313): n is a, c, g, or t
tcagtcgatcacgtcacgaccggtgctcgatttagagagagtgtgttgggtctgggggagacttggtagagcctggcaggtccctgagactctcctgtgcagcctctggattcaaattttaatgataatgccatgcactgggtccgacaagctccagggaagggcctggagtgggtctcaagtgttagttggaacagtggtaccatagcctatgcggactctgtgagggccgattcaccatctccagagacaacgccaaagagctcccctgtatctgcaaatgaacagtctgagacctgaggacacggccttntatttctgtgcaaaaaggccccggtatggcagtagctaagaggttctttgactccgtgggccagggaacccgggtcaaccgtctcctcacgccctaccaccgaaacgggcccactaccggtccttccccctcggccgcccgtccgcctccgagggacgaccgaccctcccgaacgacgccaaccgacggcggccccgtgggctcgccgtcggtccaaacggacttaccttccgaacgttcgacttccgactcggtagccgggcg

SEQ ID NO: 97277 - DNA, 635 bp, Homo sapiens
  misc_feature: GYAE6OF02H7521.38.53.E09.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaanagcccaccctctcctgcagggccagtcagactgttagcagcagctacttagcctggtaccagcagaaaccgtggaccaggcctccacggcctcctcatctttggcncatccagccagggcccacgtcggaccacgtacccagtacgtggttaccaggttggacgtagggttcgggtcgttagggactacggtacttcgaaccttccgtacaaccctactaccaccgtaacggaccgtgggaccgccgttagtaacgttacgttttagaccgttaaggttttactttacgtgtactacgactagttattagtaattacgtttaaccctcgttaccttaacggtttcgggaccgggtagggtaaccgtagggtacgactacgtacgtaaacgcgtaggttcgacgttgaccgtacgttactcgttacgtacttccg

SEQ ID NO: 97278 - DNA, 722 bp, Homo sapiens
  misc_feature: GYAE6OF02JX9M4.38.53.E09.1.454.CMB.1.raw
  modified_base (246)..(246): a, c, t, g, unknown or other
  misc_feature (246)..(246): n is a, c, g, or t
  modified_base (295)..(295): a, c, t, g, unknown or other
  misc_feature (295)..(295): n is a, c, g, or t
tcagtcgatcacgtcacgaccggtgctcgatttagagagagtgtgttgggtcgtgggggagacgttggtagagcctggcaggtccctgagactctcctgtgcagcctctggattcaaatttaatgataatgccatgcactgggtccgacaagctccagggaagggcctggagtgggctcaagtgttagttggaacagtggtaccatagcctatgcggactctgtagaggccgattcaccatctcanagacaacgccaagacgctccctgtactctgcaaatcgaacagtctaganacctagaggaccacggtccttacgtagtttactggtagtaccgaaaacgggcccccggttagtcggactaacggtacgtacgtaaaccggtagggtttactttacggaccttccggtacgggggacccgtaaccgggggtaaacccggggtccctaaccggtcccgttacccgtccgtaacggtccccttacccgaacccggaaccgggacccgtaaaccggtccgttaccccggttcccctcggggtccctacccgttcgccttacccggacggtaccggcctacccgtccggtaacgacgacccacgttaaccggcccggacccgtcgggcctcggtccgtacgggtaaccgtaaccgggtacttacccgttacccgtacggttaccgtacgtaccgtaccggttcggacgggtcggtacccggg

SEQ ID NO: 97279 - DNA, 808 bp, Homo sapiens
  misc_feature: GYAE6OF02G2PLQ.38.53.E09.1.454.CMB.1.raw
  modified_base (188)..(188): a, c, t, g, unknown or other
  misc_feature (188)..(188): n is a, c, g, or t
tcagtcgatcacgtcacgaccggtgctcgatttagagagagtgtgttgggactgagctggattttccttttggctattttaaaaggtgtccagtgtgaagtgcagctggtggagtcgtgggggagacttggtagagcctggcaggtccctgagactctcctgtgcagcctctggattacaaatttaangaataatcgaccagtgcacgtcgggtccgaacaagcctaccggaagggggaacgggccctgggacgggttcgggtcctacgtaaaggttggttttaacgggttagggaaaccgtagggttacgggtaaaccctaaggttaacggtcccgttaagtcgggaccgggttaaccttcggttaggtaagggaaaccgggggcccgttaactttccgaaccctacttacccgtaccgaaggaacggaaccaaaccggaccaaacggcgtaccctacccgttagttactcgtacgtaacaaagtacgaactagttacgacggaacgtaccgtaggaacgggtacctaacccggttcccttttagttaacgttttcgtacggttacgaaaccggtaaaccgggtccccgttaggtcggactagggtacgtaattaagggttcgttttcttacggtcgtaccgggtacggggacccggtaacggggtacccgtaccgacccgttacctccgtaccgaccgtccctacccgaacgaccggtccctaggtcccgttcccgtccccgcggtacccctacccgtaccctaccgaacgtccgtaccgtaccggtacggtccgggacctaccgg

SEQ ID NO: 97280 - DNA, 555 bp, Homo sapiens
  misc_feature: GYAE6OF02G3JGC.38.53.E09.1.454.CMB.1.raw
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtcagactgttagcagcagctactagcctggtaccagcaagaaacctggccaggcctcccaggctcctcattctttggnctactccagcgagggccagtcgcactcccagacaggttcagtgctaggtggcgtagggacagtactcactctacacatccaacagactggacnctagtaactatttcgacttagtttactagtcgtatagactagtatagtattacgtttacctctacttacgtttcggggacggtacgggtaccgtaggggtacgactaagtaaccgtaaacgtaagttcggtaggtctcgaccacgtactcgttactcttac

SEQ ID NO: 97281 - DNA, 750 bp, Homo sapiens
  misc_feature: GYAE6OF02G3N9N.38.53.E09.1.454.CMB.1.raw
  modified_base (202)..(202): a, c, t, g, unknown or other
  misc_feature (202)..(202): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagctgttagcagcagctacttagcctggtaccagcaacggaacctggaccaggcctcccgaggtcctcctcattcgtttggacgcactccgagccgacgggccctagtcggcctaacgtccccgaagaccgttaggtttaccaggtcggactagggttcgggtacgtaggggaacctaagggtaccctttacgaaccttccgtaccctaaccgtacgttacccgaaaccggtagggtaacccggttcgggaaccgtacccgttaagggtaaacgtttaccgtttttaccggacgtttaacggttttttaaccgttaccgttacggttacgaacggttaccgtaaggttagttaacgtaacgttttaaccgtttaccctaccgttaccgttacgggtttaccgggacgggtaacgggttaccgtaggggtacgaacgttacgtaacccggtaaacggtacgttacggtacggtcgttaccgacccgtaacccgttagttccgtttacggtaccctttaacccgg

SEQ ID NO: 97282 - DNA, 697 bp, Homo sapiens
  misc_feature: GYAE6OF02FIFRC.38.53.E09.1.454.CMB.1.raw
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcactgggtccgacaagctccgagggaagggcctggagtgggtctcgaagtgttagttggaacaggtggtaccatacgcctatgcggactctggtggaacggggccgtaattccaccatcctaccgagacgaacaacgaccaaggacgcctaccctgtactctgacaaatcgaaacagtactacggaagtaccctaggaacggtacgaccggtacctttcttaactttcgtgtacgtacgtaaaacgggtccccgtagtcggtactaggtacgtacgttaaggtcggtttactttcggaccgttccggtacggggtacccgaacggggtaaccccgggtcgttaccccgtcctacccgtaccgtacgtaccccttacccgaacccggtaaccgggtaccccgtacggttcccggttccccgtttccccggtccggccccgtccccgtcggtcccgttaccggaccgggaccgacccggtaccccgtccgggaccgaccgg

SEQ ID NO: 97283 - DNA, 797 bp, Homo sapiens
  misc_feature: GYAE6OF02GF5GN.38.53.E09.1.454.CMB.1.raw
  modified_base (147)..(147): a, c, t, g, unknown or other
  misc_feature (147)..(147): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccganaagctccagggaaggcctggagtgggtctcaagtgttagttggaacagtggtaccatagcctatgcggactctgtaggaacgggccattcaccatctccagacgaccaacgccaaagacgcctccctagtactctgactaaatgaaactagtcgtaggaacgacccgtaggaacggaccgtaccggtcctttacgttacttttcgtggtcgaacgaaaaccgggtccccgttaagtcggactaacggtacgtacgttaaaggttacggtttcgtttacggacgttcccggtacgggggacccgtaaccgggggtaaccccgggtaccgtaacccggttccctcccgtaccgaccggtccccttacccgaaacccggaaccggggtacccctaacggtttacccggttcccccgtttacccccggttaccgggccccgttccccgttaccggtaccctacccggacgggacccgtacccgtaccccgttacccggagaacccgtaccgaaccgacccgggacccgggtcccgtacgggtcccgtacggtcccggtacgggttaacccgaaaccgggttacccgttaacccggttaccccgtaaggttaccgtaccggtacccgtaacggtacggtacgggcccgggtacgg

SEQ ID NO: 97284 - DNA, 559 bp, Homo sapiens
  misc_feature: GYAE6OF02I4R99.38.53.E09.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggaccagcagaaacctggccaggcctcccaggctcctcatctttggncatccagccgagggccacgtggcatccccagacctaggttcaggtggcaggtgggtctgggacagtcttcactctcgacatccaccagacgtggacgtcctagtaacgtattttggaccttagtttacttacgtgtacagtactagttatagtagttacgtttacctcttacgttacgtttcgggacggtacgggtacgtagggtacgactagtaccgaaacgtacgtggtacgcgtacgcctacattctagtcttacg

SEQ ID NO: 97285 - DNA, 650 bp, Homo sapiens
  misc_feature: GYAE6OF02GDQ1K.38.53.E09.1.454.CMB.1.raw
  modified_base (316)..(316): a, c, t, g, unknown or other
  misc_feature (316)..(316): n is a, c, g, or t
  modified_base (387)..(387): a, c, t, g, unknown or other
  misc_feature (387)..(387): n is a, c, g, or t
  modified_base (531)..(531): a, c, t, g, unknown or other
  misc_feature (531)..(531): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttccttttggcttaattttaaaaggtgtccagtgtgaagtgcagctggtggagtcgtgggggagacgttggtagagccgtgggcacggtccctagagacctctcctgtgcagcctcgtgaaattctaaatttaatgaataatgaccatgcacgtggtccanacgctacgagggacggccgtggagtcggtctacgagttgttagttggaacagtacggtaccagtagcctanggaccgtactcgtggtacgggaacgggtcctacgtttaccaccgtactccgtacccgaaggaacgaaaccgaaccggacccaaaaggccgtaccctttccccgtagttacctacgtcgaaactaagtacgaaacctcggttacncgggtaacaccgtaggacgtacgacccgttcctttacttagttttccacgttacggaaccggtaaaccggtccccgtagtacgggactaaggtaccgtagttaacggttcggttttacc

SEQ ID NO: 97286 - DNA, 737 bp, Homo sapiens
  misc_feature: GYAE6OF02ISQZO.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaagagccaccctctcctgcgagggccagtccagactgttagcagcacgtctacgttacgccgtcggtacccagaccaacgtaaaccgtcggacccgacggcctaccccgaggtcctccctactacttcgtttggtcgactactccgagtcgacgggccacgtcggaccacgtcccgagacgtacggttacaggtacggcgtacggttcgggtacggtacggggtaacgacgttaaccgttcctaccgttacccgtacccgtaacccgtacttaccccgaaacccgtaacgaccggttacgggaccgtacccgtaggtaaacgtttagttttaccgaccgttttaagttttaaccgttacgttacgttacgtaacgttcgtaaggttaacgttacgtaacgttttaccgtttaccttaccgttaccgttacggtttaccgggacgggttaacggaccggtgggtacgacttacgtaaacgaaaccgtacggttagtaccggtacgtacgaccttaccgtacttcggttacgttacttccg

SEQ ID NO: 97287 - DNA, 698 bp, Homo sapiens
  misc_feature: GYAE6OF02IPW0T.38.53.E09.1.454.CMB.1.raw
  modified_base (591)..(591): a, c, t, g, unknown or other
  misc_feature (591)..(591): n is a, c, g, or t
tcagtcgatcacgtcacgaccggtgctcgatttagagagagtgtgttgggtttgggggggagaggagccccagccctgagattcccaggtgtttccattcagtgatcagcactgaacacagaggactcaccatggagttgggactgagctggatttttcctttggcttattttaaaaggtgtccagtgtgaagtgcagcgtggtggagtcgtgggggagtacgttgggtagagcctgggcacggtccctagacgacctcctcctgtgcacgccttcgtggtattactaaattttaagtgaattaatgccatcgacacgtcgggtaccgacaagccgtaccggaggggacgggccgtgggacggtgggtactacgtaaggttcggttaaggttcggaacgtacggttcgggtaaccctagtaccggtacttaggtacggcggtaacttcgtacgggtagggaaccgggtccgtagttacccaactacttccgtaccgaacggtactaaacccgaaccggaacccgaaaggaccgtacccttacccgtagttactccgtacgaactaatacggtaactagtacgacggtaacnccgttaagggacgaaccggtaccgttcctttacgttcgtttctacgtacgaacggtaacccggtcccggtaatcggtactaggtacgtaacgtacggttgtttaccg

SEQ ID NO: 97288 - DNA, 574 bp, Homo sapiens
  misc_feature: GYAE6OF02FRCF2.38.53.E09.1.454.CMB.1.raw
  modified_base (213)..(213): a, c, t, g, unknown or other
  misc_feature (213)..(213): n is a, c, g, or t
  modified_base (299)..(299): a, c, t, g, unknown or other
  misc_feature (299)..(299): n is a, c, g, or t
tcagtcgatcacgtcacgaccggtgctcgatttagagagagtgtgttggggtttggggagagctgctcagttaggacccaggagggaaccatggaaaccccagccgcagcttctcttcctcctgctactctggctcccagataccaccggagaaattgtgttgacgcagtctccaggcaccctgtctttgtctccaggggaagagccaccctntcctgcagggccagtcagactgttagcagctagctactagcctgtaccagcagaacctgccaggctcccaggctcctcatcttggncatccagcagggccactggcatcccagacaggttcagtgcaggtgggtctggggacagtacttcgacctcgtcacccatccaacacgactaggacgtccctagaagtacttttgactagtttactactgttcagtctagtatcgattacgtttacctcgttctaacgtttcggacggtacgggtacccgtaggggttacgactacgtaaccgaaaacggtaaccgtggttaggtaccgtacgtacccgtaacctacgttccttagttccttaccg

SEQ ID NO: 97289 - DNA, 1006 bp, Homo sapiens
  misc_feature: GYAE6OF02HRTGR.38.53.E09.1.454.CMB.1.raw
tcagtcgatcacgtcacgaccggtgctcgatttagagagagtgtggttgggtcgtgggggagacttggtagagcctgggcaggtccctgagactctcctgtgcagcctctggattacaaatttaatgataatgcctatgcacgtcgggtaccgaacaagctaccgaaggggaacgggcctggagtgggtctcgaagtggttaggtaggaacagttacggtaccagtagcctaatcggcggtactcgtaggtacggaagggccgtaattccgaccattcctaccgaggaacgaaccaacggacccaaaggacgcctacccgtagtactctcgaactaaatgtaaaccgtagtcgtcgacggtaccgtaggaaccggaccgtaccggtcctttactttacgttttacggtacggttacggaaaaccgtaaaaccggggtccccggttaagtcggtacctaagggtaaccgtaacggttaacgggttaacggttttcgttttaaccggtacccggttacccggggtacccggggggtaacccggggtaaaccccggggggttaccccggggttaccccgttaaaccccggttccggtttaccccgtacccggttaaccccgggtaccccctaccccggaaacccgggaacccgggttaccccccgttaaccgggtttcccccggggttttaaccccctttcccccccggggtccggggtccccccgtttacccccggtcccgggttacccgtaaccccgggaaccgggttacccggtaaccccccgttaacccgggttaaccccgggaccgggtaaccggaacccgaaccccggtccccggggtacccgggttccccggggtccgggttacccggtcccgggttaacccgggtttcccggggtaaaccgggaccggtttaaaccccgttcccgttaaccccgggtaggtttcccgaaccgggttaccgggttaaccggtacgggtccggggtaccccggggttaccggg

SEQ ID NO: 97290 - DNA, 689 bp, Homo sapiens
  misc_feature: GYAE6OF02HCKP1.38.53.E09.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagtcgatcacgtcacgaccggtgctcgatttagagagagtgtgttggggtttggggagagctgctcagttaggacccagagggaaccatggaaaccccagcgcagcttctcttcctcctgctactctggctcccagataccaccggagaattgtgttgacgcagtctccaggcaccctgtctttgcctccgaggggaancgccaccctntcctgcacgggcagtcagactgtagcagcagctactagcctaggtaccagcagaaacctggaccaggcctacccgaggtcctccctactacttcgtttaggcgacctactccgagacgtacggggcctaacgtcggactacctaccccgaaggtaccgtaacggttcgaacgggtcggtacgtacgggttcggggtcgtacggggaactacggtacctttaccgacttccgtaccaaccgtactaccacccgagtacggtacggacgtaccgtaggtaaagttctttacggaccttaaggttttaactacgtcgtacagtactagtagtacgttacgtttacgtttacctaccttacgttacgtttccggggacgaaccgggtacgtaagggtcgtaacgtaacggttaaccgaaacggtacgttacggtaccggatccggtaacctaccgttacggttacgttccgttacttacccg

SEQ ID NO: 97291 - DNA, 839 bp, Homo sapiens
  misc_feature: GYAE6OF02G7G40.38.53.E09.1.454.CMB.1.raw
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtggggagacttggtagagcctggcaggtccctgagactcctcctgtgcacgcctctggtattactaaaatttaatgtaattaatcgaccagtcgctaacggtcggggttacccgaacgaaacggtccgtacccggaaggggtaaccgggcccgtagggacgggttggggtacctaccgtaaggtttggtttaacggttacggaaacgtaggggtacgggttaaccctaaggttacggacccgtttaagtcgggtaccgggtaacctttaccggtagggtttaacgggaaacgggggtcccgtaacgttaccgtaaccctaacgttacctaccgtaacggaacgtaaccgaaaccgaaccgtaaacggtaccggtaccctaccccgttagttaacccttccgtaacgtaaccgttaaacgttaacggtaaacgtaacggttaccgttaacggtaacggtaaccgttacggggaaaccggttaaccggtacccgttacccgttttactttaccggttttacgttaccgttaccggtaaaccggtaaaacccggggttacccccggtttaagtaccggggttaaccgtaaccgggttaacggtaaccgttaccgggtttaaaggttttaccccgg

SEQ ID NO: 97292 - DNA, 744 bp, Homo sapiens
  misc_feature: GYAE6OF02F1T64.38.53.E09.1.454.CMB.1.raw
  modified_base (151)..(151): a, c, t, g, unknown or other
  misc_feature (151)..(151): n is a, c, g, or t
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
  modified_base (335)..(335): a, c, t, g, unknown or other
  misc_feature (335)..(335): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagactacccaccgganaaattggtgttgacgcagtcctccgaggccaccctgtctttgtctccgaaggggaaacncgccctaccctctcctgcacgggccagtcagtactgttacncagcagtctactagccgtgtaccngacaacgaaccgtcggaccgaggccctacccgaggcctccgtactagttcgtttgggacnctactacccgaaggtccgaacgggtcccgtacgtcggtaccaaccgtacccgaacgtaccgtaaggttccgaggtcgggtaccggtacgggttacgggtacggttaacgggacgttaaccggtaccgttaccgtacccttacggtaccctaaccgtacttacccgtaaccgaagtaccggtaacggtctaccggtagtaaagtttcgtttacgactttaacgtttactacgttcgtaaccgtaacgtattaccggtattagttacgtttaccgtttacctccgttacgtaccgtttacgggtacggtaacgggtaccggtaggtacgaacttaccggtaaacgtaaccggtaccgtacggttcggaccgtcgtaaccctacggttctaccgttacggtacccttacccg

SEQ ID NO: 97293 - DNA, 711 bp, Homo sapiens
  misc_feature: GYAE6OF02H23HV.38.53.E09.1.454.CMB.1.raw
  modified_base (137)..(137): a, c, t, g, unknown or other
  misc_feature (137)..(137): n is a, c, g, or t
  modified_base (163)..(163): a, c, t, g, unknown or other
  misc_feature (163)..(163): n is a, c, g, or t
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
tcagtcgatcacgtcacgaccggtgctcgatttagagagagtgtgttgggtttggggagagctgctcagttaggacccagagggaaccatggaaccccagcgcagcttctcttcctcctgctactctggcctccagntacccaccggagaaattgtgttgacncagtcctcaggcacctgtcttgctccgagggaaancgccacctctctgcagggccagtcagactgtancagcanctattancctgtacancaagtaaccgngacgacggcctaccgaggtcctcgtactattcgtttggagcctatcccagccgagggtccaaccgttcggacctacgtacccaggtacgtacggtttaccgaggtacggcgtaacgttgggtaccgtaggggaacctacgtacttacccacggttacctcccgtaactacgtacccaccgaacgtccggttaacggacgtacccggttagtaaaccggttagtttacgggtactttaaggtttaacgtttactacggttactaacggtacgtaacgtttaagtaccgttaatttacccgttttaccgttaccttaaccgttacgttaccggggtaccggtaaagggtacccggtagggttacgaagtaaccgttaacgtaaaaccggtccgtagtaccggtcgtacggtaaccgtacccgtaggttccgttacgttaccgttaaccc

SEQ ID NO: 97294 - DNA, 828 bp, Homo sapiens
  misc_feature: GYAE6OF02J1M04.38.53.E09.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (440)..(440): a, c, t, g, unknown or other
  misc_feature (440)..(440): n is a, c, g, or t
  modified_base (535)..(535): a, c, t, g, unknown or other
  misc_feature (535)..(535): n is a, c, g, or t
tcagtcgatcacgtcacgaccggtgctcgatttagagagagtgtggttgggtttggggaggagctgctcagttaggacccgagagggaaccatggaaaccccagcgcacgcttcttcttccctcctgcctactctggcctcccagactaccaccggagaaacttgtgttgacgcagtctcaggcacctgtcttgctcgagggaaancgccacctctccgtgcgacggccagtcacgactgttanccagacctaggtaccttaacgtagtccgttacggtaaccaggaccgaaacgtaaccgtcggcccaacgggcctacccggacgtccgttacccttctacgttaccgttacgggtactactaacgttaccgaggtcccgaacggggcccctaaccgggtcggacctacctacccggaacgtaccttcggggtttaccnggtaccggggtacgtaacggggttccggggtacgtaacgggggaacctaacggtttccgtaaccgtaccggttaccctacctaaccccggttaanacccggtaccggtaaaccggtccggtaaccgggggtacgtcccgggtaaaggttaacgttaccgggttttaggtaacccgttaagggtttttactttacggttcgtaaacccggtacgtaccgtaaggtttaaccgtcgtttaacggttacgttttaccgttacttaacggtttaccgttcgggtaccgggttaaccgggtaggtacgggtacgtaacggtaagtaccggtaaaacgtcgggtttacacggttaccacgggtacccacgttaccgtcgtacgttcttaacccg

SEQ ID NO: 97295 - DNA, 687 bp, Homo sapiens
  misc_feature: GYAE6OF02GNSMB.38.53.E09.1.454.CMB.1.raw
  modified_base (259)..(259): a, c, t, g, unknown or other
  misc_feature (259)..(259): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcacgtgggtccgacaagctccgagggaaggcctggaggtggtctcaagtgttagtggaacngtggtaccagtagcctatgcgactctgtggagggccgtatcaccatcctaccagacgaacaacgaccaagacgcctccctagtactcgtcgactaaatacgaacgtagtcgtagacgaccgtaggacggaaccgtaccggtccctttacgttactttcgtaggtacgaacgtaaaaccgggtccccggtaagtcgggaccgtaagttaacggtacgtaaaggttacggtttccgtttacgtaccgttccggtacggggtacccggaaccggggtaaccccgggtccgaacccggttccctccgtaccgaccgtcccgtacccgaaccggacccggtacccgtacgtccggttccccgttccccgtacggtccccgcccgtccgcccgtaccgacggtacccgacccgtacccgtaccggagtacccgg

SEQ ID NO: 97296 - DNA, 744 bp, Homo sapiens
  misc_feature: GYAE6OF02JUJE3.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctccagactaccaccggagaattgtgttgacgcagtctccaggccaccctgtctttcgtctccgaaggggaagacgccctaccctctcctcgacgacgggccagtcagtacgtgttacgcagcacgtctacgtacgccttacggtacctagacaacggaaaccgtcggacctacggtacctccgacggtcctccctacgtacttcgtttcggtcgtactacgtccgtacgcggaccgggtccaccgtggacctaccgtacccgtaacggtacggtacggttacgacgggttacggacgtacgggtttacgggtcggtacggtaacgtacgttaccgttacctaccgtaccgtacctaacctaccgttaccaccggtaacgtaaccgggacggtaccggtacgttacggttaaacgttggtttaaccgtacgtttaagtttaaccgtttacgtacgttactacgttagtacgttaagtacgtttaacttacggtttactaccgtttccgtttaaccggttcggaccggtaaggttcggtacgggtactacgtacgtaacggtaacgtacggttcgacgtacgtacgtcctaaccgttcgtacgtcttacgttccg

SEQ ID NO: 97297 - DNA, 729 bp, Homo sapiens
  misc_feature: GYAE6OF02JJNFB.38.53.E09.1.454.CMB.1.raw
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (288)..(288): a, c, t, g, unknown or other
  misc_feature (288)..(288): n is a, c, g, or t
  modified_base (570)..(570): a, c, t, g, unknown or other
  misc_feature (570)..(570): n is a, c, g, or t
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
  modified_base (612)..(612): a, c, t, g, unknown or other
  misc_feature (612)..(612): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggactattttaaaaggtgtccagtgtgaagtgacagctggtggagtcnggggganacgttggagagccgtggactagggtcccngacgtactctccgtagtgccagcctgtggattcgaaattttancgataatcgtacctagtcgactacggtcgggtacccgaacgtaaccggcctaccggtaagggggaaaccgggtcccttaggggtaacggttcgggggttaccaccggtaaaggtttcggtttaagggttaacggaaactacggggtttacggtaaaccccgtagttacgggtacccgttaagtacgggacgggtacccttacgtaggtacgggaaacggggttcctaacgtttacccgaaccgtacttcccgtaacccaagggactacgaaccggtaccganaacggtcctacctgtaactcgaanaccgtaaancgtaaaccngtcgtaagaccgtgtaaggccgaacgtccggttacttacgtactttcgtaaccgtggaaaccgttaaccggccggtaatcggtaataccgtaacggtacttaacgggtatttaccgg

SEQ ID NO: 97298 - DNA, 795 bp, Homo sapiens
  misc_feature: GYAE6OF02GC8ZD.38.53.E09.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctccagataccaccggagaaattgtgttgacgcagtctaccaggccaccctgtctttgtcctcgaaggggaanacgccaccctctccgtgccgagggccacgtacagacttgttagactagcgagtctaactagccgtggtaacccagaccgaacgaacccgtggacccctaggcctccccgtaaggtcccgtaccctcgtactttccgttacgggtcgactactacccgaggtccgtaaccgggcctaacgtcggacctaaccncccgtaaatcgtaggttaccnggtcggacggttcggtagggtccgtagggaacctaggttacctttcgaacccttcgtaaccctaacctacgtacccgtaaaccgtagttaccggacggtccgttaaccgtacggtaaagtttcgtttacgaccgtttaaggttttactttaaccggtcgtttaaccgaaggtaccgtttacgggttaattacggtagttttaacccgtttacccgttcgttaacccggttttaacggggtttacccggaagggttaaacggggttaacccgggtacgggttaacaccggttaaaccgtaccggaaaaccgggttcgttcgggtaacccgttacgtccgttaaccaccctttagggttccttaccggttaaccgttccg

SEQ ID NO: 97299 - DNA, 710 bp, Homo sapiens
  misc_feature: GYAE6OF02GQHO8.38.53.E09.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (305)..(305): a, c, t, g, unknown or other
  misc_feature (305)..(305): n is a, c, g, or t
tcagtcgatcacgtcacgaccggtgctcgatttagagagagtgtgttgggtttggggagagctgctcattaggacccagagggaaccatggaaaccccagcgcagcttctcttcctcctgctactctggctcccagataccaccggagaaattgtgttgacgcagtctccaggcaccctgtctttgtctccaggggaanagccacctctcctgcagggccagtcagactgttancagcagctacttagcctggtaccagcagaaaccctggccaaggcctcccgaggcctcctcattctttgggngcatccaagcgagggccacgtggcactcccaacgctaacggttcgagttcggactggtgggtacctggggaacctaaggtacctttacaccttacgtacaacccgtaactaccaaccgacggaccgtacggtacgcccgttaaggtaacgtatttttacggctaacggttttaactttaaccgttacgttactaacgtacctaaggtttagttacgtaagtttaaccggttttaacctttaccgttaccgttaaccgttttaccgggaacgggttaaccggggtaaccgggtaacggggttacggtaaaccgtacgttaaaccggaaaaccgtaaccgggttaacggttacgggtaccgttacgggtcctaaacccctaggttacccgtttaggttccttaaccg

SEQ ID NO: 97300 - DNA, 769 bp, Homo sapiens
  misc_feature: GYAE6OF02J1LEC.38.53.E09.1.454.CMB.1.raw
  modified_base (309)..(309): a, c, t, g, unknown or other
  misc_feature (309)..(309): n is a, c, g, or t
tcagtcgatcacgtcacgaccggtgctcgatttagagagagtgtgttgggtttgggggagagctgctcagttaggacccagagggaaccatggaaaccccagcgcagcttctcttcctcctgctactctggcctccagataccaccggagaattgtgttgacgcagtctccaggcacctgtctttgtctaccgaggggaaagcgccctacctctcctgcgacgggccagtacacgtactgttacgcagcagtacttacgttacgccttcggtaaccacgcaacgtaaccgtggccgacggcctacccgnggtcctaccgtctagttcgttggtcacgtacgtccgacggtaccgacgggtacccaacgtcggcctacctccgagaaccgttcggtacgcgggtacgtcggtacggttacgggtacgtacggtacgtacggttaccttccgaaccgtttaccgaccttaacccgtacgtaccgtaaccgtaacggtaccgttacgggacctaccggttaagtaaccggtttaaggtttacggtacctttaacggtttaacgtttaaccggtcgttactaaccgggactttaaggttaacttacggtaacttttacggtttaaccttcgtttaccgttacggttccggtaacgggttacggtaaccggtagtacgggtaaccttaacgtaacggtaaaccggttggtacccggttacgggtcttaccggtaaccgtaccgttacgggttacgtttcctaaccgtttacccg

SEQ ID NO: 97301 - DNA, 692 bp, Homo sapiens
  misc_feature: GYAE6OF02FYXQN.38.53.E09.1.454.CMB.1.raw
  modified_base (202)..(202): a, c, t, g, unknown or other
  misc_feature (202)..(202): n is a, c, g, or t
  modified_base (493)..(493): a, c, t, g, unknown or other
  misc_feature (493)..(493): n is a, c, g, or t
  modified_base (686)..(686): a, c, t, g, unknown or other
  misc_feature (686)..(686): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagactaccacggagaattgtgtgacgcagtctccgaggccaccctgtctttcgtctccgaaggggaancgccctaccctctcctgcacgggctagtcagtcgtagtacgcacgcacgcttaaccgtacgtccgtcggtaaccagacgtaacggaaacctggaccgtacggccctacccgaggtccctcctagtactttcggtttacggctacgtaccttaccgaggtaccggacggggtaccctaccgggttaggaccctaccttaccccggaaggtaaccggtaaacggtttcgaacgggtgtacggagttcgggggtactcggggaactaacgtctacgtaccgtctaccgacctanaccgacacgacgtcgacgactagtattaggttacacgtttagttagttacgtagtaccgtagtacgtagtattacgttacgttacgttaccgtccgttacgttacggttcggtacggtacggacgggtacggtacgtacgtaacgttacgaaacgtcgtagttcgacgtacgtagtaccgtagttcttacgtnttaccg

SEQ ID NO: 97302 - DNA, 743 bp, Homo sapiens
  misc_feature: GYAE6OF02FGN4N.38.53.E09.1.454.CMB.1.raw
  modified_base (161)..(161): a, c, t, g, unknown or other
  misc_feature (161)..(161): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (325)..(325): a, c, t, g, unknown or other
  misc_feature (325)..(325): n is a, c, g, or t
tcagtcgatcacgtcacgaccggtgctcgattttagagagagtgtgtttgggtttggggagagctgctcagttaggacccagagggaaccatggaaaccccagcgcagcttctcttcctcctgctactctggctcccagataccacggagaaattgtgttnacgcagtctccaggcaccctgtctttgtctccgaggggaaangcctacccntcctgcagggccagtcagacttgttagccagcaggtcctacttacgcctggtacccagccgagaaacctggcctaacggcctacccgaggccttccctcagttccgtttgggntcgtaacgtccgtaacgccggtaagggtcccaaggttacgggcctacttacccccgaggtaccgtacggtttaccgagggtttccgggacgttaggttcggggtaccttacggggaactacggttaacctttcccgtacttaccgtaccgtaaccgtacgtacccgtaaccgtaacggtaaccgttacggtaccgtaccgtacgtaacggttacgtttacgtacgttacgtttaacgttacgttacggtacgtacgtacgtacgttacgttacgtacgttacgtttaccgttacgttaccgttaccggtttcggtacggtaacgggtacggtacgggttacgtacgtacgtaacgtaacgtaaccgtacgtacgtacgtcggtccgtaacctacggggggttacttcggttcttaccg

SEQ ID NO: 97303 - DNA, 761 bp, Homo sapiens
  misc_feature: GYAE6OF02IVQ4G.38.53.E09.1.454.CMB.1.raw
  modified_base (207)..(207): a, c, t, g, unknown or other
  misc_feature (207)..(207): n is a, c, g, or t
  modified_base (372)..(372): a, c, t, g, unknown or other
  misc_feature (372)..(372): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctcccagactaccacggagtaattgtgttgacgcagtctccaggcctacctgttcttcgtctaccgaaggggaaancgcccctaccgttctccgtgccggaacgggcctagtacacggtaccttggtacgacgacgcgaacgtccttaacgttccggccgttacgggaaccaggaccaaacgtaaccgtcgggccaacggtcctacccgaggtcccttccgtacgtacgttcgtttggccncgtaactccgagtaccgacgggacctaggttccggactaccgtacccgaagtaccggtacggttacgagtccgggacgtggggttcgtcggtacgggaactaggtaccttccgtacgttccgaacccgtactccggaaccgaccgtaacgttcgggacgaaccgttccgtaaaggttaaagtttccgtttaacgtccgtttaagttttacgtccgtagttacgaggttacttaaggttatacgtttaaccgtttacgttacctcgtttaaccgtttacggccgggtaacgggtaaccggtacgtacgggtacgtactacggtaaaccgaaccggttgttacgggctacgtaccgaccgttactcgttacccggttagtacccttaccgg

SEQ ID NO: 97304 - DNA, 728 bp, Homo sapiens
  misc_feature: GYAE6OF02JW74E.38.53.E09.1.454.CMB.1.raw
  modified_base (153)..(153): a, c, t, g, unknown or other
  misc_feature (153)..(153): n is a, c, g, or t
  modified_base (208)..(208): a, c, t, g, unknown or other
  misc_feature (208)..(208): n is a, c, g, or t
  modified_base (681)..(681): a, c, t, g, unknown or other
  misc_feature (681)..(681): n is a, c, g, or t
tcagtcgatcacgtcacgaccggtgctcgatttagagagagtgtgttgggtttggggagagctgctcagttaggacccagagggaaccatcggaaaccccagcgcagcttctcttcctcctgctactctggcctcccagatacccaccggaanaattgtgttgacgcagtcctccaggccaccctgtctttgcctaccgaggggaaancgcccaccctctcctgcacgggccagtccagtctgttagcagcagtcttacttagcctaggtaccagcaacgaaccgtggccacggcctcccgaggtcctccgtctattccgttggactccactccgagtccgacgggtcccagtcggaccacgtaccccgagtacctagggttccaaggttcggctagggttcgggtcgtacggggaacctcggtaaaccctttccgaaccgtttccaaccgtaccctagtaacccgaccgacgtacgtgggaaaccgtccgttaaagtaacgttacgttttcggaacctttaaggttttaccgtaccgttacggtaccgtaacggttactaacggttaattaccggttaacttttaaccggtttacccgtaccgttacgttaccggtttacgggacggttaaacggtaccgtagggtaccgaactaccgggtaactaacgggtacttcggngttaccgtacggtaccgaaccgttcgttacgttacttacccgtaacg

SEQ ID NO: 97305 - DNA, 668 bp, Homo sapiens
  misc_feature: GYAE6OF02HEH4A.38.53.E09.1.454.CMB.1.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagtcgatcacgtcacgaccggtgctcgatttagagagagtgtgttgggtttggggagagctgctcaggttaggacccagagggaaccatcggaaaccccagcgcagcttctcttcctcctgctactctggcctccagataccgaccggagtaaattgtgttgacgcagtctccaggcacctgtcttgtctccgagggaaancgccacctctctgcgacgggccagtcacgctgttagcagcagctacttagcctggtaccngactaacgaaaccgtcggaccacggcctccccgaggtcctccctagtctttccgttttaggcgtacctacgtcccgaggaccgaaccgggccctaacggtcggcctaccgtccccgaagaccgtaggttccaggtggcctagggttcgggtacgtggggaacgtacgtaccttccgtactccgtaccaacctactcccaaccgagtacgtcggtaccgccgttaaggaaactttgttttacgacgtttatttaacttacgtcgtacgtagcttagttattacggttaacttttccgtttacctcgtttaccgttaccgggtttacggacggttaacggcgggttaaggtcgaacttacgaacgtaaacgtcgttggacgtcgtacgctactacgtctcgttctcc

SEQ ID NO: 97306 - DNA, 763 bp, Homo sapiens
  misc_feature: GYAE6OF02IBHNF.38.53.E09.1.454.CMB.1.raw
  modified_base (105)..(105): a, c, t, g, unknown or other
  misc_feature (105)..(105): n is a, c, g, or t
  modified_base (231)..(231): a, c, t, g, unknown or other
  misc_feature (231)..(231): n is a, c, g, or t
  modified_base (750)..(750): a, c, t, g, unknown or other
  misc_feature (750)..(750): n is a, c, g, or t
tcagtcgatcacgtcacgaccggtgctcgatttagagagagtgtgttgggtttggggagagctgctcagttacggacccaggagggaaccagtacggaaaccccngcgcagcttctccttcctcctgctactctggcctccagactaccgaccggaataaagttgtgttacgacgcagtcctcgaggcctaccgttgtctttgcctacggaagggaacacgccctaccctntccgtgcgacgggtccagtcgagtacttgtacgcacgcacgtctacgtcgcgtagacagcaacgaccgtggaccacggtcctaccggacgtcctccgttactattttccggtttgaccgctaccgtccggagccggtacgggtaccctaggtcggaaccctaccggaccagtacgttcggtacgtacgggtcgacgttcggggtactacggtacggaacttcgactttacaccgttccgaactacccgttacgaccgaacgtggtaacgtcggacttacggtaacgtagttacgtttcggaactttaagttttaccgacttcggtaactgtaccgaggtttaactagggttaccttttcccgttactaccgtttacggtttccgggttaacccggggggacggtaacgggttacccgggtggggtaccttaacggtaaccgttaaaccggggtaacttcggttaaccgggttccaccgggtacctacccggttaaccgttttcttaccgggttttaccnccgggttaacccc

SEQ ID NO: 97307 - DNA, 737 bp, Homo sapiens
  misc_feature: GYAE6OF02GSYVD.38.53.E09.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcacctgtcttgtctcgagggaaangccacctctcctgcagggccagtcagactgtancagcagctacttagcctggtaccagtcaagaacctggaccaggcctcccgaggtccctcctacgacttcgtttggtacgctactccgaggcgtacggaccacgtcggacctaacgttccccgagtaccgtaacggttcgaacggtcggtacgtaagggttcggggtccgttacgggaaccgtacggttacctttaccgaccgttcccgtaaccgtaaccctaacggttacccaaaccgtaaaggtccgttaacgggacgtacccggtaagtaaccgttacgttttacgacgttaacggttttactaccgttgttaccgagttactaaggttattacggtaagttttaccgtttaaacccgtcgtttaaccgtacgggttttaccgggacgggtaaaccgggtccgttaaggggttcgtaaccttaaccggtaaaccggttaaaacggttccgtacgggtttaccggacgtacgtaccgagttaccgttctaccggtcttaacccgg

SEQ ID NO: 97308 - DNA, 874 bp, Homo sapiens
  misc_feature: GYAE6OF02HTDE4.38.53.E09.1.454.CMB.1.raw
tcagtcgatcacgtcacgaccggtgctcgatttagagagagtgtgttgggtttggggggagaggacgccccagccctgagattcccaggtgtttccattcagtgatcagcactgaacacagaggactcaccatggagttgggactgagctaggtattttccgtttgcttaattttaaaaggtgtacagtcgtagaagtgctagtcgtgggtaggtagtcggtagggggatacgttgggtaagacgtccgtagggacctacggtccccgtacggacgttaaccttcccgtaccgtttagtacggaccgtacgtcccgtttacgttaggtaaaccttttaaccttaaaaagtttttaaagaacgtaattaaaacgcgaccggtaataccgccgttaaaccggtaccggggttaaccggaaccgttaaaccggaccgtttaacccgggaaagggggtaaaccgggtacccggttaaggggtacgggtttaacgggtaccgaaaccggttaagggtttcggttaaaaggggttaacgaaacggttaacgggtaacggttaacctaagtaacgtacccgttagtacgtacccgtaactacggttagacggaacgggttaccgtacgtactaaccgtaactaccgaccgtagtaacgaaaccgaacgtaacccgaaaggaccgtacctacccgtactacgtacgtacgaaataaacgtaacgaacgtacgtaacgtagaaccgtaacgttacggaacgtacgaccggttaccttacgtttacgttaccgtaaccgtaaccgtaaacggtaaaccggttcccggtaatacgggtaccggtaacggttaacggtaaacggttaagggtttacgtttaaccgg

SEQ ID NO: 97309 - DNA, 796 bp, Homo sapiens
  misc_feature: GYAE6OF02ILLU8.38.53.E09.1.454.CMB.1.raw
tcagtcgatcacgtcacgaccggtgctcgattttagagagagtgtgttggggtttggggagagctgctcagttaggacccagagggaaccatggaaaccacagcgcagcttctcttcctcctgctactctggcctacccagactaccgtacggagtaagttgtgtttgacgtcgtagtcctaccgtaggtcctacccgtgttcgtttcgtcgtaccgaagggtaaagcgtcccgtaccgtcgttccgtagccgacgggcctacggtcgtacgtacgttacgttacgcgagtcacgtacttacgtcgtccgtacggtaacctaggacctaaagaacccgtgggacccgtaacggccgtacccgaggttccctcccgttacgtacgtttccgtttcgggtacgtaccgtaaccgttccggacggaccgggtacgggcctacggttcggtacccgttaacctacccgtaaacggtaccgtacggttaccgaagggttaccggacggttaacgggtttcgggtacggtaaccgggtaaccgtacgttacccgtttacgacccgttaccgttacctaacggtacctcccgtaaacccggtaaggtaccgttacgggaacgttacgtaagttaacgtttcgttacgtacgtttaacgttttcgaagtttcgacgtatacgtagtacttagttaaccgttcttaactgttaccgttacggttacggccgggtagtacgagggtaccgtagtaacggtaacctagtcgtagtacgttgaccgttcgaacttcgtacgtcctacg

SEQ ID NO: 97310 - DNA, 652 bp, Homo sapiens
  misc_feature: GYAE6OF02H1ZTQ.38.53.E09.1.454.CMB.1.raw
  modified_base (172)..(172): a, c, t, g, unknown or other
  misc_feature (172)..(172): n is a, c, g, or t
  modified_base (216)..(216): a, c, t, g, unknown or other
  misc_feature (216)..(216): n is a, c, g, or t
  modified_base (242)..(243): a, c, t, g, unknown or other
  misc_feature (242)..(243): n is a, c, g, or t
tcagtcgatcacgtcacgaccggtgctcgatttagagagagtgtggttgggtttggggagagctgctcagttaggacccagagggaaccatggaaaccccagcgcagcttctcttcctcctgctactctggctcccagactaccgaccggagaaattgtgttgacgcagtcnccgagccaccctgtctttgcctccgagggaaagcgcccaccctntcctgcgaggccagtcagtactgtanncgcagtctattacgccgttaggaccaggacaacgtaaacgtggaccgacggcctcccgaggtccctacgtacctacgttccgtttcggtcaccgtaacgttccgaacggccgacgggcccttaaggcggcctaaccgtacccgaacggtacgtacggttacgaccggttggaccgtagggtccgggtacgtcgggaactacgtaccttcgtaaccgtccgtaccgacttaccgacgaccgtacgtacggcgtacgaccgtagtaacgtagttcgtatacgttaattcgagttcagtcagttctagttacgttacttccagttaccgttacgtcgggaccgaaggtccgtaggtcgatacgcgtaacgtcgtgtaccgtcgtacgacctcgtacgtcgtccgtatacccg

SEQ ID NO: 97311 - DNA, 798 bp, Homo sapiens
  misc_feature: GYAE6OF02HDAML.38.53.E09.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctccagactaccaccggagaattgtgttgacgcagtctccgagccaccctgtctttgtctcgagggaaancgcccaccctntcctgcgacgggccagtcagtactgtagcagcagtcttacgtacgccgtaggtaccacggacaacgtaaaccgtcggaccgacggccttcccgacggtcctccctactactttccggttttggcgaccgtactaccgacggtaccggaccggtaccgtacgtcggacctaccgttacccgaaggtaaccgttacggttcgaacggtcgggtaacgtagggttcgggttcgtacgggaaccgtagtacccgtttaccgaccgtacctaccgtaaccgtacctacccgtaacgaacggtaccggtaacggtccgtaaccggttacggtaacggtttacgttttacggtaacgttttaacggtttactttaacggtccggtacttaacggtacgttaattacgttaaacgtttaacgtttaacccgtttttaccgttaccgttaccgggtttacccggttacggggtaccggggtaacgggttaacccgggtaggggttacgaaccgtttaaccggaaacgttaaaccggttacgggtacgcgggttacacggtaacctacgttactttacgttaccgttacttacccg

SEQ ID NO: 97312 - DNA, 673 bp, Homo sapiens
  misc_feature: GYAE6OF02G39HL.38.53.E09.1.454.CMB.1.raw
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
tcagtcgatcacgtcacgaccggtgctcgatttagagagagtgtgttgggactgagctggattttcctttggctattttaaaaggtgtccagtgtgaagtgcagctggtggagtctgggggagacttggtagagcctggcaggtccctgagactctcctgtgcagcctctggattcaaatttaatgaataatgccatgcacgtgggtccacaagctaccgaggggaacggcctggagtgggtctcaagtgttagtggaacagtggaccagtagcctatggcggactcgtgtggaacggcgatcacntcncagacgacacgacaagcgcctcctgtactctagactaaagtcgaaactgtcgtaggacgtaccgtaggaacggaaccgtaccggtcccttttacgttacttttccgtacggtacggaaaccgaaaaccgggtccccggtaagtcgggacgtaaggtacgacgtaaggttacggtttaccttcggaccggtcccggggaccggtaaccggggtaccccggtccgtacccggtcctccgtaccgaccgtaccctacccgaacccgaaccgggtccctacgttcccggtcccgttccccggtccggcccgtacccgtccgtcccgtaccgacggccgtacccgtacccgtacccggacgacgacccg

SEQ ID NO: 97313 - DNA, 830 bp, Homo sapiens
  misc_feature: GYAE6OF02IOV7Q.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggagaaattgtgttgacgcagtctccaggcacctgtctttgtctccgagggaaagacgccaccctctcctgcacgggccagtcacgtactagttagcagcacgtctacttacgccgtggtaccagcgaacgaacctggccaggcctccgagcctccgtacattcgtttggtcgacacttccaggcgacggaccctagtcggactacgtaccccgagtaaccgtacggttacgaacggtcgggtcgtacggttcgggttacgttacggggaacctaacgggtacctttaacccgaccgtttaacccgttacccgtaaacccgtaccgttacccgaacccggtaaacgtaaccggttacgggaccggtaccgttaccgggttaaagttacggtttttaccgtaaccgtttaacgggtttttaaactttacggtttacggtacctaaacgtcggttacggttaagttacgttaaaccgttttacggttttaccctttaccggttaaccgtttaccgggtttaaccgggtaccgggttaaaccgggtaccggttaaaggggtttacccgggtaactttaacccgggttaaaccggtaaaaaccgttaaccgggtttacggtacccggggttacttaacccggaccgtaacccgttaaggtttcccctttaggtttaccccgttttaaccg

SEQ ID NO: 97314 - DNA, 903 bp, Homo sapiens
  misc_feature: GYAE6OF02HB6LK.38.53.E09.1.454.CMB.1.raw
tcagtcgatcacgtcacgaccggtgctcgatttagagagagtgtgttgggtttggggagagctgctcagttaggacccagagggaaccatcggaaacccagcgcagcttctcttcctctgctactctgctccagactaccgaccggagaattgtgttgacgcgagtcctccgacggccaccttgttcgtttcgtcctaccgaaggggaaacgacgccctaccccttccgtccgtagaccgacgggaccacggttacgaacgtacgtttacggttaacgcgacgaccgtacgtaccgtttaacgtacggtccgttacggaaccgacgaccgaaacgtaaccgtcggaccgtacggacccctacccggcggtacccttaccgttacgtaccgtttcggtttacggtctacccgtaacgttccgaacggtaccgaccggaccccgtaaggttccggaacctaccccgtacccgtaacggtaccgttaacggttacgtacgggtaccggtacggtacggtttcggggttaccgacgggaaacctacggtttaccttaccgtaacccgttacccgtacccgtaacgttaaccgaccccgtaaaccgtacgggtaacccggtagggtaaccccgtaacgttaaacggttaccgtttaacgtttacggtacgtttaaacgttttaaccgtacgttaaccgttaggaccgtttagtaaacggttcgttaaggtttaaccgtttaacctttccgttaacccggtttccgttaaccgggtttacggggaaccggttagggtacccgtttagggaactaacgtaacggtaaacccgttaaaggttacgtaacgggtcccgtaacgtaccgttaacgtaacccgttaggtttccttaccggttaccttaacccgg

SEQ ID NO: 97315 - DNA, 665 bp, Homo sapiens
  misc_feature: GYAE6OF02I9HYI.38.53.E09.1.454.CMB.1.raw
  modified_base (217)..(217): a, c, t, g, unknown or other
  misc_feature (217)..(217): n is a, c, g, or t
  modified_base (286)..(286): a, c, t, g, unknown or other
  misc_feature (286)..(286): n is a, c, g, or t
  modified_base (326)..(326): a, c, t, g, unknown or other
  misc_feature (326)..(326): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaaatttaatgaattaatgaccatgcacttgggtaccaanaacgctaccgaggggaaggcctggagtggtctacgaagtgttagtggaactgtcgtacatgctatgcgntctgagaggcatcactatcctcagacgacacgacaagacncctacctgtatcgtacgactaaaagtcgaactagtctacggaacgtacccgtaggaaccggtaaccgtaccgggttccctttacttacgtttcgtaggtacgaaccggtaaaaccgggtcccgggttaagtcggacgtaggtaacgtacgtaacggttgtttacgttacggtaccgtaccgggtcggggaccgtaaccggggtacccggtacctacccgtccgtacctcgtaccgtaccctacccgaaccgacggacctacgtccgttacccgtcccgaccgtcccctaccccgttaccaccgaacgtaccgaccgtaccggtcggtccgggacaccgg

SEQ ID NO: 97316 - DNA, 801 bp, Homo sapiens
  misc_feature: GYAE6OF02GSVKY.38.53.E09.1.454.CMB.1.raw
  modified_base (202)..(202): a, c, t, g, unknown or other
  misc_feature (202)..(202): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagactaccaccggagaaattgtgttgacgcagtctccaggcacctgtctttgtctccgaggggaaancgccacctctcctgccgacgggccaggtcagtactggttaacgcgagcacgtctacgttagccgtaggtaccagccgaacgtaaaccgtggaccctaacggcccgtacccgacggtccttccctacgtacgtttccgtttagggtcgacctaccgtacccgacggtccgaacgggccctaacgtcggacctacgtaccccgaaggtactaaggggttccaggtacggcgtaagggttcgggttaccgtagggactaagtaccgttccaacttccgtaccaaccgtataccctaacgtaccgtacgtacgggaaccgtaccgtacggttaaagtttacgtttacgggaccgttaagttttaaccgtacggtttcggtaacgttaacggtaacgttacgttacgttacgtaaggtttttaccctttaccgtaccgttaccgttaccgggtttacgggtaaccggtaaaccgggtacggtaacgggtacgttaaaccggtaccgttaaaacggtaaaaccgggttacgttacgggtaacggttcccggttaatacccggtaaccgtttaaccggtccgttttaccgtaccgttttaaccccg

SEQ ID NO: 97317 - DNA, 800 bp, Homo sapiens
  misc_feature: GYAE6OF02JYOWX.38.53.E09.1.454.CMB.1.raw
  modified_base (215)..(215): a, c, t, g, unknown or other
  misc_feature (215)..(215): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttccttttggctattttaaaaggtgtccagtgtgaagtgcagcgtggtgagtcgtgggganacttggtagagcctggcaggtccctgagaccttctccgtgtcgctacgtcctacgtggtaacttacgtaaaatttaagtgtaacttaaatcggaccaattcgaccgtaacgtcggggtaccctacgaaaacgtccgtacccggaagggggaaacgggcccttaggggaacggttggggttacctaaggtaaacggttggttttaacggtacggaaacgtagggttacggtaacctaagtacggtacctaaggtgggtaccggtaacttccggttaggtaacgggaaacgggtcccgtaagtttacccgaacccgtaagttccccgttaacccgaaggaaaccgtaacccgtaaaacccgggcccgaaaacggtacgtcccctttaaccccggtgttaaccgttacgacgaaaccttaaaaggttacgaaaccttcggtaaccgtagggtaaacccgtacgttacgggaaacgtaacccggtaaccggttcccttacgtttacttttcgaaccggtacgttaaaccggaacccggttccggtaatcgggtaacctaggtaaccttaacgggtaggttaccggtttg

SEQ ID NO: 97318 - DNA, 716 bp, Homo sapiens
  misc_feature: GYAE6OF02HLIPF.38.53.E09.1.454.CMB.1.raw
  modified_base (295)..(295): a, c, t, g, unknown or other
  misc_feature (295)..(295): n is a, c, g, or t
  modified_base (491)..(491): a, c, t, g, unknown or other
  misc_feature (491)..(491): n is a, c, g, or t
tcagtcgatcacgtcacgaccggtgctcgatttagagagagtgtggttggggtttgggggggagagggagccccagccctgagattcccaggtgtttccattcagtgatcagcactgaacacagaggactcaccagtggtaggttagggactgagcgttggtaacttttttcctttttggtctttaagtttttaaaaaggttcgttccgaggttggttaggaaggttggctagcgttgggtgggtagttcggtagggggagtacgtttggtagacgtcctagggcacggtcccgngacgtacctctccgtgtcgacacgccttctgtattaacgttaaattaatacgatatacgcctatcgctacggtcggtaccaagaacgtccgtaccggaaggggtaccggccggtggtacgggttcgggactacggttaaggttagttaggttacggaatagggtacgtaactattaggacctagtcgggtaccgtntaggttcgagggcgtacgttcttaccgacctactaccgtacaacgacaaccgtaaccgacgaacgcgttaccctccgtattagttctacgtaacgaactacgactacggacttacgaacgtcgtaacgggacgtacccgttccgtacttacgttacttcgtctaacgaacggtaaccgtccgggttagccggtacgtaaggtacgtacggtttagtaggtttccg

SEQ ID NO: 97319 - DNA, 926 bp, Homo sapiens
  misc_feature: GYAE6OF02GZ77L.38.53.E09.1.454.CMB.1.raw
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctcgtggattcaacttacaaaaattatgggatgcacgtcgggtccgccgaggcctccgaggacgaaggggctgggaggtggggtggccaacgtatactcaatagtgagttaggtaaagttttaaagacttaagtggacggaccgtccggtagggaacgggtcctaacgttccgaacctatccgtaccgaaggtaacgaacctaaacgttacccgaaaggtaccgaccgtaacctaaccgtttactttaacgttttaccgaaacctaaaaacgttacggaaaacccgtaccggtacccggttacggggaacgtccggttaacgggaaaaccgggtaccgtaaccggggtaccgtttacggtttaaccgtttaaacgtttaaccgggttacgggtacggtaaaaccgggtaaaaacccggggtaacccccgggttaccccttaacgggtttaacggggttacgggggggtttaaccggggggttaacgtttacggttaccgggttacccggggttaacgggggaaccccggttaaacccgggggtaaccccgttaccggggtaccccgttacccggttacccgttaccccgtaccgtaacccgttccccgttaaccccgaaacccgggtaaaccgggtacccccttaaccgggttccccggttaccccgttccccgggtccgggtccccgtcccggttaccggcccgtacccgacggtacccgcccgtacccggtacccggaggacccgtaccgaaccggg

SEQ ID NO: 97320 - DNA, 891 bp, Homo sapiens
  misc_feature: GYAE6OF02G9XCP.38.53.E09.1.454.CMB.1.raw
  modified_base (206)..(206): a, c, t, g, unknown or other
  misc_feature (206)..(206): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctcccagataccacggagaaattgtgttgacgcagtctccgaggccaccctgttctttgtctccgaaggggaaanacgcccaccctctcctgcgacgggccagtcgagacgtgttagcgagccacgacttacttacgccgtacggtaccaaggccaaacgtaaacccgtcggacccgaacgggtcccctaccccgacgggtcccttacccgtaccgttaccgttttccggttttacggggtacctaccgtaaaccttcccgaaacgggtccggaaaccggggccctaacggttccgggacctaccgtaccccgtagggaaccttagggtttcccgaggtacgggtcgtaacggggttcggggtcggtacgggtaaacgtacgttaccgtttacccgaaccgttcccgtaccgtaacctacgtaacccgtaactaacggtccggttaagggacccgttacccgttaaaggttaaacgtttacgtttcggtaactttaacgtttttacggttaccttaggttccgtaacgggtaccttaaaggttcgtaaacggttttaccttttaaacccgttttacttacccggtttaaccgtttacccggggttaaggggaacccggggtttaaaccggggaaccggttaacgggggttaccgtaaccgttaaaaccggtaaccggtaaaacggggtaccgttcggggtaacccggtacgttacccggtacctaaccggttcggttccgttagtttaccccttacccgg

SEQ ID NO: 97321 - DNA, 1063 bp, Homo sapiens
  misc_feature: GYAE6OF02JQZAP.38.53.E09.1.454.CMB.1.raw
  modified_base (173)..(173): a, c, t, g, unknown or other
  misc_feature (173)..(173): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctcggtctccagactaccgaaccggaagtaaattgtgttcgacgtcncgttcctccgacggcctacccgttgttcttcgtccgtacggaaggggaaacgtacaccctaccctctccgtaggaccgacgggaccctagtaccaggtaccttacgttaagccacgacgtacgtacgtaccgttacgccgttacggaaccacgtaccaacggaaaccgttcggaccgtaaccggtccgtaccggtaccggtcctaccgtacgtactttaaccggggtttcgacgtacctaccgtacccgtaggtaacccgggacgaaccggttaaccggtcgaaccgtaaacccttacccggacggtaaccgttaacgggtccggtaaagggtgaacccggggttgggttacgggtaacggttccggggaaactaaccggttaccgttaaccgtaacccgttaccgtaaacccggtcccaaaccggttaaccccggaacgtaacccggttacgggttaaccgggtaccttaaccggaaccgttaaacggggtttaccttttaccggttaaaccggtttttaccttttaaaccgggtcccgtttaaaccggttaccggttaaccggttaaacggtaacggttttaaacggtttaaacggtttaaaccgttttaaacccggtttaaccccgttttaaccggttttacccggttttaaaacccgggttacccgggggttaaacccgggttaaaacccgggggttacgggtttaaacccgggggtttaacgtaaaccgggttaaacccggttaaaaaacccgggttccgggttttaaaaacgggtacccgggtttaaccccggtaacggttaacccgggttaccccggtttaaaaacccgggtttccgggttttaacccccggtttcgggttttaaacccccggtttttacccg

SEQ ID NO: 97322 - DNA, 637 bp, Homo sapiens
  misc_feature: GYAE6OF02I2BQ9.38.53.E09.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaattgtgttgacgcagtctccaggcaccctgtcttgtctccaggggaagngccaccctctcctgcagggccagtcagctgttancagcagctactagcctggtaccagcagaaacctggccaggcctcccgaggcctcctnacgttctttggcncatcccagcgagggccacgtggccatcccagactaggttcaggtcggctagggtcgggtcgtaggggacaggtacctttccgaaccttctaccgacctacgtaccacccgaaggtacgttcgggaacgtacccgtaggtaaagttcgtttttacgacgtttaaggttttaattacccgttgtaccgtagtctagttagtagtactttacgtttaccttccgttacgttacgtttaccgggcggtaacgggtaccgagggttacgacaacgttaccgtaaacgtacgtacgggtcggcgtacgaccgtacctagtttcgtccggttattacccgg

SEQ ID NO: 97323 - DNA, 137 bp, Homo sapiens
  misc_feature: GYAE6OF01BQFO2.53.84.H07.1.454.CMB.1.raw
  modified_base (118)..(118): a, c, t, g, unknown or other
  misc_feature (118)..(118): n is a, c, g, or t
  modified_base (123)..(137): a, c, t, g, unknown or other
  misc_feature (123)..(137): n is a, c, g, or t
tcagcgcgtatacacacgaccggtgctcgatttagcagacgtctgtcgcgggctggcaaggcgcatagactctgttcccgccctcctctcgtactgcgctgagcgggctggcaaggcnatagnnnnnnnnnnnnnnn

SEQ ID NO: 97324 - DNA, 116 bp, Homo sapiens
  misc_feature: GYAE6OF01CD0O3.53.84.H07.1.454.CMB.1.raw
  modified_base (115)..(116): a, c, t, g, unknown or other
  misc_feature (115)..(116): n is a, c, g, or t
tcagcgcgtatacacacgaccggtgctcgatttagcagacgtctgtcgcgggctggcaaggcgcatttcccgccctcctctcgtactgcgctgagcgggctggcaaggcgcatgnn

SEQ ID NO: 97325 - DNA, 158 bp, Homo sapiens
  misc_feature: GYAE6OF02F221M.53.84.H07.1.454.CMB.1.raw
  modified_base (127)..(131): a, c, t, g, unknown or other
  misc_feature (127)..(131): n is a, c, g, or t
  modified_base (133)..(158): a, c, t, g, unknown or other
  misc_feature (133)..(158): n is a, c, g, or t
tcagcgcgtatacacacgaccggtgctcgatttagcagacgtctgtcgcgggctggcaaggcgcatagctgcctggtcaaggactacttcctcgtactgcgctgagcgggctggcaaggcgcatagnnnnnannnnnnnnnnnnnnnnnnnnnnnnnn

SEQ ID NO: 97326 - DNA, 221 bp, Homo sapiens
  misc_feature: GYAE6OF01CYAF3.35.21.B10.1.454.CMB.1.raw
  modified_base (213)..(221): a, c, t, g, unknown or other
  misc_feature (213)..(221): n is a, c, g, or t
tcagtacagatcgtcacgaccggtgctcgatttagtgtcgtcgcaagaggagaggggcacttctccctctaacactctcccctctacaagcctcctcggacgttcggccaagggaccaaggtggaaatcaaacgaactgtggctgcaccatctgtcttcatcttcccgccatctgaacgatctgtactgagcgggctggcaaaggcgcatagnnnnnnnnn

SEQ ID NO: 97327 - DNA, 381 bp, Homo sapiens
  misc_feature: GYAE6OF01EDG5W.35.21.B10.1.454.CMB.1.raw
  modified_base (369)..(381): a, c, t, g, unknown or other
  misc_feature (369)..(381): n is a, c, g, or t
tcagtacagatcgtcacgaccggtgctcgatttagtgtcgtcgcaagagaggagggggcagactcaccatgaccgaggacacatctacagacacagcctacatggagctgcgcagcctgagatctgacgacacggccgtgtattattgtgcaacagaaaattacgatatgtggagtggttattacacggaaaactactggggccagggaaccctgctcaccgtctcgtcagcctccaccaaggcccatcggtcttcccctggcaccctcctccaagagcacctcgtgggggcacagccggccctgggctgcctggtcaaggtactacttccacgatctgtactgagcgggctggcaaggcgcagtacgnnnnnnnnnnnnn

SEQ ID NO: 97328 - DNA, 764 bp, Homo sapiens
  misc_feature: GYAE6OF01A4V0N.35.21.B10.1.454.CMB.1.raw
tcagtacagatcgtcacgaccggtgctcgattttagtgtcgtcgcaagaggagacgggggtacgacggcttgggaacttccgagggagccacggtcgggggacacttcctccctctaacggactcctcccgtggttcgaaggccttcgtttcgtggacgggacggagtcttccaggactgatcaggactccgtcagttccaccgttctcacaatgaggctccctgctcagctccgtggggctgctaatgctctgggtctcgtggatccaggtggggatattgtgatgactcagtctccactcctccctcgcccgtcaccccgtggacgcggcccgcctccatcctcctgcgaggtctaggtcagacgtccctccgtgactattagtaaagtggtaacttaacgtaagtttatttagtaaagtttcggtaaccctgacgaaggaacgcccggaaggggcctacgttccctaccgaaccgtacggtaccttaccgttagtactttcgtttaacggtttttcgggtttacctaacgggttcccggggtacccggtttccccgggggtacccttcgggtaaccgttacggggttttaccgaagggtttccgggacgttacggggttacgggtaacgttccgggaaagggtcccgtaaacggttaagttttaacccggttttttaaaccaaacggttaaacggtaaaaaacttccggtaaaacggtaccggtaaagggtacggggtttacggggaagggttaaccgggg

SEQ ID NO: 97329 - DNA, 708 bp, Homo sapiens
  misc_feature: GYAE6OF01CWSXT.35.21.B10.1.454.CMB.1.raw
tcagtacagatcgtcacgaccggtgctcgatttagtgtcgtcgcaagagaggagggggcacttctccctctaacactctcccctgttgaagctctttgtgacggcgagctcaggccctgatgggtgacttcgcaggcgtagactttgtgtttctcgtaggctccctgctcagctccgtggggctgctaatgctctgggtctcgtggactccgaggtggggattagttgtgatgactcagtctccactctccctgcccgtccacccgtggacgcgcccggcctccatcctcctcgccgtaggtcctagtcagacgccctctgcatagtaagtggataacgtaagttatttagagtttcggtaacctgacgaagacgaccggagggacctacggtacctacccgactaacggtcccttactagttacttccgtttaaggtttttcgggttaccttaaacggttcccggggtccccgttaccccgggggtccctgggtaaccgttacgggttaccgagggttcggtaccgtagggttacggaccgttacggacggttaccgtaacgttagtttaaccgtttttaaccgaaaccgttaggaaaaactccgaacggtacgtaacgggtagggtaaccgggagggtacggttaagggtagggttagtttggggttaacgggtttaatttttaacgtaacgggttgcgttaacgg

SEQ ID NO: 97330 - DNA, 665 bp, Homo sapiens
  misc_feature: GYAE6OF01AI455.35.21.B10.1.454.CMB.1.raw
  modified_base (536)..(536): a, c, t, g, unknown or other
  misc_feature (536)..(536): n is a, c, g, or t
tcagtacagatcgtcacgaccggtgctcgatttagtgtcgtcgcaagaggagggagggggcacttctccctctaacgacctctccccgtgttgaagctcctttgtgacgggcgagtctcaggccctgatgggtgacttcgcagggcgtagactttgtgttctcgtaggctccctgctcagctcgtggggcctgctaatgctcgtgggtctcgtggactccgaggtggggacttacgttggtgtacgttggaacctcaggtcctaccaccttcctccgtcgccccgtccaccccgtggacgacgcccggtccttccgatcctccgtcggctacggttcgtacgtccagtaccgtcccttccgtgaccaagttacgtaacgtcggtaataccgtaaaggttcttttaggtaacgttttcgggtaaccttggacctaaggtaacgtacccggtaagggcctaaacggttcctaaccgacgtacggtcccttacgtgtacttcgttaggttcggtactacggtcggtcccgtcggtaccngtacgtaggtcgaggtcgacgtagtcggactcgacgtctacgtacgtacttacatacgaaagtcgagtacgagtaggtcggagtacgtggacgtagttacggttaggtaacgtttaagccgtgtcgtag

SEQ ID NO: 97331 - DNA, 390 bp, Homo sapiens
  misc_feature: GYAE6OF01AZDZG.35.21.B10.1.454.CMB.1.raw
  modified_base (377)..(377): a, c, t, g, unknown or other
  misc_feature (377)..(377): n is a, c, g, or t
  modified_base (383)..(390): a, c, t, g, unknown or other
  misc_feature (383)..(390): n is a, c, g, or t
tcagtacagatcgtcacgaccggtgctcgatttagtgtcgtcgcaagagaccgagggggcagactcaccatgaccgaggacacatctacagacaaagcctacatggagctgcgcagcctgagatctgacgacacggccgtgtattattgtgcaacagaaaattacgatatgtggagtggttatacacggaaaactcgtggggccagggaccctgctcaccgtctcgtcacgcctccaccgaagggcccagttccggtccttcccccctggccacccgtccctaccaagacgcacctcgtgggggcacagccggccctggctgccgtggtacaaggactaccttccacgactctgtactggagcgggctggcaaggcncatagnnnnnnnn

SEQ ID NO: 97332 - DNA, 726 bp, Homo sapiens
  misc_feature: GYAE6OF01DUQIF.35.21.B10.1.454.CMB.1.raw
  modified_base (644)..(644): a, c, t, g, unknown or other
  misc_feature (644)..(644): n is a, c, g, or t
  modified_base (674)..(675): a, c, t, g, unknown or other
  misc_feature (674)..(675): n is a, c, g, or t
  modified_base (681)..(682): a, c, t, g, unknown or other
  misc_feature (681)..(682): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (690)..(693): a, c, t, g, unknown or other
  misc_feature (690)..(693): n is a, c, g, or t
  modified_base (695)..(705): a, c, t, g, unknown or other
  misc_feature (695)..(705): n is a, c, g, or t
  modified_base (707)..(711): a, c, t, g, unknown or other
  misc_feature (707)..(711): n is a, c, g, or t
  modified_base (713)..(726): a, c, t, g, unknown or other
  misc_feature (713)..(726): n is a, c, g, or t
tcagtacagatcgtcacgaccggtgctcgatttagtgtcgtcgcaagagaggagggggcagactcaccatgaccgaggacacatctacagacacagcctacatggagctgcgcagcctgagatctagacgacgacggtccgttgttatttagttggtacgaacaaaacgtaaagtaaaaattacgaattagtggtaggtacgttaggtttaacttaaccgaaacggtaaaaacgttcggtcggggacccgaacgggtaaccctgccttaccgtaccgttccgttcgtaccgaccgtcccctacccgaaccggaaccgggtccccttacggttcccggtttcccctttccccccggtacggacccctacccccgttacccgtaaccgaaacggtaccgtacccgtacccggttcggggtaccgggggacctaaacccgggcccggggtccccgggttcccggtcgggtccccgttcggtccccggttaggggtaaacccgtaaacgggttaccctttaaccccgtttaccccggtaaacggttacgttttacccggttaacgggttaaccggtacgggtaacccggggtccgggggttaccgtaccgggtaaaccggtaaaccgggccgtaaagttacggacggngacgtgtacgcgcgacgtgacgcgcgcgcnncgtcgnngcgncncnnnncnnnnnnnnnnngnnnnngnnnnnnnnnnnnnn

SEQ ID NO: 97333 - DNA, 629 bp, Homo sapiens
  misc_feature: GYAE6OF02FXHMT.35.21.B10.1.454.CMB.1.raw
tcagtacagatcgtcacgaccggtgctcgatttagtgtcgtcgcaagaggagagggggtcaggctggaacctgaggagcaggtgggggcacttctcctctaacactctcccctgttgaagctctttgtgacgggcgagctcaggactgatcaggactcctcagttcaccttctcacaatgaggctccctgctcagcctcctggggctgctaatgctctgggtctctggatccgagtggggatattgtgatgactcagtctccactctcccctgccccgtcacccctggacgacgcccggcctccgatcctcctcgacaggtctagtccagacgcctcctgcatagtatggatacaagttattgattcggtactgcagtacgcgaggtcagtctaccgactacgtctacccgtgtacttcgtttaacgttttggggttacctaaacggttccggggtacccgttccggggggttcccctagggtacccgtaagggttttccaagggtttcgggcctaagggttcggtaactccggtagggacctaacggtaaggtttaacctttttaaccgaacgtttaacggaaaactttcggaaccggtccgtaaaggtcgggtacggtaggttacgg

SEQ ID NO: 97334 - DNA, 768 bp, Homo sapiens
  misc_feature: GYAE6OF02FR912.35.21.B10.1.454.CMB.1.raw
tcagtacagatcgtcacgaccggtgctcgatttagtgtcgtcgcaagaggagaggggtcaggcctggaactgaggagcaggtgggggcacttctcccgtctaacactctcccctgttgagtcttcgtttgtcgacgggcagtcctcgaggactggatccaggacttccgtcgagttcctacccttctacacaactggacggtcccttccctgcttcacgtccttccgtggggactgactaagtcgtcctcgtggtcctcgtcggactccgagggttcgggacttagttcgtagtactcgtaacttacgtagttcctaccgtaccttcctcccgtcgtcccggtacccacccgtcggacgaccgtcccggcctcctactcctccgtgtacctacgttcctacgcgtacgaccgtccgtcgtacgtctaagttacgtacgtaggtaagtacgtaagttagttacgtaagtttcggtaacgtcgaacgtagtacgtacgtacggtacctacgttccctaccgtactaccggtcctacggtacttacgtttacgtttacggttttacggttacttaaccggttccgggttaccgtccgggttcctacggtaccggttagttaccgtacggttaccgcgttacggttacgtaccgttacgggacgttaccgtaacggtttaacgttaacgttttaaccggaacttaaaccggtaaacgtttcccggaacggttaccggtaaacgggtttcgggtaacgggtaccgttaacggg

SEQ ID NO: 97335 - DNA, 660 bp, Homo sapiens
  misc_feature: GYAE6OF02HYU0I.35.21.B10.1.454.CMB.1.raw
  modified_base (374)..(374): a, c, t, g, unknown or other
  misc_feature (374)..(374): n is a, c, g, or t
  modified_base (418)..(418): a, c, t, g, unknown or other
  misc_feature (418)..(418): n is a, c, g, or t
tcagtacagatcgtcacgaccggtgctcgatttagtgtcgtcgcaagagaggaggggcacttctccctctaacactctcccctgttgaagctctttgtgacgggcgagctcaggccctgatgggtgacttcgcgaggcgtagacttttgtgtttctcgtaggctccctgctcagctccgtgggctgctatgctcgtggtctcgtggatccgaggtgggatattgtagatgactcgagtctaccactcctcctcgcccgttcacccgtggacgcgcccgctacatcctcgagcgagtctagtacgacgactcctcgtgctaagttagtaagtcgaataactaaggttaacttcgtaacgttcggtaacctggaanacgggtaaacgtcgaaagggtccaacgttcccgaacgtaaccgngtaccctccgtagtacttacgtttacgttttacgggtacttaacggcccgggtcgtacccgggtctagggaaccttcgggttacctaggtcgtacgtgggtaacgtacgtcggacgtctaaacggttcttaacgttttaacgaacgttaaagtaacgacgacgtagacgggtggtaacggaaggttcgtaaggaaagtcttacgggttttacggaacttttacggaacttcggaacgttacg

SEQ ID NO: 97336 - DNA, 175 bp, Homo sapiens
  misc_feature: GYAE6OF01BLFHZ.29.5.A05.1.454.CMB.1.raw
  modified_base (172)..(175): a, c, t, g, unknown or other
  misc_feature (172)..(175): n is a, c, g, or t
tcagatagagtactcacgaccggtgctcgatttagatagatagacaggcaccaaggccatcggtcttccctggcaccctcctccaagagcacctctgggcacagcggcctgggctgcctggtcaaggactacttccagtactctatctgagcgggctggcaaggcgcatagnnnn

SEQ ID NO: 97337 - DNA, 181 bp, Homo sapiens
  misc_feature: GYAE6OF01D5SKW.29.5.A05.1.454.CMB.1.raw
  modified_base (178)..(181): a, c, t, g, unknown or other
  misc_feature (178)..(181): n is a, c, g, or t
tcagatagagtactcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnn

SEQ ID NO: 97338 - DNA, 178 bp, Homo sapiens
  misc_feature: GYAE6OF01C1DLU.29.5.A05.1.454.CMB.1.raw
  modified_base (178)..(178): a, c, t, g, unknown or other
  misc_feature (178)..(178): n is a, c, g, or t
tcagatagagtactcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagn

SEQ ID NO: 97339 - DNA, 177 bp, Homo sapiens
  misc_feature: GYAE6OF01CXM46.29.5.A05.1.454.CMB.1.raw
  modified_base (175)..(177): a, c, t, g, unknown or other
  misc_feature (175)..(177): n is a, c, g, or t
tcagatagagtactcacgaccggtgctcgatttagatagatagacaggcaccaagggcccatcggtcttcccctggcaccctcctccaagagcacctctggggcacagcggcctggctgcctggtcaaggactacttccagtactctatctgagcgggctggcaaggcgcatagnnn

SEQ ID NO: 97340 - DNA, 539 bp, Homo sapiens
  misc_feature: GYAE6OF01B2ODH.29.5.A05.1.454.CMB.1.raw
tcagatagagtactcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaaattcaacagaagttcaaggcagagtcacctttacagggacacatccgcgaggattactatatggagctagagcagcctagagataccgaagacgacggctgtatattttgtgcgtactctagtggtaggtctagttattacgtctactaatttgacttccgttagggcccacgggtaccctcgggtacctaccgtctccgtaccg

SEQ ID NO: 97341 - DNA, 776 bp, Homo sapiens
  misc_feature: GYAE6OF01D77EJ.29.5.A05.1.454.CMB.1.raw
  modified_base (183)..(183): a, c, t, g, unknown or other
  misc_feature (183)..(183): n is a, c, g, or t
tcagatagagtactcacgaccggtgctcgatttagatagatagacagggacccaacaaccacatccctcctcagaacgcccccagagcacaaccgccccaccatggactggacctggaggatccttctttttggtggcagcagccacaggtgcccacctcccaggtccagcttgtgcagtcgnggggctggaggtgaagaagccgtggggcctcgagtggtaacggtttcctagcgaaggtccttacgaggacttacctaccttctacgtaggtatcgtactatacgtagttgggtcgccgcccgaccgggccccgaagtaaacggtcttaggagtggagtaggggtagtagggtactacgaacgtcgtggactaagtacgtaaactaaacgtaaaaacttacgaacgtaacgtaacgttaccgaagggtacaacggtaacgtaccttaaacccggtttaacgacgggaaccacgacgtcccggacggtaacggttatttaacgttaacttaggtaggacgtacgttacgaccgtagtaccggtacgtaggacgtaacgtacccgaagacccggtacgttactttacgtttaattttcgttttcgggtcgtaaccgttaccgttagttacgggttacggtagtttaccttaaagtttccgttaccgtacgttaacgttttacgtttaccgccggtttaccgggtaccgggtaacccgggtaaacggtaccccggttacccggttaaccccgtacccggttcccgtcccgtacccgg

SEQ ID NO: 97342 - DNA, 791 bp, Homo sapiens
  misc_feature: GYAE6OF01DHRAC.29.5.A05.1.454.CMB.1.raw
  modified_base (136)..(136): a, c, t, g, unknown or other
  misc_feature (136)..(136): n is a, c, g, or t
  modified_base (186)..(186): a, c, t, g, unknown or other
  misc_feature (186)..(186): n is a, c, g, or t
  modified_base (263)..(263): a, c, t, g, unknown or other
  misc_feature (263)..(263): n is a, c, g, or t
tcagatagagtactcacgaccggtgctcgatttagatagatagacaggggacccaacaaccacatccctcctcagaacgcccccagagcacaaccgccccaccatggactggacctggaggatccttctttttggnggcagcagccacaggtcgcccactcccgaggtccagtcttgtgcagtcgngggctggaggtcgaagacgccggtggggccctgaggtgtacggttcctagacgaagtctacgagtactactaccttnacgtacggtatcgtattatactaggttcgggtgcccgaccgacccgggacccggaaacgtaaaggtccgttaggagttgggacggtagggagttaggactaccgaacgtcgtacggactaagtaacggtaaaacaaaaccgtaaaaaacttcaaacgtaacggttaaccggtacggaacgggtacaacggtaccgtttaacccgtaacccgttaccggaaacgggaccctaacgtaccggaccggtacggtaacgttaactttaccgtttaagtagttaaccgggacgtacgggtagacgtaccgtacgtaccgtaagaccgtaaccggtaacccgaaaggtaacccgtacgggtatttacggttaacgtttttacgtttcggaaccgttaccgtaccgttaggttggtaccggtattactaacgtttcgtacttacttaccgttaagttccggtaccggttcggtaccggggacccgttaaccggtacccgttacgtacccgttacccgttccctacccgggtaccc

SEQ ID NO: 97343 - DNA, 180 bp, Homo sapiens
  misc_feature: GYAE6OF02HTE8S.29.5.A05.1.454.CMB.1.raw
  modified_base (178)..(180): a, c, t, g, unknown or other
  misc_feature (178)..(180): n is a, c, g, or t
tcagatagagtactcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnn

SEQ ID NO: 97344 - DNA, 180 bp, Homo sapiens; identical to SEQ ID NO: 97343
  misc_feature: GYAE6OF02F6689.29.5.A05.1.454.CMB.1.raw
  modified_base (178)..(180): a, c, t, g, unknown or other
  misc_feature (178)..(180): n is a, c, g, or t

SEQ ID NO: 97345 - DNA, 181 bp, Homo sapiens; identical to SEQ ID NO: 97337
  misc_feature: GYAE6OF02FS741.29.5.A05.1.454.CMB.1.raw
  modified_base (178)..(181): a, c, t, g, unknown or other
  misc_feature (178)..(181): n is a, c, g, or t

SEQ ID NO: 97346 - DNA, 212 bp, Homo sapiens
  misc_feature: GYAE6OF02GWYKW.29.5.A05.1.454.CMB.1.raw
  modified_base (182)..(212): a, c, t, g, unknown or other
  misc_feature (182)..(212): n is a, c, g, or t
tcagatagagtactcacgaccggtgctcgatttagatagatagacagggcgaccaagggcccatcggtcttcccctggcaccctcctccaagagcacctctgggggccacagcggccctgggcgtgcctggtcaaggctacttccagtactctatctgagcgggctggccaaggcgcatagnnnnnnnnnnnnnnnnnnnnnnnnnnnnnnn

SEQ ID NO: 97347 - DNA, 543 bp, Homo sapiens
  misc_feature: GYAE6OF02IFTUL.29.5.A05.1.454.CMB.1.raw
  modified_base (435)..(435): a, c, t, g, unknown or other
  misc_feature (435)..(435): n is a, c, g, or t
tcagatagagtactcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacaacaaaaaattcaacaagaagttccgagggcagagtacactttaccaggacacatccgcgaggattacttatatggagctgagcagctagagatcgaagacacggntagtattatttttgagtcgtacctgtagtggaggtcatttattacgcttactaatttgacctccgtcggggcctagggaacccgttggtcctaccgttcctacctccg

SEQ ID NO: 97348 - DNA, 680 bp, Homo sapiens
  misc_feature: GYAE6OF02G5K3J.29.5.A05.1.454.CMB.1.raw
tcagatagagtactcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcgagtgaaggtttcctgcaaggcttacgaggactaccaccttcacgtaggtatgctatacagttgggtgcgccacggcccccggacaaaggcttgagtggagtgggatggatcaacgcgtggacaagtcggtaaacgaactaaaaaattccaacaagtaacgttaccgagggacagacgttacctaaccgtttacccgaaggggtaaccacgtacgtcccggacggaaggtactttaacgtttaagtaacgtagggacgtaccgtaggacgctaacggcctaggaagtacgtaaccggaagaccgaccggtacttagttaactttagtttttacgtcgtacctaccgtttcgtaggttcgggtagtacgttaacgtttacgttacgctttacgtaagtttacgtaccgttcggtccgggtaccgtaccgggtaaccccgttggtacccgtacccgttcctacccgttacccg

SEQ ID NO: 97349 - DNA, 152 bp, Homo sapiens
  misc_feature: GYAE6OF01DPL76.29.57.F02.1.454.CMB.1.raw
  modified_base (151)..(152): a, c, t, g, unknown or other
  misc_feature (151)..(152): n is a, c, g, or t
tcagatagagtactcacgaccggtgctcgatttagctcgatatagttgggtttgggaaggtggaaatcaaacgaactgtggctgcaccatctgtcttcatcttcccgccatctgatgtcgagcgtctgagcgggctggcaaggcgcatagnn

SEQ ID NO: 97350 - DNA, 151 bp, Homo sapiens
  misc_feature: GYAE6OF01ARNX5.29.57.F02.1.454.CMB.1.raw
  modified_base (151)..(151): a, c, t, g, unknown or other
  misc_feature (151)..(151): n is a, c, g, or t
tcagatagagtactcacgaccggtgctcgatttagctcgatatagttgggtttgggaaggtggaaatcaaacgaactgtggctgcaccatctgtcttcatcttcccgccatctgatgtcgagcgtctgagcgggctggcaaggcgcatagn

SEQ ID NO: 97351 - DNA, 151 bp, Homo sapiens; identical to SEQ ID NO: 97350
  misc_feature: GYAE6OF01D0RIO.29.57.F02.1.454.CMB.1.raw
  modified_base (151)..(151): a, c, t, g, unknown or other
  misc_feature (151)..(151): n is a, c, g, or t

SEQ ID NO: 97352 - DNA, 151 bp, Homo sapiens; identical to SEQ ID NO: 97350
  misc_feature: GYAE6OF01BK7WO.29.57.F02.1.454.CMB.1.raw
  modified_base (151)..(151): a, c, t, g, unknown or other
  misc_feature (151)..(151): n is a, c, g, or t

SEQ ID NO: 97353 - DNA, 853 bp, Homo sapiens
  misc_feature: GYAE6OF01DDD6N.29.57.F02.1.454.CMB.1.raw
tcagatagagtactcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcgtgggggagcgttggtccagccgtgggggtccctgagctctcctgtcgcacgcctcgtggtacttccacctttcagttatttatgtactatcgactacgtcgggtccgaccgaggccgtaccggaagggggaaacgggtaccgtagggtaattagtcggttactacgtaaggttaagtttaaggtaaagttaagtcggaaacgtaaaataaacgtaatttaatttaagtttaagtacgtaacctaaacgtttcgtaacggtagggtaaaggggtacctaaggtacctttacccaacccgtacgttacccgtaaccgggtaaacgggtaacctaaacgtttaacccgaaaccggtaaccgtaaccgttaccgttagttaactttaccgtttaaacgaaaacgggttcggggacctaaacggtacccgtaaggtaacgggtaccggtacggttaacggggaaccggtaaccgtaccggggttaaccttaggtttaaaccgttaacggtttaacgggttaaggggtacgggggtaaagggtaaacggggtaaacggggtaaaccgggtttaaagggtttaccggggttaaaacggggtttacgggggttttaacgggggtaccggggggtacccgggtaaacgggggg

SEQ ID NO: 97354 - DNA, 150 bp, Homo sapiens
  misc_feature: GYAE6OF02F3KIT.29.57.F02.1.454.CMB.1.raw
  modified_base (150)..(150): a, c, t, g, unknown or other
  misc_feature (150)..(150): n is a, c, g, or t
tcagatagagtactcacgaccggtgctcgatttagctcgatatagttgggtttgggaaggtggaatcaaacgaactgtggctgcaccatctgtcttcatcttcccgccatctgatgtcgagcgtctgagcgggctggcaaggcgcatagn

SEQ ID NO: 97355 - DNA, 151 bp, Homo sapiens
  misc_feature: GYAE6OF02F9FYF.29.57.F02.1.454.CMB.1.raw
  modified_base (150)..(151): a, c, t, g, unknown or other
  misc_feature (150)..(151): n is a, c, g, or t
tcagatagagtactcacgaccggtgctcgatttagctcgatatagttgggtttgggaaggtggaatcaaacgaactgtggctgcaccatctgtcttcatcttcccgccatctgatgtcgagcgtctgagcgggctggcaaggcgcatagnn

SEQ ID NO: 97356 - DNA, 151 bp, Homo sapiens; identical to SEQ ID NO: 97350
  misc_feature: GYAE6OF02GAE7D.29.57.F02.1.454.CMB.1.raw
  modified_base (151)..(151): a, c, t, g, unknown or other
  misc_feature (151)..(151): n is a, c, g, or t

SEQ ID NO: 97357 - DNA, 151 bp, Homo sapiens; identical to SEQ ID NO: 97350
  misc_feature: GYAE6OF02GA5ZN.29.57.F02.1.454.CMB.1.raw
  modified_base (151)..(151): a, c, t, g, unknown or other
  misc_feature (151)..(151): n is a, c, g, or t

SEQ ID NO: 97358 - DNA, 151 bp, Homo sapiens; identical to SEQ ID NO: 97350
  misc_feature: GYAE6OF02F8MEO.29.57.F02.1.454.CMB.1.raw
  modified_base (151)..(151): a, c, t, g, unknown or other
  misc_feature (151)..(151): n is a, c, g, or t

SEQ ID NO: 97359 - DNA, 189 bp, Homo sapiens
  misc_feature: GYAE6OF02GMBU8.29.57.F02.1.454.CMB.1.raw
  modified_base (149)..(189): a, c, t, g, unknown or other
  misc_feature (149)..(189): n is a, c, g, or t
tcagatagagtactcacgaccggtgctcgatttagctcgatatagttgggtttgggaagtggaaatcaaacgaactgtggctgcaccatctgtcttcatcttcccgcatctgatgtcgagctctgagcgggctggcaaggcgcagtagnnnnnnnnnnnnnnnnnnnnnnnnnnnnnnnnnnnnnnnnn

SEQ ID NO: 97360 - DNA, 178 bp, Homo sapiens
  misc_feature: GYAE6OF01AM7V3.44.50.E06.1.454.CMB.1.raw
  modified_base (176)..(178): a, c, t, g, unknown or other
  misc_feature (176)..(178): n is a, c, g, or t
tcagacagtatatacacgaccggtgctcgatttagatctactgacaacacacaaggcccatcggtcttcccctggcgccctgctccaggagcacctctggggcacagcggccctgggctgcctggtcaaggactacttcctatatactgtctgagcgggctggcaaggcgcatagnnn

SEQ ID NO: 97361 - DNA, 892 bp, Homo sapiens
  misc_feature: GYAE6OF01BW1LH.44.50.E06.1.454.CMB.1.raw
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccgggaagtatgttgtacacaatactccacgaccaccctcgtctttcgttctccacggggaaaggaacgccacccctccttcctcgcgacgggaccgacgtacgtacgaggtggtttaagggtaacgtaaccttagtaccgtcggttagtacaaccaagaacaacctcggccgacggacgtcccacggctcctccatctactagatgcactaccaacgtaaggggtcccggccgggcactacccgaccggaccgtacggttacgtacggtacgggtcgaacggttcgggggtccgttaggaacggaacgtaacggtaccgtttaccctaaccgttaccttcccaaacccgtaacgttccgtaacgggacccggggtacccgttaacggtaacggggaccccgggttaaaaggttaagttttttttcggaccgtaaacggttttttaacttttaaccgtcgggttaccaacgggtaaccttaaaggtttaaagtttaaacgtttacgggacccgttttaccggggtccccccgttttacccccgtttacccgggggtaaacccgggaaaaacggggggtaaacccgtaacccgggttaaaccggttacgggggttaaaacgggtaaaaccgtttttttaaaaaaaaccccgggaaacggtttccggggtttgggggtaccccttacggtaaaccccggaaacccccttaaaggtttccccggtttttaaccggg

SEQ ID NO: 97362 - DNA, 181 bp, Homo sapiens
  misc_feature: GYAE6OF01B43OP.44.50.E06.1.454.CMB.1.raw
  modified_base (178)..(181): a, c, t, g, unknown or other
  misc_feature (178)..(181): n is a, c, g, or t
tcagacagtatatacacgaccggtgctcgatttagatctactgacaacacacaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 97363 - DNA, 583 bp, Homo sapiens
  misc_feature: GYAE6OF01DEN22.44.50.E06.1.454.CMB.1.raw
  modified_base (455)..(455): a, c, t, g, unknown or other
  misc_feature (455)..(455): n is a, c, g, or t
  modified_base (573)..(573): a, c, t, g, unknown or other
  misc_feature (573)..(573): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccgaccggggaaattgtgttgacacaatctccagccaccctgtctttgtctccgaggggaaagcgccaccctctcctgcagggccagtcagagtgtaggaactacttagcctggtatcaacagacacctggcccaggcctcccgaggcctcctcattctatgatgcataccaagtcgggccgacgggcatccccgagccgaggttcaggtggcaggtcggtctgagacagtacttcactctacactatcgacgcggtacgtacgacgaccgtaagtcgtttgacttagtttactacgtntaccaacgtaccgtagccgacgtcggtaccgttaggttacgtagtttcggaccgaaggggaccaaggtcgttacgggacgtacgtacgaaacggtacgtcggtcggtacacggacccnccgtattccg

SEQ ID NO: 97364 - DNA, 672 bp, Homo sapiens
  misc_feature: GYAE6OF01BTR96.44.50.E06.1.454.CMB.1.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
  modified_base (489)..(489): a, c, t, g, unknown or other
  misc_feature (489)..(489): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggcctcccagataccgaccggggaaattgtgttgacgcagtctccaggccaccctgtcttgtctccgaggggaaancgccaccctctcctgcgacgggccagtcagngtgtgacaccacacagtcttctagcctggaccagcagacgcctggccaggcctcccgaggtcctcctnactcgtagtggtcnctactccccgacgtacgggcctacgtcggtacctccccgagcccgtaggttccaggtcggtactagggttcgggtcgtagggaactaggtacgttccaccgttcctaccaacctgtacgacgccaacgtcctcgactacgtcgtaggtaacgtttnttttacgacgtttaagtttttaacgttaccgtagttaaccgagttaactaagtttaacttaacggttcgtaaccggttcccggttaccccttcccggttaccgggaacccggtaaacggtacctaaccggtaggttacgggaactttaaaccggttaaaccggtacgtcggttacggtacccg

SEQ ID NO: 97365 - DNA, 585 bp, Homo sapiens
  misc_feature: GYAE6OF01BNMIJ.44.50.E06.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
tcagacagtatatacacgaccggtgctcgatttagatctactgacaacacacaaggggtcagagccctggggaggaactgctcagttaggacccagagggaaccatggaagcccagctcagcttctcttcctctgctactctggctcccagactaccgacggggaattgtgttgacacatctcagccacctgtcttgtctcgaggggaancgccacctcncctgcagggcagtcagagtgttaggaactacttagcctaggtactcaacagaccaccgtggccaggcctcccgaggtcctcctcacttctatcgaatgacacgtaccaaggtcggggccgacgggcacgtcccgaagccgtaggtcaggtggcgaggttcgggtctaggacgactacgtacttcactctcacacgtcacgcgacgtacgacgtacggaagttagttagacgtagtttattactagtaccaactacgtacgtacgacgtcgtacgtagtacgtaggtttacggaccggtacgggaccgaggtacggtacggtagacgtacgaacgtaacgtcggtacgacgtacgacgcgtgtacg

SEQ ID NO: 97366 - DNA, 520 bp, Homo sapiens
  misc_feature: GYAE6OF01A6P8A.44.50.E06.1.454.CMB.1.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (517)..(517): a, c, t, g, unknown or other
  misc_feature (517)..(517): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccacctgtctttgtctccaggggaaagngccacctctcctgcagggccagtcagagtgttaggaactacttagcctggtatcaacngacacctggccaggctcccaggctcctcatctatgatgcatccaatagggccgcgggcactccagccaggttcagtggcagtgggtctgagacagacttcactctcaccatcagcgcctaggacgaccggaagtatttgctagtttattactgtacaactacttagcgtacgtggtacctaggtactagtttggccgagggtaccaaggcgtggagcgtacaaacgactcgtgctgcacgtntcg

SEQ ID NO: 97367 - DNA, 508 bp, Homo sapiens
  misc_feature: GYAE6OF01DRCO1.44.50.E06.1.454.CMB.1.raw
  modified_base (218)..(218): a, c, t, g, unknown or other
  misc_feature (218)..(218): n is a, c, g, or t
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccgggggaaattgtgttgacacaatctccagccaccctgtctttgtctccaggggaaangccaccctctcctgcagggccagtcagagtgtaggactacttagcctggtatcaacagacacctggccaggctcccaggctcctcatctatgatgcatccaatagggccgcgggcactcccagccaggttcacgtggcaggtgggtctgagactagacttcactctcacatcagcggctagagccgagtatttgctagtttatctgtcaacgccgtagcgacgtgcctaggtacngtttaggccgtagggaccagcgtaggagctacaaacgacnggtgctgacncntcg

SEQ ID NO: 97368 - DNA, 565 bp, Homo sapiens
  misc_feature: GYAE6OF01D6V3P.44.50.E06.1.454.CMB.1.raw
  modified_base (218)..(218): a, c, t, g, unknown or other
  misc_feature (218)..(218): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccaccctgtctttgtctccaggggaaagngccaccctctcctgcagggccagtcagagtgttaggactacttagcctggtatcaacagacacctggccaggctccccaggctcctcatctatgatgcatccaaatcgggccgcgggcactcccgagccaggttcagtggacaggtggtctgagacagtacttcactctcacatcacgcgactagacgaccggtaagtagttttcgacttagtttacttacgtgtacaacgtacgtacgccgacgtggaccttaggtacgtacggtttcggaccgaggggtaccaaggtcgtacgggagtactacgaaaaccggtacgtggtacggactacggacctaccgtgtccg

SEQ ID NO: 97369 - DNA, 665 bp, Homo sapiens
  misc_feature: GYAE6OF01B029I.44.50.E06.1.454.CMB.1.raw
  modified_base (219)..(219): a, c, t, g, unknown or other
  misc_feature (219)..(219): n is a, c, g, or t
  modified_base (308)..(308): a, c, t, g, unknown or other
  misc_feature (308)..(308): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccgaccggggaaattgtgttgacacaatctccagccaccctgtctttgtctccgaggggaaangccaccctctcctgcaggccagtcagagtgttagactacttagctggtatcaacagaccactggccaggcctccgaggctctcatctangatgactatccgaaagtcgggccgcgggccacgtcccaggcccgtaggttccgaggtcggcgtaggtcggggtctaggacgtaccgaggtacttccgaccttccgtaccaacccgtacttaccgaacggtacccggtaccgtaacggaccggtacccgggtaagttacgttttacgaccgtttaagttttacgtttaacgttacgtaacctaacgtaccgtaacggtacggtacgtaccggtaccgtaacggttacgttacggttttacggaccggtaacggggtaccgaaggtccgtacggtaacgacgttaacgaaacgtacgtacggtggacttacgacctaccgtacgttccg

SEQ ID NO: 97370 - DNA, 779 bp, Homo sapiens
  misc_feature: GYAE6OF01CVT53.44.50.E06.1.454.CMB.1.raw
  modified_base (220)..(220): a, c, t, g, unknown or other
  misc_feature (220)..(220): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggcctcccagataccaccggggaaattgtgttgacacaatctccacgccaccctgtctttgtctccgaggggaaancgccaccctctcctgcacgggccagtcagagttgtagactacttagcctggtatcaacagacacctggccaggcctcccgaggcctcctcatctatgatgacagtaccaaggtagggcccggcgggactacgtccccaggtcccgtaggtttccaggtcggacgtagggtcgggttactaggaacgcgtaacgttccttacaccgttcctaccgaaccctacgtaccgtacggtcccggtcccgtacggtacccgtacgggtttaccgttacggggtaaacgggtttttagttttcggttaccgttttaaagttttttaccgtttaaaccgtttggttaaccgtaacggttaccgttaaagggtttaaacttaaacgtttaacccgttccggttaccctttacccggtttacccgttaaccggggtttacccgggggtacccgggggggtaaacgttaaacgggggttagggaacggttaaaccggttaaaccgggtaaaaccggttacggtttacggggtaaccgggtcgttaacccggtaccgtaacccgttaacgg

SEQ ID NO: 97371 - DNA, 671 bp, Homo sapiens
  misc_feature: GYAE6OF01A0WP6.44.50.E06.1.454.CMB.1.raw
  modified_base (216)..(216): a, c, t, g, unknown or other
  misc_feature (216)..(216): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
tcagacagtatatacacgaccggtgctcgatttagatctactgacaacacacaagggggtcagagccctggggaggaactgctcagttaggacccagagggaaccatggaagccccagctcagcttctcttcctctgctactctggctccagactaccgaccggggaaattgtgttgacacaatctccagccacctgtctttgtctccgagggaancgccacctctcctgcacgggcagtcagtagtgttaggaactacgttagcctaggtactcaacagacaccgtgcgagcctccgaggtcctcctnatctangactgacataccagtcgggccncgggcncgtcccagccgtaggtcagnggacgtacggtggtctagacgtacgatcctcgactctaccgactactacgacggaccgtcgtaacgacgaccggtattacgttttacgacgtttagttttaactacgtacgttaaccgtaacgtacgtaacggtaccgtaccgttaccggttacggtttaacgggttaaccgtttacgggtttaccgggaccggttaaacggggacctaaccggggtcgtaacgggttaccggaacccggttaccggaaaaccggttacggtttaccggacggtacccgttaacgaccctaacggtttcgttacccgg

SEQ ID NO: 97372 - DNA, 623 bp, Homo sapiens
  misc_feature: GYAE6OF01EOFXI.44.50.E06.1.454.CMB.1.raw
  modified_base (306)..(306): a, c, t, g, unknown or other
  misc_feature (306)..(306): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagattccaccggcgaaattgtgttgacacaatctccagccaccctgtctttgtcgtccggggaacgcgccacctctcttgcgagggccgcagactgtgacgacgacttagcctggtaaccaacgagaacgcctggccaggcctacccagcctccncatctatgtattaccttcgtaggtacggcctcgtggcctactcccgacgccccgtctttacgagtcgggacgtagggtcgggtcgtacgggaactagtacctttcgaaccttccgtaccaccgtactaccacccgacgcccgtagacgtactagtaacgttatttcgtacgttatttactttacgttgtacttactaaccggtaatacggtacgtacctactaagttacttacctacgttaccggtccgtacgggactaacgtagtaactacgtacaaacgtacgtacgtggacgtacgaccactactcgtcgttac

SEQ ID NO: 97373 - DNA, 682 bp, Homo sapiens
  misc_feature: GYAE6OF01CZFY6.44.50.E06.1.454.CMB.1.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (304)..(304): a, c, t, g, unknown or other
  misc_feature (304)..(304): n is a, c, g, or t
tcagacagtatatacacgaccggtgctcgatttagatctactgacaacacacaaggggtcagagccctggggaggaactgcttagttaggacccagagggaaccatggaagccccagctcagcttctcttcctctgctactctggctcccagataccgacgggaattgtgttgacacaatctccagccacctgttctttgtctccgaaggggaaagcgcccaccctctcctgcgaggccagtcagagtgtagaactntagctagtatacaacnacacctggccaggcctaccacgtcctcctanattctatcgatacgctactaccgaagtacggggccgacggacctacgtcccgagtaccgtagggttacaggtcggacgtagggttcgggtactagggacgtaacgtacggtacctttcaacccgttctaccaacccgtactacgtaaccggaccgggtacccgttaacggaaccggtaaccggtaacgttacgttttacgtacgtttaagttttacgttacgtttacgtaccaaccgtacgtaacgaccgtaacgtcggtacgttacggttacgttacggtttacgggaccgtaacgggtaccgaagtcgaggacgtacgtaacggtaaaccggtaaccgtggtacggtaccgtacgtacctaccgtagttcgttacg

SEQ ID NO: 97374 - DNA, 855 bp, Homo sapiens
  misc_feature: GYAE6OF01CRLQ0.44.50.E06.1.454.CMB.1.raw
  modified_base (202)..(202): a, c, t, g, unknown or other
  misc_feature (202)..(202): n is a, c, g, or t
tcagacagtatatacacgaccggtgctcgatttagatctactgacaacacacaaggggtcagagcccgtggggaggaactgctcagttaggacccagagggaaccatggaacgcccagctcagcttctcctcctcctgtctctctcggcctccagactaccgaccgggtaattgtgttgacacatctccacgcctaccgttnttcgtttcgtctaccggaagggaacgcgtaccctaccgtcctccgtggcgacggaccgtagtactaggtagttaggtacgcgtacgacgtacgttaccgtccgtaccgataccgagaagtaaactcgtcggcgaccgaccgtccggtaccgtccttacaccactttaacgtaccctactaaccctcgtaccccgtaccggaaccggtcccgtaacgttccggacctacccgtcgaaccgtacgttactaccgggttacgacggtacggccggttaggcgggtaacggtcgtaacggttacgtccgttaaccttccgtacccttaacgaccgttacgacccggtaccgacggttaccgtaccgttacggttaccgttacggtaacggtttaaccgttttagttttacctttaacgggtttaccttttaaccggtttacgttaaccgtcgggtttaacgaacggtttaagttaacgtttaaacggttaccggttaccgttaccccgggttacccgttaccccggtttaaccgggggaccgtttaaaccgggaacccgggttaccggtttaaacggaaccgggttaaacggtttaaaacccgttaacggtaccgggttaaccggttacggtaccggtaaccgttaacccggtaccg

SEQ ID NO: 97375 - DNA, 728 bp, Homo sapiens
  misc_feature: GYAE6OF01EQD67.44.50.E06.1.454.CMB.1.raw
  modified_base (364)..(364): a, c, t, g, unknown or other
  misc_feature (364)..(364): n is a, c, g, or t
  modified_base (713)..(713): a, c, t, g, unknown or other
  misc_feature (713)..(713): n is a, c, g, or t
tcagacagtatatacacgaccggtgctcgatttagatctactgacaacacacaaggggtcagagccctggggaggaactgctcagttaggacccagagggaaccatggaacgccccagctcagcttctcttcctcctgctactctggctcccagactaccgaccggggaattgtgttgacacaatctccacgccacctgtctgtgtcgtaccgaggggaacacgccaccctctccgtgcgaggccagtcgagtgttgtacgcaacgtacctaacgtacgtccgttacgtaccgacgactaacgtaactcgtacggccgtaacggtcccgtaccgacggtcctccctcattcgtacgtcggtacncgtacctacccgacgaccgggtacctacgtacgttaccacccgacgtcccggttagtccggtaggtcggtacgtcgggttcgggcgtacggacgtacgtacgttacctacctccgtaccctaacctacgtaccaggtacccacggtccctaggtaccgtagtttaccggtaagtttacgttacgttttacgggtacgttttaaactttcgttaccggtagttaacgtacgtaccgtttaagtacgtttaaacgtccggtaccgtcccgggttacccgttacccgggtacgtacccggtaaggacccgtaggtacgggtaacgtaacgtaaacggttacgacggtttagnggtaccctcggtacc

SEQ ID NO: 97376 - DNA, 511 bp, Homo sapiens
  misc_feature: GYAE6OF02GPSCF.44.50.E06.1.454.CMB.1.raw
  modified_base (481)..(481): a, c, t, g, unknown or other
  misc_feature (481)..(481): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccaccctgtctttgtctccgggggaacagccaccctctcttgcagggccggccagactgttgacgacgacttagcctggtaccaacagaagcctggccaggctcccaggcctcctcatctatggtgcatccacgagggccacgtggtactcccagccaggttcagtggcaggtgggtctgggacagagttcactctcaccatcagcagcctgcagtctgaagtattttgctagtttattactgtcagcagtatatgactggcctccttcggaccgaaggacacgactagganaattaaacgaactgtggctgcacatctgtc

SEQ ID NO: 97377 - DNA, 550 bp, Homo sapiens
  misc_feature: GYAE6OF02GCBNR.44.50.E06.1.454.CMB.1.raw
  modified_base (217)..(217): a, c, t, g, unknown or other
  misc_feature (217)..(217): n is a, c, g, or t
tcagacagtatatacacgaccggtgctcgatttagatctactgacaacacacaaggggtcagagccctggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccaacagaaacctggccaggctcccaggctcctcatctatgatgcatccaacagggtcactggcacccagacaggttcagtggcagtgggtctgggacagacttcactctcaccgtcagcaatgtacacgcctagaagtatttgctagtttattacttgtctagctagtcgttcctccacggccgtctccgtacgtttccgggaccggggggtaaccgtaacgggtcgggaacggtacgtacgacggacggtaaccgtggtacggtccgtaggtacccg

SEQ ID NO: 97378 - DNA, 527 bp, Homo sapiens
  misc_feature: GYAE6OF02GJFOK.44.50.E06.1.454.CMB.1.raw
  modified_base (217)..(217): a, c, t, g, unknown or other
  misc_feature (217)..(217): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccaccctgtctttgtctccaggggaaangccaccctctcctgcagggccagtcagagtgttaggaactacttagcctggtatcaacagacacctggccaggctcccaggctcctcatctatgatgcatccaagtacgggccgcgggcactcccagccaggttcagtggcaggtgggtctgagacagtacttcactctcaccatcacgcgcctagacgccggaagtatttgctagtttattactgtacaactaccgtagcgacgtgacgttagtactagtttcgcgtagggaccagtcgtggacgcgtacgaacgtacgtcgtcggcgtgacaccatcg

SEQ ID NO: 97379 - DNA, 509 bp, Homo sapiens
  misc_feature: GYAE6OF02F6RHK.44.50.E06.1.454.CMB.1.raw
  modified_base (217)..(217): a, c, t, g, unknown or other
  misc_feature (217)..(217): n is a, c, g, or t
  modified_base (414)..(414): a, c, t, g, unknown or other
  misc_feature (414)..(414): n is a, c, g, or t
  modified_base (507)..(507): a, c, t, g, unknown or other
  misc_feature (507)..(507): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccaccctgtctttgtctccaggggaaangccaccctctcctgcagggccagtcagagtgttaggaactacttagcctggtatcaacagacacctggccaggcctcccaggcctcctcatctatgatgcatccaatacgggccgcgggcactcccagccaggttcagtggcaggtgggtctgagacagtacttcactctcaccatcagcgctagacgaccggagtntttgcttagtttatactgtactactacgtaagagtcgcctactattatctacttccgcctggactaaggtgatatacaacgatgtgctgcacntc

SEQ ID NO: 97380 - DNA, 706 bp, Homo sapiens
  misc_feature: GYAE6OF02IDKY5.44.50.E06.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctctgctactctggcctcccagataccactggagaaatagtgatgacgcgtctcagccacctgtctgtntcncgagggaaancgccacctctcctagcgacggccagtcagagtgtagcagcaactagcctcgtaccagcaagaactcgtacggccaggcctcccgaggtcctcctctactctagtcggtcgctactaccacgacggtcccacgtcgtactcccgacgccgtaggttcgacggttcggaccgtagggtcgggttacggtacggggaactacgggtacgtttacccgaccgtttaccgtacccaaccgtaatccgaaagtccgaccggtcctacggtcgtaacgttaccgtgggtaaactttagtttttaccggaccgttttaaggttttaactttaccgtcggttaccgtaacggtaccttaaggttaaacttaaacgttaaccgttcggtacccttacgtttacccggtttaaccgggtttaccggggggaccgggggtaaaccgtaggggttaccggtaagtaaccgttaacgaaacccggttaagttccgggtaggtaccgg

SEQ ID NO: 97381 - DNA, 593 bp, Homo sapiens
  misc_feature: GYAE6OF02INKRT.44.50.E06.1.454.CMB.1.raw
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccgggggaaattgtgttgacacaatctccagccaccctgtctttgtctccaggggaaagacgccacctctcctgcagggccagtcagagtgtagcagcaacttagcctcgtaccagcaagaaatctggccaggctcccaggcctcctcatctatggtgcactccaccgaggccactggtactcccgagccgtagggttccaggtggctaggtcgggtctcggggacagtacggtttcactcgtccaaccataccagccacgccgtgacagtctagtaagttactttgcttagttttacttacttcggtactagctaagttattaagtcgtacgttcggtccctacccgtttcgcccggtaaacgggacctaccggaacgttaggtaacgtaaagttaaaaccgtacgttaggtcggacgttccgacgttaaccc

SEQ ID NO: 97382 - DNA, 536 bp, Homo sapiens
  misc_feature: GYAE6OF02FU3K0.44.50.E06.1.454.CMB.1.raw
  modified_base (218)..(218): a, c, t, g, unknown or other
  misc_feature (218)..(218): n is a, c, g, or t
  modified_base (332)..(332): a, c, t, g, unknown or other
  misc_feature (332)..(332): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccaccctgtctttgtctccaggggaaagngccaccctctcctgcagggccagtcagagtgttaggaactacttagcctggtatcaacagacacctggccaggctcccaggctccctcatctatgatgcatccaatacgggccncgggcatcccagccaggtcagtgcagtggtctgagacagacttcactctcaccatcagcgcctagacgccggaagtatttgactagtttacttacgtgtactaactaccgtagcgtacgtcggacctaggtactaggtttgaccgtagggaccaggcgtggacgccgtacgaacgtaacgtgtcggtcctgcctaccattaccg

SEQ ID NO: 97383 - DNA, 530 bp, Homo sapiens
  misc_feature: GYAE6OF02FKU4E.44.50.E06.1.454.CMB.1.raw
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggaactacttagcctggtatcaacagacacctggccaggctccccaggcctcctcatctataccacatccaccagggccactggtactcccagccagattcagtgcacgtgggtctgggacagtagttcactctcaccatcagcagcctgcagtctagagtattttgctagtttattactgtcagctagtatagtgactggtcctcgttctactttccggcccgtgggtacccactacggtcgtactttacgaaacgtacttggtcgtctcgctaccg

SEQ ID NO: 97384 - DNA, 790 bp, Homo sapiens
  misc_feature: GYAE6OF02JI3WN.44.50.E06.1.454.CMB.1.raw
  modified_base (337)..(337): a, c, t, g, unknown or other
  misc_feature (337)..(337): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctctgctactctggctcccagataccaccggggaaattgtgttgacacaatctccagccaccctgtctttgtctccgaggggaaagagcccaccctctcctgccgacgggccagtcagagtcgttaccagcaacttagcctggtaccaccagaaaccgtgggcaggcctcccgaggtcctccctacacttcctagtacggaaaccncgtaccaccgagggccaaccgttaggtactaccccaaggcccctaagacgtttacccgaagggttcggaccctaacggtttcgggggtccgttcgggggaaactacggtaacggtttcccaaccgttcctttacgaaccctagtaccgaacggcctaacggccccgttgtacccgtaaggttcccgtaacgggtaaagtttacgtttttcgacttaacggtttttttaaacgtcttttacggacccgttaaaggtacttaaacgggttaagtttaacgggttcgttaacccggttcggttccccgtttccgtttaaccgttccggttttacccccggtacccgggttcggtaaacccccgtaccggttaggttacccgtttaaacgttttaaccgaaacccggttacgtttacgggtaaccgtccggtttaccctacccggtacccttaaccg

SEQ ID NO: 97385 - DNA, 643 bp, Homo sapiens
  misc_feature: GYAE6OF02F7SW7.44.50.E06.1.454.CMB.1.raw
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccactggagaaatagtgatgacgcagtctccagcccaccctgtctgtgtctccgaggggaaancgccaccctctcctgcagggccagtcagagtgtagactactagcctggtatcaanagacaccgtggccgacggcctcccgaggcctcctcatcctatgatcgctataccaaggtcggggcccgtacgggaccaccgtccccaggacccgtaggttcagggtcggcgtagggttcgggtactagggaactaccgtacgtacttacgtacctcctacctacctacgtacgacggccggtaccgtaaggacggaccggttaagttagttttacgttacgtttacgttacgttacgtacctaaccgtacgtacgacgtacgtacggtaccgttaaggttaccgttacggtttcgaccggtaacgggtaccgtaacggtcggtacggacgtacgtacgtaaccggtacgtcggtacgtcgtacgtaccg

SEQ ID NO: 97386 - DNA, 697 bp, Homo sapiens
  misc_feature: GYAE6OF02GSX7W.44.50.E06.1.454.CMB.1.raw
  modified_base (215)..(215): a, c, t, g, unknown or other
  misc_feature (215)..(215): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgcttactctggctcccagataccaccggggaaattgtgttgacacaatctccagccacctgtctttgctccaggggaangccacctctctgcaggccagtcagagtgtaggactacttagcctggtatcaacagacacctggaccaggtctcccgaggcctcctcgatctatgatcggctactaccaagttacggggccgcggggtacctatccccgagcctaggtttcaggtcggcaggtcgggtctaggacgacgaggtacctttcgaaccgttctaccacctaagtccgacggtccggtaccgttacggaccgggaccggtaaagttacgttttcggacgttaagttttaacttacgttcgtaccgtaaaccgtaccggtacggtacgtaaccgttgggttacccgttaacgggttaccgttacgggtttttaccggaccggttaacgggggtaccctaacgggtccgttaacggggtaccgtaccgttaaccggaaaaccggttacggttacgggttacgggtaccgttacgggaccctaaccgtacgtttacccgg

SEQ ID NO: 97387 - DNA, 591 bp, Homo sapiens
  misc_feature: GYAE6OF02FTEVU.44.50.E06.1.454.CMB.1.raw
  modified_base (217)..(217): a, c, t, g, unknown or other
  misc_feature (217)..(217): n is a, c, g, or t
  modified_base (385)..(385): a, c, t, g, unknown or other
  misc_feature (385)..(385): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttaggaactacttagcctggtatcaacagaccacctggccaggcctcccaggcctcctcatctatgatgcatccaagtcggggccgcgggcagtcacagcctaggtcaggtggcaggtagtctgagacagtacttnacctctaccacctatccgagccggcctaaggacgaccgggaagttagtttcgactaacgttttacttactaggtaccaacgtaaccggtacgtaccgtacgtcggtaccgttaaggtaccgttaggtttcggaccggtacggggaccaaggtcgtagggaccgtcgtaaccgaaacggtacgtggtacggcgtcggaccacgtacg

SEQ ID NO: 97388 - DNA, 803 bp, Homo sapiens
  misc_feature: GYAE6OF02GFSQZ.44.50.E06.1.454.CMB.1.raw
  modified_base (221)..(221): a, c, t, g, unknown or other
  misc_feature (221)..(221): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccgaccggggaattgtgttgacacaatctccagccaccctgttctttgtcctccgaaggggaaanacgcccaccctctcctgcgagggccacgtcaggtagttggttaacggaactacgttagccttggtactacgaacacgaccaccgtcggaccacggtcctacccaggcctcctcacttctatgatcgctactaccaagtacggggccgtcgggacactcccgagtccgtagggtttcgaggtacggcgtagggttcggtacgtaggaacgaccgtacgttaccctttacctaccgtcctaaccgtaacccctagtaccgtaacgggccggttacccgtaaagggtaccgggaaacccgggtaacggtttaacgttttacggtacggttttaacggtttttaacgttttaaccgttacggttaacccgttaaacccggtacccggtttaacgtaaccgggttaacccggttaccggtaacccggtttaacgggtttaaccgtttaacgggtttttacccgggaccgggtaaaccgggggtaccgaacgggtaccggttacgggtaacggtacccgtaacccggtaaaacggtacccgtttagggtacccggtacgtaccgggtacctacccggtaatttcccgg

SEQ ID NO: 97389 - DNA, 641 bp, Homo sapiens
  misc_feature: GYAE6OF02I6CW8.44.50.E06.1.454.CMB.1.raw
  modified_base (254)..(254): a, c, t, g, unknown or other
  misc_feature (254)..(254): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagacaccactggagaaatagtgatgacgcagtctccagcccaccctgtctctgtcctaccgaggggaaagacgcccaccctctcctgcgagggcctagtcagngtgttggcagcagtcgtagccttggtccagaccaaggaacctggaccagacctcccgaggtcctcctcactctatacccacactcccaccgaggccctacgttaggtacctcccagcctaagtacttcgaggtcggcctacggttgggtcgtagggacaggtacgttaccacgttccgtaccaccgtactacgagtccacgtcctagcgtagttccgtaaggtaacgttcgttttacgacgttttaacgttttactttacgttacggttactaacggtcttaaggttaactaggttcgtaccggttcggttcccttcggtttacctaccggtttcccggcccgttacggaccctacgttcggtacttaacgttaccgaacgttaccg

SEQ ID NO: 97390 - DNA, 761 bp, Homo sapiens
  misc_feature: GYAE6OF02I83L4.44.50.E06.1.454.CMB.1.raw
  modified_base (178)..(178): a, c, t, g, unknown or other
  misc_feature (178)..(178): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctctgctactctgctccagactacccgacgggaaattgtgttgacanatctccagccacctgtcttntctcgagggaancgccacctntctgcaggccagtcagagtgttaggaactacgttacgcttaggtactacgaacgagtaaccacgtacggacccaacgggtcccttacccggaacgggtacccttcccgtacgtaaccttaccgttaactacgggtacttacggacctaaccttaacccggtaaaggttaccgggggccccggaccggacctaaccttccccgaacgtaccccggtagggtttaccgacgggttacgacgtaaggggttcggttacgaggtaaccgagtaccgtactttacgacctcgtacctacagtaccgacggccggtaacacggaacgaccggtaagttcgtttacgacgttaacgtttactacgtaacgttaccaaaccgttacgtaacgaccgttacgtaccggtaccgttaacgttacgttagggtttacccgggacgtaacggggtacctaaacgggtcgtacgggtaacaccgtttaaacgaaaccggtttaacggtccggttaaccggaaccggttccggaacccgtacgttacggttaaccg

SEQ ID NO: 97391 - DNA, 867 bp, Homo sapiens
  misc_feature: GYAE6OF02F30LP.44.50.E06.1.454.CMB.1.raw
tcagacagtatatacacgaccggtgctcgatttagatctactgacaacacacaaggggtcagagccctggggaggaactgctcagttaggacccagagggaaccatggaagccccagctcagcttctcttcctcctgctactctggctcccagataccgaccggggaattgtgttgacacaatctccagccaccctgtcttttgtctccaggggaaacgagcccaccctctcctgcagggccagtcagagtgttagaacttacttagcctggtatcaacagacacctggccaggctccccagcctcctcatctatgtatgcactacaagtacgggcccgcggggaccactccccgacgcccgtacgggtttacctacgggttacgggaccgtaacgggttcggggttaccgttaggggaaacgaacccggacggtaacccgtttttacccgaacccgtttacccttaccccgaaccccgtaaaccgttacccgaaaccgggtaccccgggtacccgttaaacggggaacccggtaaccccggggtaaaaagggtttaacggttttttaaccgggaccgttttaaacgttttttaaacgtttaaacccgtttaggtttaccgaacggttaaccgtaaacggtttaaagttaaaaccggtttacggttaacccgggtttaccgggttaacccccgttttacccccggtttaacccggggtaacccgtaaaacgggggtacccggtaaacccgggtaaccggttaacggggtaacgggtttaaaaccgtttaaaacccgggtaaccggttagggttaccgggtacgggttaacccgtaccgtaacccgttaccgttccgttttaacccgg

SEQ ID NO: 97392 - DNA, 645 bp, Homo sapiens
  misc_feature: GYAE6OF02FZ9ZB.44.50.E06.1.454.CMB.1.raw
tcagacagtatatacacgaccggtgctcgatttagatctactgacaacacacaaggggtcagagccctggggaggaactgctcagttaggacccagagggaaccatagaagccccagctcagcttctcttcctcctgctactctggctcccagataccaccggggaaattgtgttgacacaatctccagccaccctgtctttgtctccgaggggaaagagcccaccctctcctgcgagggccagtcagtagtgttaggaactacttagcctggtactcaacagactactggccaaggctccaggcctctcatctatgatcgcatcgaatacggggccgcgggctactcccgacgtccgaaggttccaggtcgcgtagggtcggtctagacggactaaggtacctcacctcctacctacctactaccgacgccggtaccgtaacggacggaaccgggtaagttagttttacggtacgttacgtttaacttaacgttacgtaccgtaacgtaaccggtacgtacgtacgtccggtaccgttagttaacgttacggttttacgaccggtacgggtaccaacggtacgtcggacgtaccgtaaccgtaaacgtaacgtcggtacggtaccgtgacctaccgtacttacg

SEQ ID NO: 97393 - DNA, 723 bp, Homo sapiens
  misc_feature: GYAE6OF02G485P.44.50.E06.1.454.CMB.1.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
tcagacagtatatacacgaccggtgctcgatttagatctactgacaacacacaaggggtcagagccctggggaggaactgctcagttaggacccagagggaaccatggaagccccagctcagcttctcttcctcctgctactctggcctcccagataccgaccggggaaattgtgttgacacaatctccagccacctgtctttgtcgtccgggggacngccaccctntcttgcgaggccgccagtacctgttgacgacgacttacgccgttggtaccaacaggaacgtccgtacggccaggccttacccgagtactcctccaattcctaatgtaacttactttactaggttaccggccttagtcggacacgtccccaggtcccctcttccgaggtcggcgtaggttcggggtccttgggggaacctaggtaacctttccaacttcctaccgtaaccctgtacccaaacccgtaggtacccgttaacggacttacccggtaagtaaaccgtttaacgtttttacgacgtttaaacggtttttaattaacccgtttacgggttaacccttaaccgttaaaccgtttaaagggacggttaccggtcccttaaccgtaaatttaccgttaccgtaccgttttccggaccgtacggtaacaacgttcggaatttacgaacgaaacgtacgtagtcgtaactgcccgtaaatctacgttctacttaccg

SEQ ID NO: 97394 - DNA, 200 bp, Homo sapiens
  misc_feature: GYAE6OF01EQIFV.39.28.C06.1.454.CMB.1.raw
  modified_base (194)..(200): a, c, t, g, unknown or other
  misc_feature (194)..(200): n is a, c, g, or t
tcagtcgcactagtcacgaccggtgctcgatttagagctcacgtattgggtttgggtgccgaagttgctggaggtcacggtcaccacgctgctgagggagtagagtcctgaggactgtagcacagcggccctgggctgcctggtcaaggactacttccactagtgcgactgagcgggctggcaaggcgcatagnnnnnnn

SEQ ID NO: 97395 - DNA, 249 bp, Homo sapiens
  misc_feature: GYAE6OF01CYLTG.39.28.C06.1.454.CMB.1.raw
  modified_base (203)..(207): a, c, t, g, unknown or other
  misc_feature (203)..(207): n is a, c, g, or t
  modified_base (209)..(214): a, c, t, g, unknown or other
  misc_feature (209)..(214): n is a, c, g, or t
  modified_base (216)..(249): a, c, t, g, unknown or other
  misc_feature (216)..(249): n is a, c, g, or t
tcagtcgcactagtcacgaccggtgctcgatttagagctcacgtattgggtttgggtgaccggaagttgctggaggtcaccggtcacccacggcttgctgtagggagttagagtcctgaggactgtagcacagcggcctggctgcctggtcaaggactacttccacttagtgcgactgtaagcgggctggcaaggcgcatagnnnnngnnnnnngnnnnnnnnnnnnnnnnnnnnnnnnnnnnnnnnnn

SEQ ID NO: 97396 - DNA, 197 bp, Homo sapiens
  misc_feature: GYAE6OF01BHBYY.39.28.C06.1.454.CMB.1.raw
  modified_base (194)..(197): a, c, t, g, unknown or other
  misc_feature (194)..(197): n is a, c, g, or t
tcagtcgcactagtcacgaccggtgctcgatttagagctcacgtattgggtttgggtgccgaagttgctggaggtcacggtcaccacgctgctgagggagtagagtcctgaggactgtagcacagcggccctgggctgcctggtcaaggactacttccactagtgcgactgagcgggctggcaaggcgcatagnnnn

SEQ ID NO: 97397 - DNA, 197 bp, Homo sapiens; identical to SEQ ID NO: 97396
  misc_feature: GYAE6OF01B8QF5.39.28.C06.1.454.CMB.1.raw
  modified_base (194)..(197): a, c, t, g, unknown or other
  misc_feature (194)..(197): n is a, c, g, or t

SEQ ID NO: 97398 - DNA, 194 bp, Homo sapiens
  misc_feature: GYAE6OF02H5GSN.39.28.C06.1.454.CMB.1.raw
  modified_base (194)..(194): a, c, t, g, unknown or other
  misc_feature (194)..(194): n is a, c, g, or t
tcagtcgcactagtcacgaccggtgctcgatttagagctcacgtattgggtttgggtgccgaagttgctggaggtcacggtcaccacgctgctgagggagtagagtcctgaggactgtagcacagcggccctgggctgcctggtcaaggactacttccactagtgcgactgagcgggctggcaaggcgcatagn

SEQ ID NO: 97399 - DNA, 239 bp, Homo sapiens
  misc_feature: GYAE6OF01D9OJG.41.25.C03.1.454.CMB.1.raw
  modified_base (237)..(239): a, c, t, g, unknown or other
  misc_feature (237)..(239): n is a, c, g, or t
tcagtctatactatcacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 97400 - DNA, 243 bp, Homo sapiens
  misc_feature: GYAE6OF01AY5S3.41.25.C03.1.454.CMB.1.raw
  modified_base (238)..(243): a, c, t, g, unknown or other
  misc_feature (238)..(243): n is a, c, g, or t
tcagtctatactatcacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnnn

SEQ ID NO: 97401 - DNA, 534 bp, Homo sapiens
  misc_feature: GYAE6OF01D8OZA.41.25.C03.1.454.CMB.1.raw
  modified_base (527)..(527): a, c, t, g, unknown or other
  misc_feature (527)..(527): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtatttttcgaagaccttcccgtggggtccccttttcggttttctggctccatcgacagtccctccaactccgcctcccttaccatatctgggctgaagagtgaggacgaggctgactacttctgtcagtcttatgataataaacaattatgtgattaattggcggagggacgagggtgaccgtctaggtcagcccaaggcctcgcccctcggtcactctcgttcccgccctctcatatntagctgg

SEQ ID NO: 97402 - DNA, 521 bp, Homo sapiens
  misc_feature: GYAE6OF01AK7PW.41.25.C03.1.454.CMB.1.raw
  modified_base (380)..(380): a, c, t, g, unknown or other
  misc_feature (380)..(380): n is a, c, g, or t
  modified_base (515)..(515): a, c, t, g, unknown or other
  misc_feature (515)..(515): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttctgggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctggctgaagngtgaggacgaggctgactacttctgtcagtcttatgatataaacattatgtgattagttggcggaggacgagggtgaccgtctaggtcacgccgagctcgccccgtcgtcactctcgtccccacctcctcatgtntgtacg

SEQ ID NO: 97403 - DNA, 568 bp, Homo sapiens
  misc_feature: GYAE6OF01D1P35.41.25.C03.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
tcagtctatactatcacgaccggtgctcgatttagtagtgtagatttgggtttggggtaaggtagtggagccatctaccactatggcctgggctccactacttcctcaccctcctcgcttcactgcacaggttcttgggcccatttttatactttgtactacagcccccactctgtcgtcggagtcttccggggaanaccggtaaccctgtcctgcacccgcagcaggcggcagcaattggccaggcagctatgtncagtggttccagtcagcgcccgggcagttcctcccgtcactctaatttatgagtattttcgaagactccctggggtcccctttcggttttctggctcatcgacagtccctcaactccgcctccttacatatctggctgagagtgaggacgaggctgactacttctgtcagtcttatgatataacattatgtagattaattgggacggagggaccgagggtagaccgttccgtaggtcacgcccaaggcctcgccccttcggtctactcgtcgttccccgtcccttcctctacttagttactagtcgttaggg

SEQ ID NO: 97404 - DNA, 522 bp, Homo sapiens
  misc_feature: GYAE6OF01C2EYU.41.25.C03.1.454.CMB.1.raw
  modified_base (428)..(428): a, c, t, g, unknown or other
  misc_feature (428)..(428): n is a, c, g, or t
  modified_base (499)..(499): a, c, t, g, unknown or other
  misc_feature (499)..(499): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgagattttcgaagactcctgggtcccctttcggtttctggctcatcgacagtccctcaactccgcctcccttaccatatctgggctgagagtgaggacgaggctgactacttctgtcagtcttatgatataaactaattatgtnatattggcggaggacgagggtgaccgtctaggtcagcccgaagctcgcccctcggtcactctcgttccccnccctcctctatagtatgctacgg

SEQ ID NO: 97405 - DNA, 220 bp, Homo sapiens
  misc_feature: GYAE6OF01AHDYZ.41.25.C03.1.454.CMB.1.raw
  modified_base (219)..(220): a, c, t, g, unknown or other
  misc_feature (219)..(220): n is a, c, g, or t
tcagtctatactatcacgaccggtgctcgatttagtagtgtagatttgggtttgggggaagaggaagactgacggtcctcccaggagttcaggtgctgggcaccttgggcacgggggaggtgtgtcacaagatttgggctctgggcacagcggccctgggctgcctggtcaaggactacttcctatatactgtctgagcgggctggcaaggcgcatagnn

SEQ ID NO: 97406 - DNA, 582 bp, Homo sapiens
  misc_feature: GYAE6OF01CH62X.41.25.C03.1.454.CMB.1.raw
  modified_base (349)..(349): a, c, t, g, unknown or other
  misc_feature (349)..(349): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttcctcccgtcactctaatttatgaagtatttttcgaagtaccttcccgttggggttccccttttcggttttctggctccatcgacngtccctccaacctccgcctcccttaccatactcgtgggctgaagagtgaggacgaggctgacttacttctgtctagttcttatgtaattaataaactaatttagtgttagtattaagttgggacgggagggaccgagggtcgtaccgtccgtaggtcacgacccgaaggtcctccgccccgtcggtcctactcgttccgttccccgcccttcctacacttagtatagcgtcgg

SEQ ID NO: 97407 - DNA, 538 bp, Homo sapiens
  misc_feature: GYAE6OF01C67K2.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctcaactccgcctccttaccatatctgggctgaagagtgagacgaggctgactatctgtcagttctatgataataaacaattatgtagattaagttggacggagggaccagggtcgtaccgtcgtaggtcagcccaaggctcggcccctcgggtccatctcgttccccacctccctcaactagtatagcgtacgg

SEQ ID NO: 97408 - DNA, 597 bp, Homo sapiens
  misc_feature: GYAE6OF01DAOW4.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttcctcccgtcactctaatttatgaagtattttcgaacgactcccgtggggttccccttttcggttttctggtcctccatcgacacgtccctcaacctccgccctcccttaccatatctgggctacgagagtgaggacgaggctgacctacttctgtcacgttcttatagataataaactaatttatgtagtactaagttgggacggagggtaccgagggtcgaccgttacctaggtacgacgccgtaaggtcgtaccgcccccgtcggtcctaccgttccgttccgttcccccgtccccgtcccttacctaacttacgtaacttcgcgtacggg

SEQ ID NO: 97409 - DNA, 537 bp, Homo sapiens
  misc_feature: GYAE6OF01C1TO4.41.25.C03.1.454.CMB.1.raw
  modified_base (516)..(516): a, c, t, g, unknown or other
  misc_feature (516)..(516): n is a, c, g, or t
  modified_base (533)..(533): a, c, t, g, unknown or other
  misc_feature (533)..(533): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacacgtccctccaactccgcctcccttacatatctgggctgagagtgaggacgaggctgactacttctgtcagttcttatgatataaactaattatgtgtataagttgggacggagggaccgtagggtcgaccgtcgttaggtcagcccaaggctcgcccctcggtcactctcgttcccnccctctcacttatatgntcgg

SEQ ID NO: 97410 - DNA, 537 bp, Homo sapiens
  misc_feature: GYAE6OF01DXTH9.41.25.C03.1.454.CMB.1.raw
  modified_base (383)..(383): a, c, t, g, unknown or other
  misc_feature (383)..(383): n is a, c, g, or t
  modified_base (526)..(526): a, c, t, g, unknown or other
  misc_feature (526)..(526): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtattttcgaagacttccctggggtcccctttcggttttctggctccatcgacacgtccctcaactcccgcctcccttacatatctggctgaagngtgaggacgaggctgactacttctgtcagtcttatgtaatataaactattatgtagtattaagttgggacggagggaccagggtcgtaccgtcgtaggtcacgccgaaggctcgcccctgtcactctcgtcccgcctcctacntatctagctgg

SEQ ID NO: 97411 - DNA, 563 bp, Homo sapiens
  misc_feature: GYAE6OF01DIWZ4.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtattttcgaagactcccgtcggggtcccctttcggttttctggctccatcgacacgtccctccaactccgcctcccttaccatatctgggctgagagtgaggacgaggctgactacttctgtcagttcttatgatataaactaattatgtagtaattaattgggcggaagggaccgagggtcgaccgtacgtaggtcgacgcccgaaggctccgccccctggtcctaccttcgttccgttccccaccccttcctacattagtactgacgtacggg

SEQ ID NO: 97412 - DNA, 583 bp, Homo sapiens
  misc_feature: GYAE6OF01CR7AK.41.25.C03.1.454.CMB.1.raw
  modified_base (260)..(260): a, c, t, g, unknown or other
  misc_feature (260)..(260): n is a, c, g, or t
  modified_base (475)..(475): a, c, t, g, unknown or other
  misc_feature (475)..(475): n is a, c, g, or t
  modified_base (509)..(509): a, c, t, g, unknown or other
  misc_feature (509)..(509): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggnagttcctccgtcactctaatttatgaagtattttcgaagtactcccgtggggttcccctttcggtttctggcctcatccgacacgtccctcaacctccgtcctcccttacatatcgtgggctgaagagtgaggacaggtctagacttacttctgtacagttcttagtgaattaactaaactaatttatgtagtaattagttggacggaggaacgnggtacgaccgtcgtagtacacgaccgaaggtccnccgtccccgtcggtcctaccgtccgttcccggttccccgccccttccgtactactaagtactaggcgttacggg

SEQ ID NO: 97413 - DNA, 556 bp, Homo sapiens
  misc_feature: GYAE6OF01C2256.41.25.C03.1.454.CMB.1.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggnagttctcccgtcactctaatttacngaagtattttcgaagtaccttcccgtggggttccccctttcggtttttctcggcttccattccgacacgtcccctcaacctccgcctcccttaccatactctgggctgaagagtgaggacgaggctgactacttctgtcagtctatgatataacattatgtagtataagttggacggaggaccgagggtacgtaccgtccgtaggtcagcccgaaggtctcggcccctggtcacgtctcgtccccgtcctcctcatagtctagtcgtacgg

SEQ ID NO: 97414 - DNA, 608 bp, Homo sapiens
  misc_feature: GYAE6OF01AIA0M.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggtccagcagcgcccggcacgttctcccgtcactctaatttatgaagtattttcgaagtaccttccccgtcgggggttcccccttttcgggttttcctcgggccttccatcgacacgtcccctccaacctccgcctcccttaccatactcgtgggctagaagagtggaggacgaggctgacttacttctgtcagttcttatgtatataaactaattatgtagtaattaagtgggacggaagggaccgtagggtcgtacccgttcgtaacggtcgacgacccgtaacggcctaccgcccccgttcggtccctaccgttcgtcccgttccccggccccttccgtacctacgtagtacgtacgtcgtacgg

SEQ ID NO: 97415 - DNA, 672 bp, Homo sapiens
  misc_feature: GYAE6OF01EHA0W.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagaccggtaaccctgtcctgcacccgcagcagcggcagcattggcagcagctatgtgcagtggttccagccagccggcccggctacgttcctcccgtctaccttacttaatttatagtaagtacttttacggaacgtaccgttcccggttcggggtttcccccttttcgggttttcctcggtccttaccctagtccgacctaccgttcccctacccaacctccccgtccccttacccttaccacttacgtcgtcgggctaggaaacgtaggtaggacgggacggtaggtctacgtaccttacttcgttgtacgtagttcttaagtagtaattaacttaaactaatttagtagtagtattaaggtcgggacggacgggtaccgtagggtcgtaccgttcgacgtcgacgaccgagtccgtcccgtccccgtcgtcctaccgttccgttccgtcccccgtccctccgtactacgttacgtactcgtagtacggg

SEQ ID NO: 97416 - DNA, 618 bp, Homo sapiens
  misc_feature: GYAE6OF01C7ZX8.41.25.C03.1.454.CMB.1.raw
  modified_base (400)..(400): a, c, t, g, unknown or other
  misc_feature (400)..(400): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccactctgtgtcggagtcttcggggaagacggtaaccctgtcctgcacccgcagcagcggcagcattggcagcagctatgtgcagtggttccagcagcgcccgggcagttctccgtcactctaatttatgaagtattttcgaacgtaccttcccgttcggggttccccttttcggttttctcggtcctccatccgtacacgtccctcaacctcccgcctcccttaccattactctgggctgaagngtgaggtacgagctgacttacttctgtctagttcttatagtataaataaactaattagtagttagtaagttaagttgggacgggagggaacccgtaggggtacgtaccgtccgtacggtacacggacccaaggtcctacccggtccccgtacggtcctaccgtccgttcccgttccccgaccccttccctactaataacgttacgtacgtcgtacggg

SEQ ID NO: 97417 - DNA, 711 bp, Homo sapiens
  misc_feature: GYAE6OF01EO0L7.41.25.C03.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
tcagtctatactatcacgaccggtgctcgatttagtagtgtagatttgggtttgggaagtaggtggagcatctccactatggcctgggctccactacttctcaccctcctcgctcactgcacaggttcttgggccctattttatattgacacagccccactctgtgtcggatcgttcgggaagacggtaaccctgtcctgcaccgcagcagcgnagcattggcagcagctatgtncagtgtccagcagcgccggcacgtcnccgtcactctaattntgagtatttcgaagtaccgtcccgtgggttccccttttcggtttctcggtctctagtcgactacgtccctacgaaccgtcccgtccttacccttactattacgtccgttacgggaccttaggtaaacgtacggttacggaacggtacggacggccttacggtaaccttactttcgtgttacgtaggttaccttagtacgtaattaaattaaactaagtttatagttaactaaagttaacgttaacgggacggtaacgggtaaccacgggggttacgaacccggtttacggttaacgtcgtaacccggcccgtaaaggggtccccgtacccgtacccccggttacgggtccctaaacccgttccggttcccgttaaccccctaccccgttccgttacgtaacgtttaaccggtaacgtacccggtaagtaaccggg

SEQ ID NO: 97418 - DNA, 578 bp, Homo sapiens
  misc_feature: GYAE6OF01EIZO7.41.25.C03.1.454.CMB.1.raw
  modified_base (393)..(393): a, c, t, g, unknown or other
  misc_feature (393)..(393): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttcctcccgtcactctaatttatgaagtattttcgaagtaccgtcccgttcggggttccccttttcggttttctggctccgatcgactacgtccctccaacctcccgcctccctacatatctggctgaagngtgaggacgaggctgacttacttcgtcgtctagttcttatgtaattaataaactaattatgtagtaataagttgggacggtagggaccgtagggtcgtaccgtcgtaggtccagcccgaggcctcgccccgtcggtcctactccgttcgtccccgccctccgtctacttagtactagtcgtacgg

SEQ ID NO: 97419 - DNA, 591 bp, Homo sapiens
  misc_feature: GYAE6OF01BMP5C.41.25.C03.1.454.CMB.1.raw
  modified_base (260)..(260): a, c, t, g, unknown or other
  misc_feature (260)..(260): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggnagttcctcccgtcactctaaatttactggaagatttttcggaagaccttccccgtcgggggttcccccttttcgggttttcctgggtccttcccatccgactacgttccctccaactccgcctccctacatactctggctgaagagtgagacgagctgactacttctgtcagtcttatgatataaacattatgtgattagttggcggaggaccgagggtcgtaccgtcgtagtcgacgacccgaaggcctaccgcccccgtcggtcctaccgttccgttcgtttccccctaccccgttcctacgtacgttaacgtacttacgacgtacggg

SEQ ID NO: 97420 - DNA, 541 bp, Homo sapiens
  misc_feature: GYAE6OF01BXYND.41.25.C03.1.454.CMB.1.raw
tcagtctatactatcacgaccggtgctcgatttagtagtgtagatttgggtttgggggctgtgggtccaagaggcagaactctgggtgtctcaccatggcctggatccctctacttctccccctcctcactctctgcacaggctctgaggcctcctacgagctgacacagccaccctcggtgtccgtgtccccaggacagacggccaggatcacctgctgtggagatgcatcgaccaaaagtaatatggctattgatattagtagaagccaggccaggtcccggtgctggtgataggtgaaagacactgagacggccctgagggactccctgagcgagtctcgtggttcctgctcgagggacagcagtcacattcggccatcaggtggagtccgaggcaagaagacgaggctgacttatttctgtacaatcgagcgacaactactgcttacttatacctagttagtcgggttgttcgggacggtacgggaccctaaccgtcggtacccgttccgtacgttcctacgacgtcgttggtacgg

SEQ ID NO: 97421 - DNA, 678 bp, Homo sapiens
  misc_feature: GYAE6OF01CU0TC.41.25.C03.1.454.CMB.1.raw
  modified_base (240)..(240): a, c, t, g, unknown or other
  misc_feature (240)..(240): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccactctgtgtcggagtcgttcggggaagaccggtaaccctgtcctgccacccgcagcagcggcagcattggcagcagctatgtncgagtggtccagcacggccggcccggctagttcctcccgtcactcttaaatttatagaagtagttttacgaactaccgttcccgtcgggttccccttttcggtttctggctccagtcgacaccgtccctactaacctcccgtcccttacccgttacctaacgttctaccggtcgggactaggtaagtaggttacggaacggtacggacggtcttacgtaacctttacgttcgttacgtacgtagtttcttaagtagtaaacttaactaaaactatttagtgtaagtaagttaagttgggacgggaaggtaccgtagggtacgtacccgtacgtacgtcacgacccgtaaggtcccgtccgccccgttcggtacctaccgttccgttaccctaccccccacccttcctacgtaacgtcgtaaactcggtaccgtacggg

SEQ ID NO: 97422 - DNA, 572 bp, Homo sapiens
  misc_feature: GYAE6OF01EZVPG.41.25.C03.1.454.CMB.1.raw
  modified_base (346)..(346): a, c, t, g, unknown or other
  misc_feature (346)..(346): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttcctcccgtcactctaatttatgaagtattttcgaagactcccgtcggggttccccttttcggtttctcggtctccatcgacncgtccctccacctcccgccctccttacatatctggctgaagagtgaggacgaggctgacttacttctgtcagttcttatgtaataataaataattatgtagattaagttgggacggaggacgagggtcgaccgtctaggtcacgcccgaagtcctccggtcccccgtcggtcctacttccgttccgttcccccgccctccctactacttaagtacttagcgtacgg

SEQ ID NO: 97423 - DNA, 597 bp, Homo sapiens
  misc_feature: GYAE6OF01B3V8I.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtattttcgaagtacctcccgtggggttccccctttggttttctggctccatcgacacgtccctccaactcccgcctcccttaccatactcgtcggctagaagagtgaggacgaggctgtactacttctgtcagttcttatgaataataaactaattatgtagtaataagttgggacggagggaccgtagggtcgtacccgtcgtaggtcacgacccgaaggtcctccggtcccccgtacggtcctaccgttccgttcccgttaccccctaccccgttcccttacacttaagtacgtaacgtcgtacggg

SEQ ID NO: 97424 - DNA, 569 bp, Homo sapiens
  misc_feature: GYAE6OF01CKOGW.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtattttcgaaagacctccccgtgggggttcccctttcggttttctggctccatcgacagtccctcaacctccgccttcccttaccatatctgggctagaagagtgaggacgagctgacttacttctgtctagttcttatagattaataaactaatttatgttagaattaagttgggcggtaagggaccgagggtagtacccgtccgtaagggtcacgcccgaaggtcctcggccccctcggtccactctccgttccccaccctcctcatagtatgtcgtgg

SEQ ID NO: 97425 - DNA, 613 bp, Homo sapiens
  misc_feature: GYAE6OF01DO6ZY.41.25.C03.1.454.CMB.1.raw
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcgttcggggaagacggtaaccctgtcctgcacccgcagcagcggcagcatggcagcagctatgtgcagtggtccagcagcgcccgggnagttctcccgtcactctaattntgaagtatttcgaagtaccttcccgtcgggttccccttttcggtttctcggctcatcgacacgtccctcaactcccgtcctccctacatatcgtggctagaagagtgacggacgaggctagacttactctgtctagttcttagtgtaataataaactattagtgtagaattaagtgggacggaacgggtaccgaggggtacgtacccgttacgttacggtaccacggacccgtaaggcccttcccggcccccgttacgggtccctaccgttccgttcccggttccccccgtccccttccctacgtacgttaacgtattaccggacgtacggg

SEQ ID NO: 97426 - DNA, 603 bp, Homo sapiens
  misc_feature: GYAE6OF01AHKBR.41.25.C03.1.454.CMB.1.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (459)..(459): a, c, t, g, unknown or other
  misc_feature (459)..(459): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtacttcggggaagacggtaaccctgtcctgcacccgcagcagcggcagcattggcagcagctatgtgcagtggttccagcagccgcccggcagttcnccgtcactctaattanagaagtattttcgaagtacctcccgtcgggttccccttttcggttttctggcctccatcgactcgtccctccaacctcccgcctcccttacattancgtggctaggaagngtgaggacgagctgtactacttcgtgtacagttcttagtgtaattaactaaactaattataggttntaagttaagtgggacggtcgggaccgtagggtcgtacccggttcgtacggtacacgacccgaacggtcctccggtccccgtcggtctacccttcgttcccgttacccccgtccccttccgtacacttagtacgtcgtcgtcggg

SEQ ID NO: 97427 - DNA, 603 bp, Homo sapiens
  misc_feature: GYAE6OF01DVT1I.41.25.C03.1.454.CMB.1.raw
  modified_base (275)..(275): a, c, t, g, unknown or other
  misc_feature (275)..(275): n is a, c, g, or t
  modified_base (392)..(392): a, c, t, g, unknown or other
  misc_feature (392)..(392): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccactctgtgtcggagtcttcggggaagacggtaaccctgtcctgcacccgcagcagcggcagcattggcagcagctatgtgcagtggttccagcagccgcccgggcagttcctcccgtnactctaatttatgaagtattttcgaagtactcccgttcggggttccccttttcggttttctggtctccatcgacacgtccctccaactccgcctcccttacatactctggctagagngtgaggacgaggctagacttacttctgtcagttcttatagataataaactaattagtgttagaattaagtgggacgggaaggtaccgagggtacgtaccggtcgtacggtcacgcccgtaaggtccgtccgcccccgtcggtcctaccttccgttccgttcccccgtccccttacccttacctaagttacgttacgtagtaccgttacggg

SEQ ID NO: 97428 - DNA, 752 bp, Homo sapiens
  misc_feature: GYAE6OF01CKZUE.41.25.C03.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
tcagtctatactatcacgaccggtgctcgatttagtagtgtagatttgggtttgggaagtagtggagcatctccactatggcctgggctccactacttctcacctcctcgctcactgcacaggttcttgggccctattttactattgacacagccccatctgtgtcggagtcttcggggaagacggtaaccctgtacctgccacccgnagcagcgcagcattggctagcagctatgtgcagtggttccagcagcgccgggcagttcctccgtcactctaatttacngtaagtattttacgaacgtaccttcccgttcgggttccccttttggttttcctcggtcctcctaagtcgtacgacgtcccctactaacctcccgtccttacccttaccgattacgtcgtcgggctacggaagtggtacggaacggaacggacgggtcctacggtaaccttaccgtttcgtacggttaccgtaacggttttaccttaagtacggtaaactttaaactaaaaccgttaagtttaaccgtaggtttacgtaaatttaacgggttacgggaccgggtaaccgggtaaccggtacggggttaaccgacccggtttcggtaacggttccgaaccggtacccgtaagggtccccttacccggtcccccgttacggttacccgtaaccctttccgttacccggttacccccctaacccttcccgtaaccttaacgttaacgttactaacggtccggtaaccggg

SEQ ID NO: 97429 - DNA, 603 bp, Homo sapiens
  misc_feature: GYAE6OF01DHYUP.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcgggggaagacggtaaccctgtcctgcacccgcagcagcggcagcattggcagcagctatgtgcagtggtccagcagcgcccggcagttcctcccgtcactctaatttatagaagtattttcgaagtaccgtcccgtggggttcccccttttcggttttctggtcctccatccgacacgtccctcaacctccgccctcccttaccatactcgtggctgaagagtgagacgagctagtactattctgtcagttcttaatgaataactaaactaattactggttagtaagttaagttgggacgggtaacggacgtacggggtcgtacccgtcgtacggtcacggcccgtaaggcctcgccccgttcgtacctaccttccgttccgttacccccaccttaccctactaacgttgttaactcgtacgtacggg

SEQ ID NO: 97430 - DNA, 550 bp, Homo sapiens
  misc_feature: GYAE6OF01DGC44.41.25.C03.1.454.CMB.1.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (542)..(542): a, c, t, g, unknown or other
  misc_feature (542)..(542): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagaccggtaaccctgtcctgccacccgcagcagcggcagcattggcagcagctatgtgcagtggttccagcagccgcccgggcagttcncccgtcactctaattangaagtattttcgaacgacctcccgttggggttcccctttcggttttctggctccatcgacacgtccctcactcccgccttccctacatatctgggctgaagagtgaggacgaggctagactacttctgtcagttcttatagtataataaactaattatgttagtaatagtgggacgggacggaccgagggtcgtaccgtcgagtacacgcctaagctccgcccgtcgtcnctcctcgtacccncctctcatagtangcgtacgg

SEQ ID NO: 97431 - DNA, 913 bp, Homo sapiens
  misc_feature: GYAE6OF01CSG71.41.25.C03.1.454.CMB.1.raw
  modified_base (190)..(190): a, c, t, g, unknown or other
  misc_feature (190)..(190): n is a, c, g, or t
tcagtctatactatcacgaccggtgctcgatttagtagtgtagatttgggttgggaagtaggggtggagacatctccactatggccgtgggctccaactacttctccacccgtcctcgctcactgcacaggttcttggccctattttatattgacacgacgccccactctgtgtcgagtcttcggggaanaccggtaaccctgtccctgccaccgcacgcagcggcagcattggcagcagcgtatgtgctaggtcggtttccaagtcgaggtccggcccggggacttaacggtttccctaccccggtacctaaccgttacttaaaactttttaaccgacgggtaaaattacgttttttaccggaaaacgttaccttacccgggtttccggggggtttacccccctttttagggtttttcgtcgggcccctttaccgtaacgtttaccgtaaaccgtaccggtttccccccttacgaacccgtttccccggtaccccctttaaccccttttaaccgaaacgtttaccgtacccggttaccggggtaccgtttacggaaaaccgggttacgggttaacggaaacgggtaccggtaacgggggtcctttaaccggttaaaccctttccgttttaccgttacgggttacccgttaacgggtttacctttttaacgaaggtttaaaccttaaattaaaaccggttaatttacgttaacggtaagttaaagttaaggtttacgggacggggaaaggtaccgggtagggttaaccggtaccgttaccggtaacgggttccggacggacccgtaaaggtacccgtccggtcccccggttaggtcccttaccgtaccggttaccccgttacccctaccccgttaccttccgtaacttaccgggtaactccggtcgtaccggg

SEQ ID NO: 97432 - DNA, 569 bp, Homo sapiens
  misc_feature: GYAE6OF01ASHG1.41.25.C03.1.454.CMB.1.raw
  modified_base (260)..(260): a, c, t, g, unknown or other
  misc_feature (260)..(260): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggnagttctcccgtcactctaatttatgaagtattttcgaagtaccttcccgtcggggttccccctttggttttccgtggtcctccattccgactacgtccctaccaactcccgccctcccttaccatactcgtggctgaagagtggaggacgaggctagtacttacttctgtcagttcttatgtaataataaactaattatgtataagttaagtgggacggaggaccgagggtcgtaccgtcgtagcacgaccgtagctccgcccgtgtcctactctcgttccccaccgtcctcactagtactagctacgg

SEQ ID NO: 97433 - DNA, 555 bp, Homo sapiens
  misc_feature: GYAE6OF01A5YKF.41.25.C03.1.454.CMB.1.raw
  modified_base (390)..(390): a, c, t, g, unknown or other
  misc_feature (390)..(390): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagccgcccgggcagttctcccgtcactctaatttatgaagtattttcgaagacttcccgtggggtccccttttcggttttctggctccatcgacacgtccctccaacctcccgcctcccttaccatactctgggctgaagngtgaggacgagctgactacttctgtctagtcttatgattataaactaattatgtgtaatagttgggcggagggaccgagggtcgaccgtcgtacgtcacgccgaggcctcgcccccgtcgtcctactcgtccgttcccctacctccctctactagatgtactcgg

SEQ ID NO: 97434 - DNA, 551 bp, Homo sapiens
  misc_feature: GYAE6OF01BQSZW.41.25.C03.1.454.CMB.1.raw
  modified_base (391)..(391): a, c, t, g, unknown or other
  misc_feature (391)..(391): n is a, c, g, or t
  modified_base (453)..(453): a, c, t, g, unknown or other
  misc_feature (453)..(453): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcaccgcagcagcggcagcattggcagcagctatgtgcagtggtccagcagcgcccggcagttctcccgtcactctaatttatcgaagtattttcgaagtaccttcccgtcgggggttcccccttttcgggttttctcggctccatcgacacgtccctccaacctccgcctcccttacatatctggctgaagngtgagcgagctgactcttctgtcagtcttagtgatataaactattatgtgtaatagttcggnggacggacgaggtcgaccgtcgtaggtcacgacccgaaggcctccgcccctggtcctactcctcgtccctacctcctctactagtactacgctacggg

SEQ ID NO: 97435 - DNA, 906 bp, Homo sapiens
  misc_feature: GYAE6OF01BNZGE.41.25.C03.1.454.CMB.1.raw
  modified_base (299)..(299): a, c, t, g, unknown or other
  misc_feature (299)..(299): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgccacccgcagcagcggcagcagttggcagcagctatgtgctagtcggttccagcgacgccggcccgggctacgttcctcccgtcacttcgttaatttanagtaagttacttttacgaacgtaccgttcccgttcgggtttccccttttacgggtttttctcggtccttccgtacgttaccgaccgtacgttccccctaccgtaacccttcccccgtacccttacccccgttaacctacttaaccgttccggttacgggtaccgtaggtaaacggtacggttacgggaaacgggtaccggagggttacccgtacgggtaacccctttaccgttttaccgttacggttaaccgttacggtttaaccgtttaacgtaacggtttaaacttaaacgttaaaacctttaaagttttaaacgttaggttaacgttaaacgtttaacgggttcgggggtaaccggggtaacgggttaaacccgggtaacgggggtttacccgtaaaccccgggtttccggtaaaccggggttacccgtaaccgggttacccccgggaaacggttcccggttacccccggttaaccccccggttcgggttaacccccgttacggtttaacccccggtttcccggttaacccccccgttacccctttaccccggttaaccttaacgttaaccgggtttaactacccggttaacggtaacccgggg

SEQ ID NO: 97436 - DNA, 588 bp, Homo sapiens
  misc_feature: GYAE6OF01DYQN0.41.25.C03.1.454.CMB.1.raw
  modified_base (389)..(389): a, c, t, g, unknown or other
  misc_feature (389)..(389): n is a, c, g, or t
  modified_base (447)..(447): a, c, t, g, unknown or other
  misc_feature (447)..(447): n is a, c, g, or t
  modified_base (491)..(491): a, c, t, g, unknown or other
  misc_feature (491)..(491): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggttccagcagcgccgggcagttctcccgtcactctaatttatgaagattttcgaagtactcccgtcggggttccccttttcggttttctggccttccatcgacacgtccctcaactcccgcctcccttaccatatctgggctgaagngtgaggacgaggctgactacttctgtctagtcttatgaattataaactaattatgtanattaatgggcggaggaccgagggtacgtaccgtccgtaggtacncggacccaacggtctaccggcccccgttacggtcctacctccgttccgttacccccaccccttacccgtcgtaacttagttaactcgtacgtacggg

SEQ ID NO: 97437 - DNA, 567 bp, Homo sapiens
  misc_feature: GYAE6OF01BI4B0.41.25.C03.1.454.CMB.1.raw
  modified_base (207)..(207): a, c, t, g, unknown or other
  misc_feature (207)..(207): n is a, c, g, or t
  modified_base (561)..(561): a, c, t, g, unknown or other
  misc_feature (561)..(561): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccactctgtgtcggagtcttcggggaagacggtaaccctgtcctgcacccgnagcagcggcagcattggcagcagctatgtgcagtggttccagcagcgcccgggcagttctcccgtcactctaatttatgaagtattttcgaagtaccttcccgtcgggggttcccccttttcgggttttcctgggcctccatcgactacgtccctccaacctcccgcctcccttaccatactctgggctgaagagtggaggacgaggtctagacttacttcgtgtctagttcttatgtatataaactattatgtagattaagtgggcggagggaccgagggtcgtaccggtactacggtcacgaccaggcctcgcccctcgtcactctcgtcccctcctcctcactagtatcgngtacgg

SEQ ID NO: 97438 - DNA, 697 bp, Homo sapiens
  misc_feature: GYAE6OF01BI2U9.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggtccagcagccggcccgggctacgttcctcccgtcacttcttaaatttatagaagttattttacgaacgtaccgttcccggtccggggtttcccctttttcggttttctcggtccttccaacttccgactaccgtccccgtcctaaccgtcccgtaccttacccttacctactactcggtcggctagggaacgtaggtcggtaacgggacggtacggtctacggtaccttaccgttcgtcggttactagttacttagtagtaattaattaaaacgtatttagtagtaacgtagttaagttgggacgggaagggtaccgtaggggtaaccgtaccggttaccggtagttaccgacggtacccgaacgggtccgtacccgtacccccgttggtccctaccggttcccgttcccgtcccccgtccttaccgtactacgttagtacgtagcggtacggg

SEQ ID NO: 97439 - DNA, 706 bp, Homo sapiens
  misc_feature: GYAE6OF01CFOPE.41.25.C03.1.454.CMB.1.raw
  modified_base (253)..(253): a, c, t, g, unknown or other
  misc_feature (253)..(253): n is a, c, g, or t
tcagtctatactatcacgaccggtgctcgatttagtagtgtagatttgggtttgggggggcacaagaggcagcactcaggacaatctccagcatggcctggtctcctctcctcctcactctcctcgctcactgcacagggtcctgggcccactctgtgctgacgcagccgccctcagtgtcgtgggggccccgggcaggagggtcaccatctcctgcacgtgggagcagactccaacatcggggacagattcngatgtccactggtaccaacaccttcaggaacacgccccaaactcctacattcgtttacggtaacaactatccggccctcgacggggtccctcgaccgtattcctctggctaccgaagtctggacctaccgtcaccgtcccttccccgtggccctaactcctaccgtcgggtccctaccgacgggcgttaggaaagtagtaggtaaggggtacgtaagttttaactttaccgttacggtcccgttaacggttaccccttaagttacggaacctaacggaccgtacgtacccgttacgtagggttggggtttacggggttcgggtttcggggaccggggtacggggtaacccgtaacgggtccgttaccggtacccgggttcccggtacggggttacccgaccgggtaccccggacgggttcccgtaccccggtccccccgttcggttacccccg

SEQ ID NO: 97440 - DNA, 649 bp, Homo sapiens
  misc_feature: GYAE6OF01AH5V8.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtatttttcgaagactccctggggttccccttttcggttttctggctccatcgacagtccctccaactccgcctcccttacatatctgggctgaagagtgaggacgaggctgactacttctgtcagttcttatgtaattaactaaactaatttattggtagtaattaagtttgggacgggacgggtaaccgtaggggtacgtaccccggttccgtaaggggtttccacggtaccccgtaaagggcccttaccgggtccccccccgttcgggtccctaaccgtttcccgttcccggtttaccccccggtccccccgtttcccttaccgtaacgtttaacgttaacgtaagggtccttacgggg

SEQ ID NO: 97441 - DNA, 866 bp, Homo sapiens
  misc_feature: GYAE6OF01EGFHX.41.25.C03.1.454.CMB.1.raw
  modified_base (210)..(210): a, c, t, g, unknown or other
  misc_feature (210)..(210): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagttcgttcggggaagacggtaaccctgtcctgccacccgnagcagcggcagcattggcagcagctatgtgcgagttcggttccagcgacggccggcccgggctacgttcctccccgtctaccttacttaattttagtaggtaaagttacgtttttaccggaaacgtacccgttccccggtttccgggggtttcccccgttttttccgggttttccgtcgggtcccttacccgacgttaccggacccgtaaccgttccccctaccccgaacccttccccgtaccccctttaccccgtttaacccacgtttacgttcccggttcggggtaccttaaggtaaacggtacggttacggaacgggaccgggtaacggttccgtacggttacccgtttaaccgtttcgttacgttacgttacggtttaccgttattacgtaattaaacgttaaacttaagttattaggtacgttaagtttaagggttgggaaccggggtaacgggtaccggtaacgggggtaccgtaacccgggtttccgtaaccgggttccgaacccggtaaccccggtaacgggtccccggttccccggtaccccccggttaccggtcccgttacccgtttccgtttacccccggtaccccccttaccccttccgtaaccgttaaccgtttaggtaaccgttcggtaacccgttacgggg

SEQ ID NO: 97442 - DNA, 656 bp, Homo sapiens
  misc_feature: GYAE6OF01CILQH.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttcctcccgtcactctaattatgaagtattttcgaagtacctcccgttcggggttcccctttcggttttctggtctccatcgactacgtccctccaacctcccgcctcccttacatactcgtggctagagagtggagacgaggtctgacttacttctgtcagttcttatcgtaattaactaaactaatttagtgttagaattaaggttgggacggaaggaccgtagggtaccgtacccggttacgttagggtaccacggaccccgtaaggtccccgtccggtacccccccgttcgggttcctaacccgtttccggtttccccggttaccccccctaacccccgtttcccgttaactaacgtttaaggtaacgttaccggtaaccggttacgggg

SEQ ID NO: 97443 - DNA, 831 bp, Homo sapiens
  misc_feature: GYAE6OF01BV16R.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttcgggccctatttttatattgacacacgccccatctgtgtcggagtcgttcggggaagaccggtaaccctgtcctgccaccgcagcagcgcagcatggcagcagctatgtgctaggtcggtccaggcgaggccggcccgggtcacgtttcctcccggtctaccgttacttaaagttttactacggtaaagtactttttacggaacgtacctttcccggttcgggtttcccccgttttcggttttcgtcggtccttaccgtacgttccgtaaccgtaccgtccccttaccgtaacctcccggtaccccttaccccgttaaacctacgttaaccttcggtcgggacttaggaaacggtagttacggggaacgggaccggtaacggggtccttacgggaaccctttaaccgtttcggtttacgtacgttaacggtttacctttaagtaacgttaaactttaaacttaaaaaccgttaaagttttaacgttaggtaacggttaaacgtttaaggggtttacgggacggggtaaacgggacccggttaacggggtaccgttaacccgggttacccgtttaacgggaccgacccgtaacccgggaacggtcccgttacccggtaccccgtcggtaccttacccgttaccgtttccggtccccgtaccccgttacctaaccgtattaaacgttctaaccggtgtaccggg

SEQ ID NO: 97444 - DNA, 702 bp, Homo sapiens
  misc_feature: GYAE6OF01DC6YF.41.25.C03.1.454.CMB.1.raw
  modified_base (185)..(185): a, c, t, g, unknown or other
  misc_feature (185)..(185): n is a, c, g, or t
  modified_base (211)..(211): a, c, t, g, unknown or other
  misc_feature (211)..(211): n is a, c, g, or t
  modified_base (265)..(265): a, c, t, g, unknown or other
  misc_feature (265)..(265): n is a, c, g, or t
  modified_base (336)..(336): a, c, t, g, unknown or other
  misc_feature (336)..(336): n is a, c, g, or t
tcagtctatactatcacgaccggtgctcgatttagtagtgtagatttgggtttgggaagtagtggagcatctccacgtatggcctgggctccactacttctcaccctcctcgctcactgcactggttcttgggccctattttatattgacacagccccactctgtgtcggagtcgttcggggaanacggtaaccctgtcctagcacccggnagcagcgcagcatggcagcaagctatgagcagtcggttccagcagccgtccggnagttcctccgtacacttctaatttagagtagtatttccgaagtacttcccgtcgggttccctttggtttcnggctccatcgacagtccctacaactcccgctacccttacatactacgtgggtctacgaaagtcgtaggagaccgagggtctgaacctcttatggtctaagttctaagtagaacttaactaaacgtaatttacgtagtataagtttaagtacgggtacgggtaacggaccggttacgggtacgtaccccgttccgttaaggaccctaagggccccgtaaaggtccccgtacccgggtaccccccgttaggggttaaacccctacggtacccggtttttacccccgttttacccccgaaacccccttttaccccccgttagttaaaaaccggttacgttaaaccgttacgtaacccggttaaccgggg

SEQ ID NO: 97445 - DNA, 856 bp, Homo sapiens
  misc_feature: GYAE6OF01EBHV3.41.25.C03.1.454.CMB.1.raw
  modified_base (238)..(238): a, c, t, g, unknown or other
  misc_feature (238)..(238): n is a, c, g, or t
  modified_base (284)..(284): a, c, t, g, unknown or other
  misc_feature (284)..(284): n is a, c, g, or t
tcagtctatactatcacgaccggtgctcgatttagtagtgtagatttgggtttgggaagtagtggagcatctccactatggcctgggctccactacttctcaccctcctcgctcactgcactaggttcttgggccctatttttatattgacacacgccccactctgtgtcggagttcgttacgggggaacgaccggttaaccctggtcctgccacccgcagcagcggcagcagttggnagcagctagtgagctaggtggttccagcgacggcccggcccgggtntacggttccctcccgtacacctacttaaagttttacgagtaaagttcgttttacggaaacgtcccgtttccccggttccgggggttttcccctttttcgggttttccgtacggtccccttccgtacgtcccgtaacctccgtaccccctaccgtaacccttccccgtacccctttaccccgttaacctacttaaccgttcggttacgggaccgtaaggtaaacggtggttacggaaacgggtacggacgggtaccttaggtaccctttaacgtttcccgtggttacccgttaagtttaccgtttaagttacggaaaaatttaaaccgtaaaaacgttaagtttagtttacgtttaaggtaaacgtttaacgggtcggggtaacggggaccgggttaaccggacggggttacccgtaacccgggttaccgttacgggtacccaacggtaccccggtaaggtccccgtccccggttacccccgtccggtacctaccgtttccccgtcccgggttccccccctacccgttcccgttaccgtaacgttaggttaaaccgttcggacccggtacggg

SEQ ID NO: 97446 - DNA, 821 bp, Homo sapiens
  misc_feature: GYAE6OF01ENTOH.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgctaggttggttccagcagccggcccgggctacgttcctcccgtacacttacttaactttatagtaagttattttacgaaccggtaccgttcccggttccggggtttcccccgtttttcgggtttcgttcggtccttccgtacgttcgacctaccggttcccctaccgaaccttccccgtcccttacccttacccattacgtcgtcgggtcgtagtaacgtaggtaggacggacggtacggacttacggtaaccttaccgtttcgtcgtcgttagtttaccttaagttagttaaagttaaacttaaaaccttaaagtttacgttagggttaagtttaaacgtttaacgggttacggggacggggttaaaccggggaacccggggttaaagggttacccgggtaacccggtttaccggttaacgggttacccgacccgggtacccgtaaccggtcccgttacccccggccccccgttttcggtaccccgttcccgttacccggtttcccccggttccccccgttcccccgttacccgttaccgttaacgttaaccgtaacgttaaccggtacccggttaacggggg

SEQ ID NO: 97447 - DNA, 800 bp, Homo sapiens
  misc_feature: GYAE6OF01CQI9W.41.25.C03.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (780)..(780): a, c, t, g, unknown or other
  misc_feature (780)..(780): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcctattttatattgacacacgccccactctgtgtcggagtcgttcggggaagtaccggtaccctgtcctgccacccgnagcaggcggcagctagttggcagcanctagtcgtgacgtggttacgtccagcgacggtcccggccgggtactacgttcccttacccgtactaccttacttaagtttacgtaggtaaagttacgtttaacgaacgtacccgttcccgggttccgggttttccccgttttcggttttccgcgtccctaccgtactaccgtactacccggttacccctacgtaaccccgtcccgttaccccttacccttaacctattccgtcggtcgggtactacggtaaggtacggtacggacggacgcgggttctaacgttacttacgtttcgtagtaaccgtagtttaccttagtaagtaaacttaaacgttaaagtgtttacgagtttaacgtaagtttaacgggacgggtacgggacggttaacgggtgggtaacctccgggtttaccaagggtacccacggtaaccccggtggttccccgtcccgggttacccccgttaaggtcccctaacccggtttccggttcccccttaccccccgtaccttcgtaaacccgtttaaggtaacccgggtttaancccgggggttaagtccgggg

SEQ ID NO: 97448 - DNA, 695 bp, Homo sapiens
  misc_feature: GYAE6OF01B7XVA.41.25.C03.1.454.CMB.1.raw
  modified_base (541)..(541): a, c, t, g, unknown or other
  misc_feature (541)..(541): n is a, c, g, or t
  modified_base (568)..(568): a, c, t, g, unknown or other
  misc_feature (568)..(568): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctatttttatattgacacagccccactctgtgtcggagtcttcggggaagacggtaaccctgtcctgccacccgcagcagcggcagcattggcagcagctatgtgctaggtcggttccagcacggccggccccgggctacgttcctcccgttcaccttacgttaatttatcgtaaagtacttttacggaacgtaccgttccccggttcggggtttcccccgtttttcgggtttttccgtcgggtccttccctacgttccgtaccgtaccggttccccctacctaaccccgttcccgtccccttacccctttacctacttacgtccggttacgggccttaaggaacgtagggtggaacggtacggacggtacgtacgtaccttacttcgttgtccgtagttacgttanacgtaataataaaacgttattacgttntacgtaattaaggttcgggagggacgtacggtaggtacgtaccgtacgtaggacaccgaccgacggtcctcccgccccgtacggctaccgtccttccgtccctccgtcctgactagtctgctacggg

SEQ ID NO: 97449 - DNA, 840 bp, Homo sapiens
  misc_feature: GYAE6OF01EM3PL.41.25.C03.1.454.CMB.1.raw
  modified_base (209)..(209): a, c, t, g, unknown or other
  misc_feature (209)..(209): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctatttttatattgacacagccccactctgtgtcggagtcgttcggggaagacggtaaccctgtcctgcacccgnagcagcggcagcattggcagcagctatgtgcagttcggtccagcgacgccgcccgggctacggttcctcccgtcacttacgttaaattttagtagtaaagttacttttacggaaacgttacccgttccccggtttccgggggtttcccccttttttcgggtttttccgtcgggtcccttcccgtagttccgtaacctacccggttccccttaacccgtaaccttccccgtaccccctttaccccttaacctacgtttacgttcggtcgggtaccgtaggtaaaggaggttacggaacgggtaacggtacgggtaccttaacggtaacctttaccctttcgttacggttactaacggttttacttaacgttagttaaactttaaacttaaaaccgttagtttaagtttaaggttaagtaacgtttaacgggttcggggaaccggggtaaccgggtaaccgggtaacggggttaccgtacccggtttaccgttaacgggtaccctacgggtaaccccggaagggttccccgttaccccggtacccccggttcggttaccctaacccgttcccggttcccgttccccccgtacctacccgtcgtaaacgttcgtaacgtaacgtcgggtaacgg

SEQ ID NO: 97450 - DNA, 889 bp, Homo sapiens
  misc_feature: GYAE6OF01DTGYH.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccactctgtgtcggagtcgttcggggaagacggtaaccctgtcctgcaccgcagcagcggcagcattggcagcagctagtgtcgcgtaggtcggttccagcgacggccggcccgggctacgttcccgtccccgtctacttacttaatttacgtagtaagttacttttacggaaacgtacccgttacccgggttccgggggtttccccctttttcgggttttccgtcgggtcccttacccgtagttaccggaacctaccggttcccccctaccctaacccgttccccgttaccccttaccccctttaaacccgtacgttacgtttccggtcggggtaccgttaacgggaaacgggtacgggttaacggggaaaccggggtaccgggtaacgggttccgttaacccggttaaccctttcccggtttcgttccggtaacttacggtttactttaaggtaacgttaactttaaaacgttaaaactttaaagtttacgttagttaagttaacggtttaagggttaccgggggaacggggtaaccgggtaacccgggtaacggggttacccgtacccgggtttaccgtaagggtacccgtacccggtacccgggtaaaccgggtcccttccccgggtaccccccggttacgtacccgtaacccggttccccgtttccccgttaacccccccgttcctaccccgttaacgtaacgttacgttaacggtacgtcggtacggg

SEQ ID NO: 97451 - DNA, 685 bp, Homo sapiens
  misc_feature: GYAE6OF01AMB17.41.25.C03.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (341)..(341): a, c, t, g, unknown or other
  misc_feature (341)..(341): n is a, c, g, or t
  modified_base (677)..(677): a, c, t, g, unknown or other
  misc_feature (677)..(677): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacacgccccactctgtcgtcggagtcttcggggaagacggtaaccctgtcctgcaccgnacgcaggcggcagcatggcngcagctatgngctaggtcggttccagcngccggcccggntacgtcctcccgtcacttacttaattagtgaagttctttacgaacgtccgtccgtcgggttcccttttggttcncggtctccatcgactacgtccccaccaccttccccgccttaccctactacttacgtccggtacggtcttaggaacgtacggtaggaacggtacggacggtcttacgtaccgttaccgtttgtcgttacctaggtttccttaaagtccgtaagtaaacttaaacttaacgttagtacgtataacgtttaggttacgggacgggtaggacccgtagggtccgtaccgttcgtagtaccgacgtaccggacggtcctacccggtcccgtacgttccgtaccttccgtttccccggtccccttaccttcggtaacgacctttaagacccgtaacgggttntaccgggg

SEQ ID NO: 97452 - DNA, 682 bp, Homo sapiens
  misc_feature: GYAE6OF01BXP7T.41.25.C03.1.454.CMB.1.raw
  modified_base (211)..(211): a, c, t, g, unknown or other
  misc_feature (211)..(211): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (661)..(661): a, c, t, g, unknown or other
  misc_feature (661)..(661): n is a, c, g, or t
  modified_base (675)..(675): a, c, t, g, unknown or other
  misc_feature (675)..(675): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctatttttatattgacacagccccactctgtgtcggagtcgttcgggggaagacggtaaccctgtcctgccacccgnagcagcgcagcatggcagcagctatgtgcaggtggtccagcacgccggcccggtnacggttcctcccgtcacttacgttaatttanagaagttnttttacgaacgtcccttcccggtcgggttcccctttttggtttccncggtcctccgtaagtccggtacctaccggttccccctactaaccttcccggtacccttaccccgttaactacttactcggtcgggccttaaggaagtaggtacggaaggaccgtagggtcctaggtaccttaccgttcgttaggtacctaggtttcttaagataagtaactaaacgtatttgatagtaatttaggtcgggacgggaagggtacgtacgggtaccgtaccgtacgttacggtacacggacccggtagtcccggtccctaccccggttcgctaccgtccgttcccgtccccgtcccttacgntactaaggtatcgngtacggg

SEQ ID NO: 97453 - DNA, 699 bp, Homo sapiens
  misc_feature: GYAE6OF01CS650.41.25.C03.1.454.CMB.1.raw
  modified_base (215)..(215): a, c, t, g, unknown or other
  misc_feature (215)..(215): n is a, c, g, or t
tcagtctatactatcacgaccggtgctcgatttagtagtgtagatttgggtttgggaagtagtggagcatctccactatggcctgggctcactacttctcaccctcctcgctcactgcacaggttcttgggccctattttatattgacacagccccactctgtgtcggagtcttcggggaagacggtaaccctgtcctgccacccgcagcagcgnagcattggcagcagtctatgtgctagtcggtccagcaggccgcccggctacgttcgtcccgtctacgttcttaatttactgtaagtattttacgaacgtaccgttcccggttcgggttccccttttacggttttcgtcggtccttaccgtacgttaccgtactaccggttccccctacctaaccttccccggtacccttaccccgtttaacccgtaacgttccgttccggttcgggacctttagggaaacgtaggttcggacgggtacgacgggtcttacggacctttacttccgtgttacctagtttctagtacgtaataactaaacgtattagtgtagtaagttagtcgggacggtaacggacgtagggtcgtaccgttcgtacggtcacgtcccgtaaggccttcccggtaccccgtcggttacctaccttcgtccccgttacccgtccccttacgtactacgttagtaactcgtcgtcgg

SEQ ID NO: 97454 - DNA, 636 bp, Homo sapiens
  misc_feature: GYAE6OF01BHF59.41.25.C03.1.454.CMB.1.raw
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagccgcccgggcacgttctcccgtcactcttaatttatagaagtattttacgaacgtaccttcccgttcgggggttccccttttcggttttctggtctccctatccgactacgtcccctcctaacctcccgccccttacccttaccacttactccgtgggccgtgaaagagtggaaggacgaggtctgacttacttctgtctagtcttatagaattataaactattatgtanattaagttgggngggtaggaaccgagggttcgacccgttacgtcgggtacacggacccgaaggtccgttccgacccccgtttcggtaccgtaccttccgtccggttaccccctacccctccgttacctaacttacggtaactacggtacgtacgg

SEQ ID NO: 97455 - DNA, 745 bp, Homo sapiens
  misc_feature: GYAE6OF01DWX4K.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggtccagcgagccgcccggctacgttcctcccgtcactcttaatttatgtaagtattttacgaacgtaccttcccgttcggggtttccccttttcggttttctcggtccttccagtccgactacgttcccctacctaacctcccgtacccttacccttaaccatactcgtcgggctagaaagtaggtaggacgggacgacggtctacgtacttactttcgtcgttctacggttcttaagtagtaattaaactaaacttaattagttgttaagtaagttaagttcgggacgggtaacgggtaccgtaagggttaccgggtaacccgttaccggttaacggttcccgaaaccggtaccccggaaacgggtcccgttaccccgggtacccccccgttacgggttacccttaccccgttaccccggtttcccgtttacccccccggtacccccttaccccgttaccttaacggttaacgtttaacggttaaccgtccggtaaccgggg

SEQ ID NO: 97456 - DNA, 623 bp, Homo sapiens
  misc_feature: GYAE6OF01A7V5A.41.25.C03.1.454.CMB.1.raw
  modified_base (410)..(410): a, c, t, g, unknown or other
  misc_feature (410)..(410): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggttccagcagcgcccgggcacgttctcccgtcactctaatttatgaagtattttcgaagtaccttcccgttcggggttccccttttcgggttttctcggtcctccacttcgactacgtccctaccaacctcccgtcctacccttacacttactcgtcgggctggaagngtgacggacgaggctgactacttctgtctagttcttatgtataataaactaattatgtagtaattaagtgggacggtagggaccgtagggtacgtaccggtcgtaggtcacgacccgtaacggccttaccggcccccgttacgggtcctaacccgttccgttcccgttccccctacccttcccgttacacgttagtaactacgtacgtacggg

SEQ ID NO: 97457 - DNA, 590 bp, Homo sapiens
  misc_feature: GYAE6OF01DIN6M.41.25.C03.1.454.CMB.1.raw
  modified_base (257)..(257): a, c, t, g, unknown or other
  misc_feature (257)..(257): n is a, c, g, or t
  modified_base (382)..(382): a, c, t, g, unknown or other
  misc_feature (382)..(382): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctatcctgcacccgcagcagcggcagcattggcagcagctatgtgcagtgtccagcagcgcccggnagttctcccgtcactctaatttatgaagtattttcgaagtactcccgtggggttcccctttcggttttctggtctccatcgacacgtccctccactccgcctcccttacatactctgggctgagngtgagacgaggctagactacttctgtcagttcttatagataataactaattatgtagtataagttgggcggaacgggtaccgaggggttcgtacccggttccgtagggttaccacgtacccgaacggtcctccggacccccgttcggtacctacttcccgttccgttccccctaccccttcctactaactagttactggtacgtcggg

SEQ ID NO: 97458 - DNA, 729 bp, Homo sapiens
  misc_feature: GYAE6OF01C7TQ9.41.25.C03.1.454.CMB.1.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
  modified_base (272)..(272): a, c, t, g, unknown or other
  misc_feature (272)..(272): n is a, c, g, or t
  modified_base (353)..(353): a, c, t, g, unknown or other
  misc_feature (353)..(353): n is a, c, g, or t
  modified_base (422)..(422): a, c, t, g, unknown or other
  misc_feature (422)..(422): n is a, c, g, or t
tcagtctatactatcacgaccggtgctcgatttagtagtgtagatttgggtttgggaagtagtggagcatctccactatggcctgggctccactacttctccaccctcctcgctcactgcacgtaggttcgttcgggcctattttatattgacacacgcccatctgtgtcggatcgtacggggaacgtaccggtaacctgtcctgccaccgnaggcaggcgcagtcagtggcagcagtctagtgngcgtagtcggtcagcgagccgccggtntacgtcctaccgctactacttattacgagtaacgtttcttacggaacgtccgttccggttcggtttacccgtttcggttcncggttacctctacgtacgtacgtccgtccctacgacctcccgtacctaccgttaacacgtacgttcggnggtacgtaaggagtcgacgtagggacttcggtactagtaaccgtttctacggttctacgttactacgttaagacgtaaattaactaaacttagttataggttacgtaaatagggtaacgggttaccggggaacgttacgggtaccggtaacggttaccgtacggttaacgggtccctaccgggtaaccgaaccggttccgacccccggtacccgttacgggtccttaaaccgttcccgttaacccggtaccccttaccccgttacggtacttaacggtaaccggtttactacggtaacggtacgggg

SEQ ID NO: 97459 - DNA, 852 bp, Homo sapiens
  misc_feature: GYAE6OF01BIOPB.41.25.C03.1.454.CMB.1.raw
  modified_base (227)..(227): a, c, t, g, unknown or other
  misc_feature (227)..(227): n is a, c, g, or t
tcagtctatactatcacgaccggtgctcgatttagtagtgtagatttgggtttgggaagtagtggagcatctccactatggcctgggctccgacctacttctcaccctcctcggctcactgcacaggttcttgggcccatttttatattgacacagccccactctgtgtcggagtcttcggggaagacggtaaccctgtcctgcaccgcagcagcggcagcattgcngcagctatgtcgacaggttcggttaccagtccaggtccgccccggggaactacggttcctaccccggtctaaccgttacttaatttacgtacggtaaacgttacgtttttaccgaaacggtacccttccccgggtttcgggggtttacccccctttttttgggtttttccgtacgggttacccttacccgtaagttcccggtaccgtaacccggttccccctaccgtaaccgttccccgtaccccttaccccgtttaacgactttacgtccggtagggtaccttagggaaacggtagtacggtaaccggaaccggtacgtaccttacggtaaccctttaccgttccgttcgttaccgtacgtttacttaacgtacggtaaattaaacgttaaaccttaagtttacgttacggtaattaaaccggttaaaggttcgggaacggggtacggtaacccggtaacgggttccctaccccggttacggtttacgtacccggaccggtaaccccggtaagggtcccgttccccggtacccccggttcgggtaacctacccgtttcccggtaccttcccccccgggttcctaccgtacggaaccctttaggtaaccgttcggaacgtccggg

SEQ ID NO: 97460 - DNA, 811 bp, Homo sapiens
  misc_feature: GYAE6OF01BFT2Y.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagcccccactctgtgtcggagttcgttcggggaagaccggttaaccctgtccctgccaccccgcagcaggcggcagcattggcagcagctagtgtgcgtaggttcggttaccagaccgacggccccgggtaccccggggcttaaccggtttcccgtccccggttacctaccgttactttaaagttttagtacgtaaggtttacgttttaccggaacggttaccccgtttccccgggttccgggggttttcccccgttttttcggttttccgttcggcccttccacggttcccgaacgtacccgttcccctacccgtaacctcccgtaccccttacccttacctactacgttcgtcgggtactaggaaacgtggtaggaacggacggtacgtccgtaaggttaccctttacgtttctacgttacttacgttacttaagtaagtaacttaaacgttaaacttaatttgtagtttacgtaagttaacggttacgggaacgggtaacggtaccggttacgggaccgttaccggtaccggtacgtaccggacgtaccccggtaagtcccggtacccggtacccccgtcgtaccctacccgttccgttccccggttcccccggacccttacgtaacgttacgtactaccggttcgacgggtaccgg

SEQ ID NO: 97461 - DNA, 636 bp, Homo sapiens
  misc_feature: GYAE6OF01BI4L7.41.25.C03.1.454.CMB.1.raw
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (628)..(628): a, c, t, g, unknown or other
  misc_feature (628)..(628): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccactctgtgtcggagtcttcggggaagacggtaaccctgtcctgcacccgcagcagcggcagcagttggcagcagctatgtgcagtggttccagcagccggcccgggntacgttcctcccgtcactcttaatttatagaagtntttacgaacgtccgttcccggttcggggttccccgttttggtttctcggtcctccacgtcgactaccgtccctaccacctcccgccttccctactatctcgtggctagaagtgtaggacggacgtagctagtaccttactcgtgtctacgttacttatacgtaattaactaaattaagtttagtaggttaataagttaggttcgggaacgggtaacgggtacgtacgggtctaacccggtctaacgggcacgtacccgagtcctacccgtccccgtagtcctacgttccgttcccctccccgtaccctcgtcaacgttagacgtaccgngtaccggg

SEQ ID NO: 97462 - DNA, 593 bp, Homo sapiens
  misc_feature: GYAE6OF01EEM9T.41.25.C03.1.454.CMB.1.raw
  modified_base (474)..(474): a, c, t, g, unknown or other
  misc_feature (474)..(474): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccggcagttctcccgtcactctaatttatgaagtattttcgagacctcccgttcgggtccccttttcggtttctggtctccatcgactacgtccctccaacctcccgtcctccctaccactatcgtgggctgaacgagtgaggacgaggctgactacttctgtctagtcttatgtaataataaactaattagtagtagagtaagttgggcggagggaccngggtcgtaaccgttccgtaaggtcacgcccgaaggtcccgtcgccccccgtcggtccctacttcccgtccgttacccctacccttacctctaaagttaacgtctaacggtacgtacggg

SEQ ID NO: 97463 - DNA, 826 bp, Homo sapiens
  misc_feature: GYAE6OF01EZ3X5.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacacgccccactctgtgtcggagtcgttcggggaagacggttaaccctgtcctgccacccgcagcagcggcagctattggcagcagtctatgtgctagttcggttccagcacgccgcccgggactacgttcctcccgtcacttacttaatttacgtagtaagttacgttttacgaacgtacccgttcccggttccggggtttccccgttttcggttttcgtcggtccttaccgtactccggtaacctaccgtcccctaccctaacccgtccccgtaccccttacccttacctaacttacgtcgtacgggccgtaaggtaacgtaggtacggaacggacggtacgggtactacgtacctttaccgttcgtcgtttacctaaggtttaccttaagtacggtaaacttttaaaactaaaaccgttaagttttaacgtaggttaataaggtttaaacggttcgggggaaacgggtaaccggggtaaccgtaaccgggggtacccgttaacccggtttaccggttaaaggtccccggaaacggtaccccgtaaggccccgtttaccccggacccccggtttaccgggtacccttaaccgttccccggttaccccggtttcccccgtaccccttacccgttaacgtacggttaaaacgttcgttaaaaccgtggtaacccggg

SEQ ID NO: 97464 - DNA, 822 bp, Homo sapiens
  misc_feature: GYAE6OF01BCW6T.41.25.C03.1.454.CMB.1.raw
  modified_base (214)..(214): a, c, t, g, unknown or other
  misc_feature (214)..(214): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttcgggccctattttatattgacacacgccccatctgtggtcggagtcgttacggggaagaccggtaaccctgtcctagccacccgngagccaggcggcagctagttggcaggcagtctatggtcgacgtaggtcggtccgagaccgccgggcccggcccggggtcttaccgttcccgtccccgtactaaccttactttaatttagtagtaagtttacgttttaccgaacgtacccgtttccccggttaccggggtttccccgtttttcgggtttccgtcggtaccttccctacggtaccggtacccttcccgtacccctacccggtacccgtaccccgttaccccttaccctaactaccgtttcgtccggggttagaacggtaacggtaggtaccggtaacgggacggtaccggtaccgttagttacccggttacttccggttacgttacggtactttacgttacgtataaacgttaaataacttaacgttagttagtacgtttaagtaacggtacggggtcggaacgggtacgtacgggttacgtacccggtttacggtaccgacgtccggacgaccgttaccggtcccgtaccccgttccgtacccgggtacttacccccgttcggttccccccaaccccggttattccgtaaaacgttacgttaaccggttacgtaggtcccggggtaggg

SEQ ID NO: 97465 - DNA, 882 bp, Homo sapiens
  misc_feature: GYAE6OF01EFRZG.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttctgggcccattttatattgacacacgccccactctgtgtcggagtcgttcggggaagacggtaaccctgtcctgcacccgcagcaggcggcagcagttggcagcagctagtgtgctaggttcggttccagcgacggccggcccgggactacggttcctcccgtcacttacttaatttataggaacgtttactttacgaacgtaccgttcccggttcggggtttccccgtttttacggttttcgtcggtccttacctacgttccgtaaccgtacccgttacccctacccgtaacctccccgtacccctttaccccgttaaccaacgttacttccggttacgggtacgtaacggaacgggtacgggtagggaacgggtaacgggtacggtaccgttaccggttaacttttacccgtttacgttacggtttaccgttaacgttacttttaacggttagtaaactttaaaacttaaaaccgtttagtttaaaacggttggttaaagtttaaacggtttaaggggtttccggggaacgggggtaaccgggtaaccggggttagggttaccccgggtacccgttaacgggttacgaaccccggttacggaccccgggtacggtttccccgtaccccggttccccggttaccgggtccctttacccgttacccggtttccccccgggtttaccccccgtaccccctttaacccttacggttaaaccggttaaggtttacctaacggggtccggttacgggggg

SEQ ID NO: 97466 - DNA, 879 bp, Homo sapiens
  misc_feature: GYAE6OF01APE9B.41.25.C03.1.454.CMB.1.raw
  modified_base (207)..(207): a, c, t, g, unknown or other
  misc_feature (207)..(207): n is a, c, g, or t
  modified_base (272)..(272): a, c, t, g, unknown or other
  misc_feature (272)..(272): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcgttcggggaagacgtaaccctgtcctgcacccgnagcagcgcagcagttggcagcagctagtgtcgctaggtcggttccagcgacggcccggcccgggntacgttcctcccgtctactacttaatttagtagtaaagttacttttacggaacgtaccgttccccggttcggggtttcccccttttgggttttcctcgggtccctccgtagtccgtacctaccgtccccctacctacccgttccccgtccccttacccgttaccacgttacgtccggtacggtccttaagggaaacggtacggtacgggtaacgggaaccggtacggtaccgttacggtaaccctttacgtttccgtacggttacttacggttactttagttaagtaaacttaaagtaaaacgttaatttacggttagtaggttaaacggtttaacgggtcgggggtaaccgggtaaccggggtaacccgggtaacgggggttaccccgtaacccgggtttcggttaaaccgggtccgtaaacccgggtaaccccggtaacggttcccgtaccccccgggttaccccggtttccgggttaaccccttaccccggtttccccgtttaccccccggtttaacccccccgttacccccggttttaacccttaacccggtttaacgtttaacccgggttaacccttaaacggggtaccgttaacccggggg

SEQ ID NO: 97467 - DNA, 571 bp, Homo sapiens
  misc_feature: GYAE6OF01CJSZC.41.25.C03.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
  modified_base (490)..(490): a, c, t, g, unknown or other
  misc_feature (490)..(490): n is a, c, g, or t
  modified_base (523)..(523): a, c, t, g, unknown or other
  misc_feature (523)..(523): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccatctgtgtcggagtcgttcggggaagacggtaaccctgtcctgccaccgcagcagcgcngcagtggcancagctatgtgcagtcgtcagcagccgccggcagttctccgtcactctaatttangtatagtttcgaagtaccgttcccgtcgggttcccttttcggtttcgtcggtctcgactcgacnctcctccaacctccgacctcctactatctcgtggtctaggagtagtggaggacgaggctacgtacttactcgtgtcagttactatgaatataactattagtgtagtataggtgacggacggacgcgggtacgtcgttacgacgtacncgtaccggagtccgtaccgtccccgtgtccctnttcccgtccttcccctacctacctacgacttagacgttacgtgtcggg

SEQ ID NO: 97468 - DNA, 913 bp, Homo sapiens
  misc_feature: GYAE6OF01C09U8.41.25.C03.1.454.CMB.1.raw
  modified_base (222)..(222): a, c, t, g, unknown or other
  misc_feature (222)..(222): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttggccctattttatattgacacacgcccccacttctgtgtcggagtcgttcggggaagaccggtaccctgtccctgccacccgcagcagccggnagctagttggcagcagtctatcgtgcaggttcggttccaggcacggcccggacccgggctacgtttcccctcccgtacaacttactttaaatttagtacggtaagttacttttaccggaaacgttacccgttcccccgggtttacgggggttttcccccccttttttacggggtttttccgtcggtcccttacccgtaacgttacccggtaacccttaccgggtttacccccccttaccgtaaaccccctttcccccggtacccccccttttacccccgtttaaacccaatttaccgttccggtacgggtacccttaagggaacggttaagggtaccgggaacgggtaaccggtacgggtacttaaccggtaaccctttaccgtttcgttaacggttaccgtaacgttttaactttacgtaaacgttaacttaaaacttaaaaacgtttaagttttacgtaggtttaggtaaagtttaaacgggttcggggaaccggggtttaaccggaaccgggttacgggttaccggtacccgttaccggtacggtaccgtaccggacccgtaaccgggtccgttaccccccggaccccgttaccggtaacccttcccgtttacccgttcccccgggtttccccccaaccgtttcccgaacccgttaagttaccggaaacgttccggtacggtaccggg

SEQ ID NO: 97469 - DNA, 793 bp, Homo sapiens
  misc_feature: GYAE6OF01EIFNX.41.25.C03.1.454.CMB.1.raw
  modified_base (184)..(184): a, c, t, g, unknown or other
  misc_feature (184)..(184): n is a, c, g, or t
  modified_base (219)..(219): a, c, t, g, unknown or other
  misc_feature (219)..(219): n is a, c, g, or t
  modified_base (565)..(565): a, c, t, g, unknown or other
  misc_feature (565)..(565): n is a, c, g, or t
  modified_base (777)..(777): a, c, t, g, unknown or other
  misc_feature (777)..(777): n is a, c, g, or t
  modified_base (786)..(786): a, c, t, g, unknown or other
  misc_feature (786)..(786): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccatctgtgtcggagtcgttacggggaanaccggtaaccctgtcctgccaccgcagcagccggnacgctagtggacagcagctagtgtcgactaggttcggtaccagacgaggcccggacccgggctacggttccgtacccgtactacgttacttaagtttagtacgtaacggtttacgttttacgaacgttacccgttccccggttaccggggttttccccttttcgggttttactccggtacctttaccgaacgttccgaaccttaccgtacccccgtaccttaacccgtcccggtacccctttacccttaacggtacttacgtaccggtccgggtaccttaggaaaacgggtacgttacgggaaccggtaaccgggtacgtaccgtttacggaacctttaaccggtnttaccgggttactaacggtttccttaaagtacgtaaacgttaaagttaaacctaagttagtacggttaagtaagtttaacgttacgggacgggaacgggttaccgtacggggtactaaccgggtcctaaggtcccaggcccgtaagtccgtaccctccccgtacggtactacgttccgcccgttccccgacccttcgtagtactaacggttntaccgggtntacgggg

SEQ ID NO: 97470 - DNA, 697 bp, Homo sapiens
  misc_feature: GYAE6OF01A50QW.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccactctgtgtcggagtcttcggggaagacggtaaccctgtcctgccacccgcagcagcggcagcattggcagcagctatgtgcagtggttccagcagccgcccgggctagttcctcccgtcactccttaatttatgtaagtacttttacggaacgtaccgttcccgttcggggttcccccttttggttttctcggtcctcctagtccgactacgttcccctacctaaccgtcccgtccccttacccgttaccacgttactccgtcgggtcttaggaaagtacggtaggacgggtacggaagggtccttacggtaaccttaccgtttcgttacgtccgttaaggtttcctttagtacgtaacttaacgtaaaacttatttagtacgttagtaagtttaacggtgggacgggaaggaaccgtgggtacgtacccgttcgtaaggtccaacggcccgaacggtcctcccggccccgttcggtaccctccttaccgttcccgttcccctacccgtctaccgtaattacgtagtacgtcgtacggg

SEQ ID NO: 97471 - DNA, 749 bp, Homo sapiens
  misc_feature: GYAE6OF01CXVBM.41.25.C03.1.454.CMB.1.raw
  modified_base (299)..(299): a, c, t, g, unknown or other
  misc_feature (299)..(299): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacacgccccacttctgtgtcggagtcgttcggggaagacggtaaccctgtcctgcacccgcagcagcggcagcattggcagcagctatgtgcagtggtccagcacggccgccggctacgtttccctcccgtcaacttacttaatttaagngtaagttacttttaccggaacgtaccttccccggttcggggttttccccctttttgggttttctacggtccctacctagtaccgtacaccgttccccaccgtaaccgtcccgtccttacccttacgattacgtgtcggcttaggagtaggtggaggacgtaggctacgtacttcttctagtctagttcttaatagtaacttaaacgtaaacttaattttacgtgttaacgtaagtttaacggttgggggaaccgggtacggggaaccgtagggggttaacccgtacccggtttacggtaacggtacccgacgtaaccccggtaaggtccccgtacccggtccccccggttaggttccccttacccgtttcccgtttacccggttccccccctaacccttttcccggtaaacttacgttaacggttaccgtaacgtacccggttaacgggg

SEQ ID NO: 97472 - DNA, 904 bp, Homo sapiens
  misc_feature: GYAE6OF01BYVPW.41.25.C03.1.454.CMB.1.raw
  modified_base (212)..(212): a, c, t, g, unknown or other
  misc_feature (212)..(212): n is a, c, g, or t
  modified_base (245)..(245): a, c, t, g, unknown or other
  misc_feature (245)..(245): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctatttttatattgacacagcccccatctgtgtcggagttcgttcggggaagaccggtaaccctgtcctgccacccgnagcagcgcagcagttggcagcagctagtgtcgntaggttcgtccagcagcccggcccggctacgttcctcccgtctaaccttacttaatttagacgtaagttacgttttaccggaacggttacccgttccccggtttccggggtttcccccttttttcgggttttccgtcgggttacccttccgtaaccgttaccgggtaacctacccggttaccccctaccgtaaacccgttccccggtaccccttaccccgttaacctaacgttacgttccggttacgggtactaacgggtaaacgtacgggttaggaaacgggtaccgggaccggttacgttaaccggttaccctttaacgtttcgtacggttaccgttaacggtttacctttaagaaacggtttaaactttaaaaccgtttaaaagttaacctttttaaggtaggttaaagttaaaccggttttaagggtacccgggggaacggggttaaaccgggaaccgggttaaggggttaccccgtaacccggtttaccggtaacggttaaccggacccgttaacccggtaaccggtcccgttaaccccggtcccccggttacggttaccccgttaccgtttcccgttacccccggttacccccgtacccccgtttactaaaccggttacggtttaaccgttagtacccggcgttaaccggggg

SEQ ID NO: 97473 - DNA, 805 bp, Homo sapiens
  misc_feature: GYAE6OF01BRSCP.41.25.C03.1.454.CMB.1.raw
  modified_base (277)..(277): a, c, t, g, unknown or other
  misc_feature (277)..(277): n is a, c, g, or t
  modified_base (363)..(363): a, c, t, g, unknown or other
  misc_feature (363)..(363): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggaccatttttatacttgacacagccccactctgtgtcggatcgttcggggaagaccggtaacctgtcctgcaccgcagcagcggcagcattggcaggcagctatgtcactagtcggttccagcaggtccgccgggactacggttcncccgtactactacgttaaatttacgagtaagtagttttaccggaacgtaccttccccggttggggtttacccctttttcggtttcncgggtacctacgtacttcgacgtacgttcccctacctaaccgttcccgacccttcccgttaacacgttacgttccggtcggtacttaggaaaggtaacgttgggtaacgggacgtacggtacgttacggtaacctttaccgttacgttcggtactttaacggtacctttaagtaacgtaaacttaaaacgtaaaacgttaaacgttaagtgtaagttaacggttaagtttaccgggggacgggtaaacggggaccgttaacgggggtccgtaacccggttaccgttaacggtaaccgaacggtaaccccgtaacgggtaccctacccggtaacccccggttacggtttaaccctaacccgttccggtttaaccccggtacccccttaacccgttaaccgttaactaacggttaaacgttaccgtaaacggtcggtaaacggg

SEQ ID NO: 97474 - DNA, 787 bp, Homo sapiens
  misc_feature: GYAE6OF01CT0PM.41.25.C03.1.454.CMB.1.raw
  modified_base (232)..(232): a, c, t, g, unknown or other
  misc_feature (232)..(232): n is a, c, g, or t
tcagtctatactatcacgaccggtgctcgatttagtagtgtagatttgggtttgggaagtagtggagcatctccactatggcctgggctccactacttctcaccctcctcgctcactgcactaggttcttgggccctatttttatattcgacactacgcccccactctggtagtcggaggttccgtttacgggggaaagaccggttaaccctggtccctaggccaaccccgnacggcacggcggcaagcctagttcgggacagtcaggctagtgtgacgaggttcggttccagccgagtcccgggccgggtcctacggtttccctccccgttctaccgttactttaaagtttatacggtaaacttagttttaccggaacgttacccgtccccggtttccggggtttccccgttttcgggtttttccgtcggtccttaccgtacgtacgaccctaccgtttcccctacgtaaccccgttcccgtaccccttccccgttaactactacgttcggtcgggtactaggaaggtacggtaggtacggacgtaggtcctagtaccgttcgtttcgttcgttcgtacgtttattacgaagttacgtaaactaaattaacgttaatggtaacttaagttaggtacgggtacgggtaacggacggtacggttccgaccgttacgtacgtccgtacggaccgttaccgtccgtccgttccccggttagtccgttcccgttccgtcccgttaccccgttccccgttacctacgtactaacgtcgtaggtcgtaccggg

SEQ ID NO: 97475 - DNA, 786 bp, Homo sapiens
  misc_feature: GYAE6OF01B2M3T.41.25.C03.1.454.CMB.1.raw
  modified_base (698)..(698): a, c, t, g, unknown or other
  misc_feature (698)..(698): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacacgccccactctgtgtcggagtcgttacggggaagaccggtaaccctgtcctgccaccgcagcaggcggcagctagttggcagcagtctagtgtgcgtaggtcggttccaggcgtacggccggtcccgggttacgttcccgtaccgtacctacttactttaaagtttagtacgtaagttacgttttacgaaacgtcccgttccccggtttccggggtttacccccgtttttcggttttccgtacggtcccttaccgtacgtaccggtaacccgtaccggtttacccccgtaccctaaccgtcccccgtaccctttaccccgttaactacggttaacctcggtcggtaaccgtaggtaagcggtacggtacggacgacggtctacgtacgttacgtttcgtacggtcacgtttacttaagtaagtaacttaaataaacgtattagtacggtaataagtaacgggttgggacggtaacgggaccgtaaggtcccgtaccgtacgtacggttacgacccgtaacggccgttcgacccgtcccccggttanacccgttacgttcccgttacccgtacccccgtaccccgttataaccggttaactaccgttaaacgtacgggtaccgtggggacccggg

SEQ ID NO: 97476 - DNA, 848 bp, Homo sapiens
  misc_feature: GYAE6OF01ESEOM.41.25.C03.1.454.CMB.1.raw
  modified_base (240)..(240): a, c, t, g, unknown or other
  misc_feature (240)..(240): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctatttttatattgacacacgccccactctgtgtcggagtcgttcggggaagacggtaaccctgtcctgcacccgcagcagcggcagcattggcagcagctatgtncaggtggttccagcacgccggcccgggctacgttcctcccgtcactacttaatttacgtagtaagtagttttaccgaacgtaccctcccgggtttccggggttcccctttttccgggttttcctacggtccttcccattccgaccgtaccgttcccctacccaaccgttccccgtccccttaccccttaaccctattaccgttccgtacgggggtacctaaggtaaacggtacggtacgggtaagggaaccggtacgggtaccgtttacggtaacccttttccgtttacccgttcggttaccgttaacggtttaccgttttaacggtagttaaactttaaaacttaaaaacgttaaacgttttaagtttaggttaaggttaaacgtttttaagggtcggggtaacggggtaccgggggtaaaccgggtacgggggttaccgtacccggtttaacggtacgggttaacccgaccgggtaacccgaacgggttccccggccccggttaccccccggttacggtacccgttaccttacccccgtttccccgttaaccccccgtccccttaccccgttataacggttaaagtacggtacgtacggtaccggg

SEQ ID NO: 97477 - DNA, 808 bp, Homo sapiens
  misc_feature: GYAE6OF01CXWF4.41.25.C03.1.454.CMB.1.raw
tcagtctatactatcacgaccggtgctcgatttagtagtgtagatttgggtttgggaagtagtggagcatctccactatggcctgggctccactacttctccaccctcctcgctcactgcacaggttcttcgggccctattttatattgacacacgccccactctgtgtcggagttcgttcggggaagtaccggttaaccctgtcctgcccacccgcacgcgacggcggacacgcgtagttcggcgagcaagctagtggtcgacgtaggttcggttaccaggcgacggcccggccgggacgtcgtttcccgtccgttacctaacctacgtttaattagtagtaagtttacgttttacgaacgttacccgttcccggttccgggttttcccttttggttccgtcggtcctacgtaccgtcggtacctaccgtccctacctaacccctcccgtacccttacccttaacaacttcgttacgtcggtagtaacggtaagtaggtaacgggaacgtacggacgttcgtagtacctttcgtacgttacgtacgttaagtttctaagtaactaagttaaacttaaacgttaagttaacgttagtaaggtttaaagttagggtaccgggaacggtaccgggaaccggtcgggtaaacgttccccggttacggtaacggaaccgttcccgggaaacccgtaggtcccccgtaccccgggttacccggtaccggtacccgttaaccgttcccggtcccctttaccccgtcccttaacccgtcttaaacgggtattaaaccggtcggttaaggaccggg

SEQ ID NO: 97478 - DNA, 651 bp, Homo sapiens
  misc_feature: GYAE6OF01CGYBB.41.25.C03.1.454.CMB.1.raw
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (416)..(416): a, c, t, g, unknown or other
  misc_feature (416)..(416): n is a, c, g, or t
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
  modified_base (635)..(635): a, c, t, g, unknown or other
  misc_feature (635)..(635): n is a, c, g, or t
  modified_base (641)..(641): a, c, t, g, unknown or other
  misc_feature (641)..(641): n is a, c, g, or t
tcagtctatactatcacgaccggtgctcgatttagtagtgtagatttgggtttgggaagtagtggagcatctccactatggcctgggctccactacttctcaccctccgtcgctcacgtgacacaggtttccttcgggccctatttttatatttgaactagacgccccattcgtggtacgtcggagttcgttcgggggaagtaccggtaacccttggtcctgcccacccgnagcaggcgcagctagttggcagcagtcttancggtnactaggtgtccagcaggccgtccgggntacgttcnccgtctacgtcttaaagttgagtaactgtttacgaacgcctccggttggttcccctttgggtttntcggctacgagccncgtacttcccgccaactcccgtacttaccttacgnttacgtctaggtacgcgtataaagggtcgtagacgggacgttaggacctggtaacttcgtccgtagtacctaggtttactagtataacttaaacggtaaattattagtatacgttaagtaagtcgggagtaacgacggtagtaccgtacgtacgtacgtnaccgganaccggctacccgccgtaaccgtcggtccctgttccgtacccctcgtaacctnaagttntacgtagtcg

SEQ ID NO: 97479 - DNA, 863 bp, Homo sapiens
  misc_feature: GYAE6OF01EB3F0.41.25.C03.1.454.CMB.1.raw
  modified_base (216)..(216): a, c, t, g, unknown or other
  misc_feature (216)..(216): n is a, c, g, or t
tcagtctatactatcacgaccggtgctcgatttagtagtgtagatttgggtttgggaagtagtggagcatctccactatggcctgggctccactacttctccaccctcctcgctcactgcacaggttcttgggccctatttttatattgacacagcccccattctgtgtcggagttcgttcggggaagtaaccggtaacccttgtcctgccacccncacgcaggcgcaggctatggacagcagtctatgtcgactggttacggtccaggcgacggccggcccgggtactacggttcccgccccgtataacctttacttaatttagaggtaacgtttagtttaccgaacgttacccgttccccgggtttaccggggttttcccccgtttttacgggttttcctacgggtccctttaccgacgtaacccgtaccttaccccggttcccctaacccctaacccgttccccgttacccccttaccgtttaacctacgttcgttacccggttcgggtactacgggtaacggtacggttacggggaacggtaaccggtacggttaccttacggtacccttttacgttaccgttcggtactttaggttttaccttaaggtaagtttaaaaccttaaacgttaaacttcgttttaacggttgttaaacgtttaacggtttaacggggttacgggggacggtaaaccgggtccggttaacgggtaccgtttacccgggtacggttacgtacccgacggtacccgtcggtaccccgttcccgggtaaccccgttcggtacccttaaccggttcccgttacccgtacccccgtacccgttcgtaactaacggttagtgttacgtccggtacggg

SEQ ID NO: 97480 - DNA, 715 bp, Homo sapiens
  misc_feature: GYAE6OF01BE8NG.41.25.C03.1.454.CMB.1.raw
  modified_base (251)..(251): a, c, t, g, unknown or other
  misc_feature (251)..(251): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttcgggccctattttatattgacacagcccccactcctgtgtcggagtcgttcggggaagtaccggtaaccctgtacctgccacccgcagcagccggcagctagttgcgagctagtctatgtcncgtagttcgttaccagccaggccgccggcttacgtcctcccgtactaccgtacttattatagtattacgtttacgactaccgttccggtccggtttacccttttggtttcgtcgtctcgtactccgactccttccctacctaccgtcctcccgttacccttaccgtacttactcggtcggtactacggtaacgaaggttcggaaggacggtacgtcgtacgttaacgttactttcgtacgtagttaaccttcgttataacgtaaacttaacctaaaggttactttagagtaagtttagtacgggttagggtaccgggtaggtaaccggtacgggaccgttaccgtaccggttaacgccgtaccgaacccggtcgaccccgtttaccggcccccgttaacgtccgtaccgttcccgtaccctccccgtaccctcgtacgtaactggttacaccgttggtaccggg

SEQ ID NO: 97481 - DNA, 888 bp, Homo sapiens
  misc_feature: GYAE6OF01CCF91.41.25.C03.1.454.CMB.1.raw
  modified_base (143)..(143): a, c, t, g, unknown or other
  misc_feature (143)..(143): n is a, c, g, or t
tcagtctatactatcacgaccggtgctcgatttagtagtgtagatttgggtttgggagtagtggagcatctcactatggcgtgggctccactacttctcaccctctcgctcactgcactaggttcgttcggccctatttttanagttgacacgacggtcccctatcgtgtggtcggtaagttcggttacgggggaaacgtaccggttaacccctggttccgtcgacctaccccggctaaggccgaacggcgggtacctaagccgtagttagggaccaggtccgaagcctttacgtcggtagcccgtagggttacccggttacgaaccggcttaccggggcccgtccccggggtattacccgggttcccttaccccggtactaacgtttaaccgttaatttccgaaggttaaggttaccgtttaacggaaccggttccccgttcccggggtttccggggttttcccccgttttgggttttccgtacggtcccttaaccgggtacgttacccgtacccggttacccttacccccgtaacgttacccgtccccgttaccccgtttccgtaaaccggggttcttaccgtccgggttaacggggaccctttaaaagggaccgggttttacgggtaacggggaccgggttagggtaccggttaccttaccggttactttaaccgttcgttacttcgtacgtttagttactaagtaaactaataacgttaattacggtataagtagttaggccgggtaacggtcgggaacgtggtccgtacggttaccgtacggtcgtaccgacggtccggttatccccgggtccggtctccgttaccgtcccgttccgtaccctccggttacctacgtacgttagtaacgtcggtaacgtcggg

SEQ ID NO: 97482 - DNA, 873 bp, Homo sapiens
  misc_feature: GYAE6OF01ADUML.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttctgggcccatttttatattgacacagccccactctgtgtcggagtcgttcgggggaagaccgggtaaccctgtcctgccacccgcacgcaggcggcagctagttggcagcagctagtgtgctaggtcggttccagcacggccggcccgggctacgttcctcccgtcactttaccgttaatttagtagtaacgttacttttacggaacggtacccttcccggtttaccggggttttcccccgtttttcgggtttttccgtcggtccttccagttaccgaccgtaccgttcccctacccgtaaccgtccccgtacccccttaccccttactaacgttcttccggtgggtacctaggtaaacggtacggtacggaagggtaccgggacgggtacctacggtaccgtttacgttccgttaggttaccgtaagtttacttttaacgtagtttaaacttaaaccttaaaaacttaacgttaggttacgttaggttaacggttaaggtttaccgggggacgggtaacggggtaccgtacggggggtaccgttcccggttaaccggttcgggaaccccgtacccgggtaaccggtacccgggtccccggttccccccgggttaaccccgtaccgggtttaccccggttaacccgttttcccccgggtttcccgttacccccccgggttcccctttaccccggttaactttaacgggttaacccgtttaacgggttaaccgtcgggttacccgggg

SEQ ID NO: 97483 - DNA, 864 bp, Homo sapiens
  misc_feature: GYAE6OF01A61QV.41.25.C03.1.454.CMB.1.raw
  modified_base (237)..(237): a, c, t, g, unknown or other
  misc_feature (237)..(237): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcgagcaggcggcacgcagttggcagcagctangtgcgagttggtccagcagcggcccgggctacgttcctcccgtctaccttcgttaatttagtagaacgtattttacgaagtacccgttcccggttccggggtttcccccgttttcgggttttcctcgggtccttacccgtacgtaccgacgttaccggtccccttaccccgaaaccgttccccggtccctttaaccccgtttacctaacgttacctttccggtacgggtaccgtcgaaacggtaggttacggaacgggtacggaacgggtccttacggtaacctttaccgttcgtagttaccgttacgtttccgttaatacgttaaacgtaattaaaccgttaatttagtcggtttaagtaacgtttaaaggtccgggggtaacgggaagggttaacccggtacggggtttacccggttaaccccgggttaccggttttaaccgggacggtaccccgtaaccccggttaaacgggcccgttaaccccgggcccccccgttttacggggtaaccgttcccccggttaacccggttccccggtttacccccccggccccccgtttaaccccggttaactacccgggtttaaaaccgtttaacgttaccggtaacccggttaaccggggg

SEQ ID NO: 97484 - DNA, 855 bp, Homo sapiens
  misc_feature: GYAE6OF01BTEJA.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacacgccccactctgtgtcggagttcgttcggggaagacggtaaccctgtcctgccacccgcagcgaggcggcagctagttggcagcaagtctatggtgcaggtcgttccagcgaggccggccgggctacgttcctcccgttctacttacgttaatttcagtaagttagttttacggaacgttacccgttcccggttcgggggtttcccccgtttttcgggttttccgtcgggtcctacccgtacgttcggaacccttaaccggttcccctaacccctaacccgtttcccccggtacccctttaccccctttaacccgtaacgttaccgtacggttcggggtcgtaacgggtaaacgggaggggttaccgggggaaccggtacgggtaccgttcgtaaccgtttaccttccgttcgttactacgtttcccttaagttaacgtaacgtttaaaacaaaaccgtttaaagttttactcgggttaagtaagtttaacgggtttcccggggaagggggaaccgggttacggtaaccggggttaccgaaccggtttccgtaacggtaccggtaccgtaaccccgtacgggttcccgaccccggttcccggttaccggtacctttaccggttccccgtttacccggtcccccccgttacccgtccgtttaaccgtagtttaaccgtaagttcccggtaacgttgggtccggg

SEQ ID NO: 97485 - DNA, 814 bp, Homo sapiens
  misc_feature: GYAE6OF01AGBBA.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacacgcccccactctgtgtcggagttcgttcgggggaagaccggtaaccctgtcctgccacccgcacgcaggccggcagcagttggcagcagctagtggtgtcgtaggttcggttccaacggccgaccgggcccgggccccggggtcctaccggtttccctccccgtacctaacctttacttaactttagtaggtaattacgttttaccgaacgtaccgttccccggttccgggttttccccgtttttcggttttccgtcggtcctaccgtcgtaccgacctacccgttacccctaccccgtaaccctccccgttaccccttacccctttaacctaacttacgttcccggtcgggtacgtaacggtaaacgggtagggttacggggaacgggtccgggtaacggtccttaaccggttaacctttacttttcgttcgttaccttacggttactttaataacggtttaaataacttaaaacgttaacgtttagtacggttaataagtttacgggtccgggacgggtaccggacgggttacggtaccggtaccgtacggttacgccgtaaccggaccgtaccggcctacccggcccggttcgtcctaccgttcccgttcccggtccccctcccgttacgtccgtaagttatacggttcgagtccgggg

SEQ ID NO: 97486 - DNA, 678 bp, Homo sapiens
  misc_feature: GYAE6OF01BSLGO.41.25.C03.1.454.CMB.1.raw
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
tcagtctatactatcacgaccggtgctcgatttagtagtgtagatttgggtttgggaagtagtggagcatctccactatggcctgggctccgactacttctcaccctcctcgctcactgcacaggttcttgggccctattttatattgacacagccccactctggtgtcggagtcgttcggggaagacggtaacctgtcctgcacccgnagcagcggcagcagttggcagcagctatgtgcagtggtccagcagcgccgggnaggttctcccgtcactctaattatgaagtattttcgaacgtacctcccgttcggggttccccttttggttttctggtcctccatccgactcgtccctacactccgtcctcccttacactactcgtcgggctagagtgtgaggacgacggctgtaccttacttcgtcgtcgtagttcttagtagtattaactaaactaatttacgtagttacgtaattaacggttgggacgggaagggtaccggtaaggggttaccggtacccggttaccggttaacgggtacccgtaccggtaccgtaacgggtccttacccggtacccccgttcgggttaaccctaccgtttacccggttccccgttaccccctaccccgttacgtaccgttaagttaaccgttataaccgggtaaccgtcgggg

SEQ ID NO: 97487 - DNA, 799 bp, Homo sapiens
  misc_feature: GYAE6OF01ADOFD.41.25.C03.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (461)..(461): a, c, t, g, unknown or other
  misc_feature (461)..(461): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttcgggccctatttttatattgacacacgccccactctgtcgtcggagtcgttacgggggaagaccggtaaccctgtacctgccacccgcagcaggcggcagcattggcngcagtctatgtncgaggttcggtccagccaggcccggcccgggatacgttcccgtcccgtactaacttctttaaattacggtaggtaaagttacgttttaccggaaacgttcccgttcccgggtttacccggggttttcccctttttcgggtttccgtacggtccgtacctacgtaccgtacctaccgtacccctactaccctcccgtacccttccctaacgtnttaccgttcgccgggtattacggaaacggtaggtaggaacgggacggtacggcgtaccgtaccgttctttcgtacgtcgtattacgtagtacgttaataaagtaaactttaaagtcgttaacggtaagtaaggtttaacggtacgggggtccgggtaaacggggttacccgggtaaacgggttccgggtaaacccgggtttacccgttaacgggttaacccgacccgttaaccggacggttacccgttcccccggtaccccgttccgggtacctaccgttccccgttcccgttaccccctccgttactaacgttactaagtacgtacgtgtaccgggg

SEQ ID NO: 97488 - DNA, 240 bp, Homo sapiens
  misc_feature: GYAE6OF02IU91I.41.25.C03.1.454.CMB.1.raw
  modified_base (238)..(240): a, c, t, g, unknown or other
  misc_feature (238)..(240): n is a, c, g, or t
tcagtctatactatcacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctggtctgcctggtcaaggactacttccacgtctactgctgagcgggctggcaaggcgcatagnnn

SEQ ID NO: 97489 - DNA, 527 bp, Homo sapiens
  misc_feature: GYAE6OF02I7251.41.25.C03.1.454.CMB.1.raw
  modified_base (435)..(435): a, c, t, g, unknown or other
  misc_feature (435)..(435): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactcccgcctcccttaccatatctgggctgaagagtgaggacgaggctgactacttctgtcagtcttatgatataaacaattatgtnataattggcggaggaccagggtgaccgtctaggtcagcccaaggctgcccctggtcactctcgttcccacctcctcatagtatacgactcgg

SEQ ID NO: 97490 - DNA, 530 bp, Homo sapiens
  misc_feature: GYAE6OF02IDG1C.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctcaactccgcctcccttacatatctggctgaagagtgaggacgaggctgactacttctgtcagtcttatgataataaactaattatgtagataattggcggtagggacctagggtgaccgtcctaggtcagcccagctcgcccctcgtcacctctcgtcccgccctcctcactagtactagatcgg

SEQ ID NO: 97491 - DNA, 252 bp, Homo sapiens
  misc_feature: GYAE6OF02HQL4O.41.25.C03.1.454.CMB.1.raw
  modified_base (239)..(252): a, c, t, g, unknown or other
  misc_feature (239)..(252): n is a, c, g, or t
tcagtctatactatcacgaccggtgctcgatttagtagtgtagatttgggtttgggtgcccaagctgctggagggcacggtcaccacggtcaccgtctcctcagcttccaccaagggcccatcggtcttcccctggcgccctgctccaggagcacctctgggggcacagcggccctgggcctgcctggtcaaggctacttccacgtctactgcctgagcgggctggcaaggcgcatagnnnnnnnnnnnnnn

SEQ ID NO: 97492 - DNA, 526 bp, Homo sapiens
  misc_feature: GYAE6OF02GAAE7.41.25.C03.1.454.CMB.1.raw
  modified_base (434)..(434): a, c, t, g, unknown or other
  misc_feature (434)..(434): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtnataattggcggagggaccagggtcaccgtctagtcagccaagctcgcccctggtcactctcgttcccgccctcctcatacgtatacgatcgg

SEQ ID NO: 97493 - DNA, 529 bp, Homo sapiens
  misc_feature: GYAE6OF02G0SQ1.41.25.C03.1.454.CMB.1.raw
  modified_base (338)..(338): a, c, t, g, unknown or other
  misc_feature (338)..(338): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctgggtcccctttcggttttctggctccatcgacngtccctccaactccgcctcccttacatatctgggctgaagagtgaggacgaggctgactacttctgtcagtcttatgatataaacaattatgtgataattggcggagggacagggtgaccgtcctaggtcagccagctcgcccctcggtccacttcctcgttcccgccctcctccatagtactagactcgg

SEQ ID NO: 97494 - DNA, 523 bp, Homo sapiens
  misc_feature: GYAE6OF02IE97P.41.25.C03.1.454.CMB.1.raw
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctatcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctccttaccatatctgggctgaagagtgaggacgaggctgactacttctgtcagttctatgatataaacaattangtnataatggnggagggacagggnaccgtcctagtcagccaagctgccccctggtcactctcgttccccaccttcctcatagtatagactcgg

SEQ ID NO: 97495 - DNA, 548 bp, Homo sapiens
  misc_feature: GYAE6OF02JLA6S.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctgggtcccctttggtttctggctccatcgacagtccctccaactccgcctccctacactactctggctgaagagtgaggacgaggctgactactctgtcagtcttatgaatataaacatttaatgtagataaagttggacggaggtacagggtgaccgtccttaggtcacgacccaaggctacggcccctggtcctactctcgttccccgcccttccgtactacgttagtactacgtacgtcgg

SEQ ID NO: 97496 - DNA, 657 bp, Homo sapiens
  misc_feature: GYAE6OF02JEDHD.41.25.C03.1.454.CMB.1.raw
  modified_base (260)..(260): a, c, t, g, unknown or other
  misc_feature (260)..(260): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggnagttctcccgtcactctaatttatgaagtattttacgaagtaccttccccgttcggggttcccccttttcggttttcctcggtccttccatccgactacgtcccctccaacctcccgccctcccttaccatactctgggctagaagagtgacggacgaggctagaccttacttcgtgtctagttcttatgtaattaataaactaatttatagtagtaattaaagttgggacggtagggtaaccgtaggggtacgtacccggttaccgttagggttaccgaacggaccccgaagggtccctaccggtcccccgttacgggtaccctaccgttccgttccggtttcccccgtccccttccgtaccgtaacgttaacggtacttacggtaccgttacggg

SEQ ID NO: 97497 - DNA, 528 bp, Homo sapiens
  misc_feature: GYAE6OF02HR98V.41.25.C03.1.454.CMB.1.raw
  modified_base (434)..(434): a, c, t, g, unknown or other
  misc_feature (434)..(434): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtnataattggcgagggaccagggtgaccgtcctaggtcagcccaaggctgccccctcggtcactctcgttcccgccctcctcatagtatagactgg

SEQ ID NO: 97498 - DNA, 533 bp, Homo sapiens
  misc_feature: GYAE6OF02GUW07.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctcaactccgcactcccttacatatctgggctgaagagtgaggacgaggctgactacttctgtcagtcttatgatataaacaattatgtagattaagttggcggagggaccgagggtcgaccgtctaggtcagcccaaggctcgccccgtggtccactctcgttcccacccttcctcatagtatagtacg

SEQ ID NO: 97499 - DNA, 567 bp, Homo sapiens
  misc_feature: GYAE6OF02HIPLW.41.25.C03.1.454.CMB.1.raw
  modified_base (446)..(446): a, c, t, g, unknown or other
  misc_feature (446)..(446): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccactctgtgtcggagtcttcggggaagacggtaaccctgtcctgccacccgcagcagcggcagcattggcagcagctatgtgcagtggttccagcagcaccgggcagttctcccgtcactctaatttatgaagtattttcgaagtacctccccgttcggggttccccttttcggttttctggtctccatcgactacgtccctccaactcccgcctcccttacatactctggctgaagagtgaggacgaggctgacttactctgtcatctatgatataaactattatgtanattagttggcggagggtaccagggtacgaccgtcgtaggtccacgcccgaaggcctcgcccccgtggtcctacctccgtccgttccccgtccctcctctacgttacgtactacgactcggg

SEQ ID NO: 97500 - DNA, 507 bp, Homo sapiens
  misc_feature: GYAE6OF02JH5JJ.41.25.C03.1.454.CMB.1.raw
  modified_base (260)..(260): a, c, t, g, unknown or other
  misc_feature (260)..(260): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggnagttctcccgtcactctaatttatgaagattttcgaagactccctgggtcccctttggtttctggctccatcgacagtccctcaactccgctccctacatatctggctgaagagtgaggacgaggctgactacttctgtcagtcttatgaatataaacattangtnatatggngaggacagggtnaccgtcagtcagccagctcgccctggtcattctcgttcccacctctcatagtactacgatgg

SEQ ID NO: 97501 - DNA, 522 bp, Homo sapiens
  misc_feature: GYAE6OF02GYYB7.41.25.C03.1.454.CMB.1.raw
  modified_base (455)..(455): a, c, t, g, unknown or other
  misc_feature (455)..(455): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccactccgcctccttaccatatctggctgaagagtgaggacgaggctgactacttctgtcagtcttatgatataaacaatttatgtagataattggcgaggaccagggtnaccgtctagtcagccagctcgcccctggtcactctcgttcccaccgtcctcatacgtatacgatcgg

SEQ ID NO: 97502 - DNA, 554 bp, Homo sapiens
  misc_feature: GYAE6OF02FS21Y.41.25.C03.1.454.CMB.1.raw
  modified_base (349)..(349): a, c, t, g, unknown or other
  misc_feature (349)..(349): n is a, c, g, or t
  modified_base (391)..(391): a, c, t, g, unknown or other
  misc_feature (391)..(391): n is a, c, g, or t
  modified_base (535)..(535): a, c, t, g, unknown or other
  misc_feature (535)..(535): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagtattttcgaagtacctccccgtggggttcccccttttcggttttctggtcctccatcgacncgtccctccaactccgcctcccttaccatatctggctgaagngtgaggacgaggctgactacttctgtcagtcttatgatataaactaattatgtgaattagttgggacggtagggaccgtagggtcgaccgtctaggtcacgccaaggctcgccccgtggtcactctcgttccccacccgttccnctatacgtatacgctacgg

SEQ ID NO: 97503 - DNA, 517 bp, Homo sapiens
  misc_feature: GYAE6OF02IN2L4.41.25.C03.1.454.CMB.1.raw
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactactctgtcagtcttatgatataaacaattatgtnatatggnggaggacagggtgacgtctagtcagccagctcgcccctggtcactctcgtcccgccctcctcatagtactagactgg

SEQ ID NO: 97504 - DNA, 529 bp, Homo sapiens
  misc_feature: GYAE6OF02GP9T1.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggtctccatcgacagtccctccaactccgcctcccttaccatatctggctgaagagtgaggacgaggctgactacttctgtcagtcttatgatataaacaattatgtgataattggcggagggaccagggtcgaccgtctaggtcagcccagctcgcccctcggtcactctcgttcccgcctcctcgactagtactagctcgg

SEQ ID NO: 97505 - DNA, 606 bp, Homo sapiens
  misc_feature: GYAE6OF02G0TXW.41.25.C03.1.454.CMB.1.raw
  modified_base (269)..(269): a, c, t, g, unknown or other
  misc_feature (269)..(269): n is a, c, g, or t
  modified_base (376)..(376): a, c, t, g, unknown or other
  misc_feature (376)..(376): n is a, c, g, or t
tcagtctatactatcacgaccggtgctcgatttagtagtgtagatttgggtttgggaacgtaagtggacgcagtctccacctatggcctgggctccactacttctcacccgtcctcgctcactgcactaggttcttgggcccattttataattgacacacgccccactctgtgtcggagtcttcggggaagacggtaacctgtcctgcaccgcagcagcgcagcattggcagcagctatgtgctagtggttccagcagcggtcccgggnacggttctcccggtcacgtctaatttatgaagtattttcgagactcccgtggggtcccctttcggtttctcggctccatcgacagtccctcaactccgctccctacntactctggctgaacgtgtagacggacgacggctacgtactacttctgtaccgactttctaagtagtaactaactaaacgtaatttagtcgtagtaacgttaagttcgggacgggaacgggtaccgtacgggtactaccgttacgttagtcgacgtaccgaggctaccgcccgtagtcctacttcgtcccgttaccctactccgtactacgtacggtactacgacgtacgg

SEQ ID NO: 97506 - DNA, 553 bp, Homo sapiens
  misc_feature: GYAE6OF02HUY77.41.25.C03.1.454.CMB.1.raw
  modified_base (208)..(208): a, c, t, g, unknown or other
  misc_feature (208)..(208): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatatttgacacagccccactctgtgtcggagtcttcggggaagacggtaaccctgtcctgcacccgnagcagcggcagcattggcagcagctatgtgcagtggttccagcagcgcccgggcagttctcccgtcactctaatttatgaagatttttcgaagacttccccgtggggtccccttttcggttttctggtctccatcgacagtccctcaactccgcctccctacatatctggctgaagagtgaggacgaggctgactacgttctgtcagttcttatgatataaacaattatgtagattaagtggacggaggacgtaggtgaccgtctagtcacgcccgtaagcctacgcccccgtcggtctaccgtctccgttcccgcccgtcctcacgttacgtatcgacgtacgg

SEQ ID NO: 97507 - DNA, 521 bp, Homo sapiens
  misc_feature: GYAE6OF02GBPUW.41.25.C03.1.454.CMB.1.raw
  modified_base (335)..(335): a, c, t, g, unknown or other
  misc_feature (335)..(335): n is a, c, g, or t
  modified_base (408)..(408): a, c, t, g, unknown or other
  misc_feature (408)..(408): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctgggtccctttcggtttctggctcatcgacngtccctcaactccgcctccttacatatctggctgaagagtgaggacgaggctgactacttctgtcagtcttangatataaacaattatgtagtataattggcggaggaccagggtcaccgtctaggtcagccaagctcgcccctggtcactctcgttcccaccctcctctatagtactacgatcgg

SEQ ID NO: 97508 - DNA, 523 bp, Homo sapiens
  misc_feature: GYAE6OF02FNHQL.41.25.C03.1.454.CMB.1.raw
  modified_base (335)..(335): a, c, t, g, unknown or other
  misc_feature (335)..(335): n is a, c, g, or t
  modified_base (507)..(507): a, c, t, g, unknown or other
  misc_feature (507)..(507): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactcctgggtccctttcggtttctggctccatcgacngtccctccaactccgcctcccttaccatatctgggctgaagagtgaggacgaggctgactacttctgtcagttcttatgatataaacattatgtgatatggcggagggaccagggtcgaccgtctagtcacgccgaggctcgcccctcggtcactctcgtcccgcccttccncatagtatacgatcgg

SEQ ID NO: 97509 - DNA, 633 bp, Homo sapiens
  misc_feature: GYAE6OF02HE9HC.41.25.C03.1.454.CMB.1.raw
  modified_base (206)..(206): a, c, t, g, unknown or other
  misc_feature (206)..(206): n is a, c, g, or t
  modified_base (260)..(260): a, c, t, g, unknown or other
  misc_feature (260)..(260): n is a, c, g, or t
  modified_base (334)..(334): a, c, t, g, unknown or other
  misc_feature (334)..(334): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgnagcagcggcagcattggcagcagctatgtgcagtggtccagcaggcgcccgggnagttctcccgtcactcttaaatttatgaagtattttcgaagtaccttcccgtggggttccccttttggttttcnggtcctccatcgactacgtccctcaacctcccgcccttacccttaaccattactcgtgggctaggaagtaggtagaggacgaggcctagacttacttcgtgtactagttcttatgtaataaataaactaatttagtagtagtaattaagtgggacggaagggaccgaggggtacgaccggttaccgttaggtccgaacgacccgaacggccgttacccgcccccgttacggtcctaccgttccgttccgttacccccgcccttcccgtactaacgttaggtaacgtacgtacgtacggg

SEQ ID NO: 97510 - DNA, 534 bp, Homo sapiens
  misc_feature: GYAE6OF02FPRBT.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagtactcccgtcggggttccccttttcggttttctggctccatcgacacgtccctccaacctccgcctcccttacatatctggctgaagagtgaggacgaggctgactacttctgtcagtcttatgataataaactaattatgtgataatggcggaggacgagggtcgaccgtcgtagcagccaagctcgcccctcggtcactctcgttcccaccctcctcatacgtactagctacgg

SEQ ID NO: 97511 - DNA, 689 bp, Homo sapiens
  misc_feature: GYAE6OF02JIQPO.41.25.C03.1.454.CMB.1.raw
  modified_base (183)..(183): a, c, t, g, unknown or other
  misc_feature (183)..(183): n is a, c, g, or t
tcagtctatactatcacgaccggtgctcgatttagtagtgtagatttgggtttgggaagtagtggagcatctccactatggcctgggctccactacttctcacctcctcgctcactgcacaggttcttgggccctattttatattgactacagccccactctgtgtcggagtcttcggggaancggtaacctgtcctgcaccgcagcagcggcagcatggcagcagctatgtgcagtggttccagcagcgccggcagttctccgtcactctaatttatgaagtattttcgaagtactccgtcgggtccctttcggttttctggtctccatcgactcgttccctctaacctcccgccttcccttacattactcgtcgggcttgaacgtacgttacggacggtaacgaggtcgtacgtaccgttactttacgtcgtcgtacgttcctttaagtcggtaacttaacgttaaacttaaacgtttagttaggttagaactttaagtttagggacgggtaacggggaccgtaagggggtactaacccgggttcgttaacggtccgtaacggtacccgtaaggtccccgtaccgtcccccgttacgggtaccctaacgtttcccggttccgttacccccgttacccgttacccgttaccgtaaccgttaaggtaccgtttacgacccggttaacgg

SEQ ID NO: 97512 - DNA, 539 bp, Homo sapiens
  misc_feature: GYAE6OF02GA22P.41.25.C03.1.454.CMB.1.raw
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctccccgtcactctaatttatgaagattttcgaagactccctggggtcccctttcggttttctggctccatcgacagtccctcaactccgcctcccttaccatactctggctgaagagtgaggacgaggctgactacttctgtcagttcttatgatataaactaattatgtgattaagttgggcggaggaccgagggtcgaccgtcgtagtcacgccgagcctcgcccctcggtcacgtctcgttcccncccttcnctatacgtatacgactcgg

SEQ ID NO: 97513 - DNA, 530 bp, Homo sapiens
  misc_feature: GYAE6OF02GZI3X.41.25.C03.1.454.CMB.1.raw
  modified_base (380)..(380): a, c, t, g, unknown or other
  misc_feature (380)..(380): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctcaactccgcctcccttaccatatctgggctgaagngtgaggacgagctgactacttctgtcagtcttatgatataaacaattatgtgatattggcggagggaccagggtgaccgtctaggtcagcccagctcgcccctggtccactctcgttccccaccctcctacaaacgtatacgactgacgg

SEQ ID NO: 97514 - DNA, 767 bp, Homo sapiens
  misc_feature: GYAE6OF02JP4QO.41.25.C03.1.454.CMB.1.raw
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcaggcggcagcattggcagcagctatgtgcagtgtcagcagcgcccggnacgttctcccgtcactctaatttangtaagttatttacgaacgtaccgttcccgttacggggttcccccttttcggttttccgtcgggtacctccgtactccggtacctaccggttccctaccgtaacccgttccccgtacccttacccctttaaccgtaagtttacctccggttacgggtaccttaaggaaacggtacggttaggaacgggtacgggtacggtacccgttaggtaaaccctttaccgtttcgttacgtacttaagggtttccttttaaagtaggttaaattaaactaaaacttaacgtttagtacgttaaagtacgttaagtaggggaccggaagggtacccggtagggtaccggtaccgttaccggtaggtaaccgaacggtacccgtaaagggccttacccggtaccccgtaggttaccccgtagtccccgtttacccgtaaccccgttccccgtccgttaacctggttaaccgtacgtaaccggtccggttaacgg

SEQ ID NO: 97515 - DNA, 528 bp, Homo sapiens
  misc_feature: GYAE6OF02GBKEP.41.25.C03.1.454.CMB.1.raw
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
tcagtctatactatcacgaccggtgctcgatttagtagtgtagatttgggtttgggaagtagtggagcatctccactatggcctgggctccactacttctcaccctcctcactcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttggtttctggctcatcgacagtcccncaactccgcctcctaccatatctggctgaagngtgaggacgaggctgactacttctgtcngtcttatgatataaacaattatgtanataattggcggagggacagggtacgaccgttactagtcagcccaagctcgcccctcggtcactcctcgtcccacccgtcctcgattagtactacgatcgg

SEQ ID NO: 97516 - DNA, 604 bp, Homo sapiens
  misc_feature: GYAE6OF02GO1A1.41.25.C03.1.454.CMB.1.raw
  modified_base (405)..(405): a, c, t, g, unknown or other
  misc_feature (405)..(405): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggtccagcagccgcccgggcagttctcccgtcactctaatttatgaagtattttcgaagaccttccccgttcggggttccccttttcgggttttcctcggtcttcccgatccgactacgtccctaccaacctccgccctcccttaccatactcgtggctgaagngtgaggacgaggctgactacttctgtcagttcttatgaatataaactaattatgtagtattaagttggcgggaggaccgtagggtacgtaccgttaccgtaggtccgacgacccgaagctcccgccccgtacgggtcccacttccgttaccgttacccccacccttcctaccgtaattacgtacgttacgtacgtacgg

SEQ ID NO: 97517 - DNA, 569 bp, Homo sapiens
  misc_feature: GYAE6OF02G022S.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcacctctaatttactgaagtattttcgaagacctccccgtggggttcccccttttcggttttctgggtcctccatcgactacgtcccctcaactcccgccttcccttaccatacttcgtcgggctagaagagtggaggacgaggctagacttacttctgtcagttcttatgacttataaacattatgtagattaagtggcggagggacctagggtgtaccgtctaggtcacgaccgagctccggcccctcggtctacctctccgttccccgtcctcctacactacgtatacgatacgg

SEQ ID NO: 97518 - DNA, 574 bp, Homo sapiens
  misc_feature: GYAE6OF02IO4XQ.41.25.C03.1.454.CMB.1.raw
  modified_base (455)..(455): a, c, t, g, unknown or other
  misc_feature (455)..(455): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggtccagcagcgcccgggcagttctcccgtcactctaatttatgaagtattttcgaagtactcccttgggggtccccctttcgggttttctcgggctccatcgacaggtcccctccaactcccgtcctccctttaccacttatctcgggctagaagagtgaggacgaggctaggaccttacttctgtctagtcttatgatataaacaattatgtnaattagtggcggagggaccgagggtgaccgttcgtaggtcacgtaccgaaggcctcggcccctcggtcctaccgtccttcgttccccgtccctccctctagtacgtcgtacgctacggg

SEQ ID NO: 97519 - DNA, 598 bp, Homo sapiens
  misc_feature: GYAE6OF02I47DW.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggtccagcagcgcccgggcagttctccccgtcactctaatttatgaagtattttacgaagtacctcccgtggggttcccccttttcggttttcctggtcctccatcgacacgtccctccaacctccgccctcccttaccatatctggctgaagagtggaggacgagctgacttacttctgtctagttcttatagataataaactaattagtagtagtattaagttgggacgggacgggaccgagggtacgaccgttacgtacggtacacgacccgaggcctcgtcccccgtcggtcctaccttccgtccgttccccgcccttacccgtactaacgttacgtacgtacgtacgtacggg

SEQ ID NO: 97520 - DNA, 579 bp, Homo sapiens
  misc_feature: GYAE6OF02H2TMJ.41.25.C03.1.454.CMB.1.raw
  modified_base (207)..(207): a, c, t, g, unknown or other
  misc_feature (207)..(207): n is a, c, g, or t
  modified_base (381)..(381): a, c, t, g, unknown or other
  misc_feature (381)..(381): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgnagcagcggcagcattggcagcagctatgtgcagtggttccagcagcgcccgggcagttctcccgtcactctaatttatgaagtattttcgaagactcccgtgggttcccctttggttttctggctccatcgacagtccctcaactcccgcctcccttacatatctggctgaagngtgagacgaggctgactacttctgtcagttctatgtaatattaaataatttatgtatattaagtgggacggagggtaccaggggtgaccggttctaggtccaaggcccgaaggtccgtcgttccccgtcggtaccaccgttcgttccgttacccccgtcccttacccgtccgaagttacgtaacgtacgacctacggg

SEQ ID NO: 97521 - DNA, 919 bp, Homo sapiens
  misc_feature: GYAE6OF02HB8GK.41.25.C03.1.454.CMB.1.raw
tcagtctatactatcacgaccggtgctcgatttagtagtgtagatttgggtttgggaagtagtggagcatctccactatggcctgggctccactacttctcaccctcctcgcctcactcgcacgtaggttcgttcgggaccctaattttatattgacacacgccccactctgtggtcggagtcggttacggggaacgtaccggtaacctcgtcctgccacccgcgagccgacggccggcgacggctagttcggcaaggcacgtactagtgtcgacgtaggttcggtaccgagcgacggcccgggtccccggggactaccggttcccgtccccgtacctacctttaacgttaattttacgtaggtaaagttacgttttaaccggaaccgttacccgttccccgggtttcccggggttttccccgtttttacggggttttaccgtcgggtccttaccgtacgttaccgacctaccggttcccctaccgtaaccgtccccgtaccccttacccttaacacgttactcggtacggttccgtaaggaacggtacggtagggtaacggacggtacggtccttacgttaacctttacgtttccgtacgtacgtacgtttacgtaattagtaaacttaaaacgttaaacttaagttacgtttagtaagttaacggttaaggtccgggggtaacggtaacccggggtaacggttaccggggttacccggttaacccgttacccggggttaagtaccccggtaaacccgaccccggttaacggttcccccttaccccggggtaccccccgttacggggtttaacccctacccggttttcccggttacccccgtttcccccccggtaccctttacccggttaacctagttttaacccggttaaccgtacggggttaccgaacccgggggg

SEQ ID NO: 97522 - DNA, 580 bp, Homo sapiens
  misc_feature: GYAE6OF02I4MW7.41.25.C03.1.454.CMB.1.raw
  modified_base (351)..(351): a, c, t, g, unknown or other
  misc_feature (351)..(351): n is a, c, g, or t
  modified_base (422)..(422): a, c, t, g, unknown or other
  misc_feature (422)..(422): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggttccagcagcgcccgggcacgttctcccgtcactctaatttatgagtattttcgaagaccttccgtcgggttccccttttcggtttctggctccatcgacacgtcccnccaactcccgccctcccttaccatactctggctggaagagtgaggacgagctagactacttctgtcagttnttactagacttaataaactaatttatgtactattaagttggagggtacggaccgtagggtcgtaccgttcgtacgtcgacgaccgaagtccgtaccgtccccgtcggtctacctcgttcccgttccctccctcgactactacgtactacgacgtcggg

SEQ ID NO: 97523 - DNA, 791 bp, Homo sapiens
  misc_feature: GYAE6OF02HVE9M.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaacctgtcctgcacccgcagcagcggcagcattggcagcagctatgtgcagtggtccagcgagccgcccgggcaggttcctcccgtcacttacttaattttacagtaagttacttttacggaaacgtaccgttccccggttcggggttcccccttttcgggtttttcctcgggtcctccgtagtccgacctaccgttcccctacctaaccgtcccgtccccttacccttaaccacttcgttcgtcggggtacctaggaacgtaggtaggacgggacgtacggtctagtaccttacgttcgttcgtacgtagttactttagtacggtaattaaactaaaacttagtttacgttaggttaacgtaagtttaaggttcggggtaacggggtaaacggggacccggttaaggggttaccggtacccggtttaccgtaacggggtacccgtaacgggaaccccggtaagggttccccgtaccccggtacccccccggttttcgggtcccctttaacccggttcccgtttaccccggttacccccctaccccggtttaccctacgttaaccggtttaacggttaacgttaaccgggtacgttaacggggg

SEQ ID NO: 97524 - DNA, 729 bp, Homo sapiens
  misc_feature: GYAE6OF02HOUM2.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtgtccagcgagcgcccggcacgttcctcccgtcactctaactttatagtaagtatttacgaacgtaccgttcccgttcggggttcccctttcggtttcgtcggtcctccagtccgacacgtccctaccaaccgtcccgtcccttaccctacctactacgtcgtcgggacttggaaacgtacggtggaacgggtacggaacggtcgtacgtaccttaccgtttcgttcgtacgtacgttacgtttactagtaacttaaataaaaacttaatttagtacgttagtaacgtttaaggtacggggaacgggtaacgggtaaccggtacggggtaccgtaacccggttaccggtaacgggttaccgtaaccgtacccggtaacggtcccggtacccgtcccccggtttaccggtccgttacccttacccgttcccggtttaccccctacccgttccctaccgtaacttaacggtaacgttaccgtagtaaccggg

SEQ ID NO: 97525 - DNA, 748 bp, Homo sapiens
  misc_feature: GYAE6OF02JL51B.41.25.C03.1.454.CMB.1.raw
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
tcagtctatactatcacgaccggtgctcgatttagtagtgtagatttgggtttgggtaagtagtggagcatctccactatggcctgggctccactacttctcaccctcctcgctcactcgcacagttcttgggcccattttatatttgacacagccccactctgtcgtcggtagtccttcggggaagtaccggtaaccctgtccctgcaccgcagcagcggcagcatggcagcagctangtnacaggtgtccagccgagccgcccgggctagttcctccccggtacaccttcttaaagtttacngtaaacgttacttttcgaaacgtaccttccgtccgggttccccgttttcggttttccgttcgggtccttccgtacgttaccggaccttaccggttcccctccgtaaacccgttcccacccttcccttaacctacgttaccgtcttcgggactacgtaaacggtcgtacggacggtacggacggtccgtaacggtaccttaaccctcgttacggtactacggtttactttacgtagtacttaaataaaccgtatttaacgtagtataagttaagtcgggtacggaagggtacccgagggtcggtaaccgtccgttaggacgcgtacccgagggttaccctcgtccccgttaaccgggtccttacccgttccgttacccggttcccccgttaccccttacccgttaccgtaccgtttaaccgtaacgttaccgtacgtaacccggg

SEQ ID NO: 97526 - DNA, 564 bp, Homo sapiens
  misc_feature: GYAE6OF02GNHRE.41.25.C03.1.454.CMB.1.raw
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttcctcccgtcactctaatttangaagtattttcgaagtactccctggggttccccttttggttttcnggtctccatcgcagtcccncaactccgcctccctacattancgtggctgaagagtggacggacggagctagacttacttctgtctagtcttangtaatataaactattatgtctaatagttggcgggtaggacgtagggtcgaccgttcgtaggcacgccgaagccgtcgccccgtcggcctacgttccgtccgttccccgcccttcctacgtacgttagtactagtctacggg

SEQ ID NO: 97527 - DNA, 592 bp, Homo sapiens
  misc_feature: GYAE6OF02FUWPN.41.25.C03.1.454.CMB.1.raw
  modified_base (396)..(396): a, c, t, g, unknown or other
  misc_feature (396)..(396): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctccccgtcactctaatttatgaagtattttcgaagacctcccgtggggttcccccttttcggttttctggccttcctatcgacacgtcccctccaacctcccgcctcccttaccatactcgtggctgaagngtgaggacgaggctgactacttctgtcgtagtctttatgtataagtaaactaattactagtagattaagttgggcggagggtaccgagggtacgacccgtcgtaggtcacgacccgaggcctcgccccgtcggtcccacttccgttcccgttcccgtccccttccctactacgttacggtactacggtacgtcggg

SEQ ID NO: 97528 - DNA, 716 bp, Homo sapiens
  misc_feature: GYAE6OF02JHMMQ.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtcggttccagcagccggcccgggctacgttcctccccgtcactcttaactttatcgaagttattttacgaacgtacctccccgttcggggttccccttttcgggtttttctcggccttccagttccgacgtacgttccccgtaccaacctcccgtccctaccccgtttacacttacgtcgtcgggtctaggaagtacggttacggaggacggacggctacgtacttacttcttggtactaggttcttaagtcgtaaagtaaacttaaaactagttttaactggttagtaaacgttagttcggggaacgggtacggggtaaccgtaaggggtccgttaaccggttaccgttaaggggtcccaaacgtacccgaacgtccttcccggcccccgtttacgggtcctaaccggttccgttacccggtttccccgccccttaacccgtcgtaacgtttaacggacgttacgaccgttccggg

SEQ ID NO: 97529 - DNA, 573 bp, Homo sapiens
  misc_feature: GYAE6OF02HAM8Q.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccatctgtgtcggagtcttcggggaagacggtaaccctgtcctgcacccgcagcagcggcagcattggcagcagctatgtgctaggtggttccagcagccgcccgggcagttctcccgtcactctaatttactgaagtattttcgaaagtaccttccccgtggggttcccccttttcggttttctcggtcctccagtcgactacgtcccctaccaactcccgcctcccttacactatcgtggctgaagagtgaggacgagctagactacttctgtcagttcttatgatataaactaattagtgtatattaagtggacggtagggacctagggtcgaccgttcgtacggtcacgaccgaaggcctacgcccctggtccacttcgtcgttcccctaccctctcattacgtactgactcgg

SEQ ID NO: 97530 - DNA, 600 bp, Homo sapiens
  misc_feature: GYAE6OF02GDNRJ.41.25.C03.1.454.CMB.1.raw
  modified_base (238)..(238): a, c, t, g, unknown or other
  misc_feature (238)..(238): n is a, c, g, or t
  modified_base (327)..(327): a, c, t, g, unknown or other
  misc_feature (327)..(327): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcnggtggttccagcagcgcccggcacgttctcccgttactctaattatgagtatttcgaagactccgtcgggttccccgtttcggttttcncggtctccagtccgactacgtcccctccaaccgtcccgcccttccctaccacttatcgtgggtcttggaacggtagtaggacggacggtaggccgtgtacttacttcgtggtctaggttctatgtaataagttaaactattacgtagtatataagttggcggaggaccgtagggtcgacgtcgtagcgacgaccgagccgtccgcccgtacggtcctacctccgttccgtcccgcccttccgtacctcgtacgtagttacgacgtgtaccggg

SEQ ID NO: 97531 - DNA, 544 bp, Homo sapiens
  misc_feature: GYAE6OF02GBO7T.41.25.C03.1.454.CMB.1.raw
  modified_base (390)..(390): a, c, t, g, unknown or other
  misc_feature (390)..(390): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggtccagcagcgcccgggcagttctcccgtcactctaatttatgaagattttacgaagtacctccctggggtccccttttcggttttctggctcatcgacagtcctcactccgcctccctacatactctgggctagaagagtgaggacgnggctgactacttctgtcagtcttatgaatataaanaattntgtanataagttgggagagggacagggtcaccgtccgtaggtacacgccgagctcgcccctcggccacttccgtcgtccccgcccttccgtactacttatacgtacgactacgg

SEQ ID NO: 97532 - DNA, 602 bp, Homo sapiens
  misc_feature: GYAE6OF02HQJDL.41.25.C03.1.454.CMB.1.raw
  modified_base (259)..(259): a, c, t, g, unknown or other
  misc_feature (259)..(259): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggtccagcagcgcccgggnagttctcccgtcactctaatttatgaagtattttcgaagtacctcccgtcggggttcccctttcggttttctcggtctccatcgactacgtccctaccaactcccgccctcccttaaccacttactcgtgggctaggaagtagtggacggacgacggctagacttacttctgtctagttctatgtaataataaacttaattatgtagtatagttcggaggtacgggacgtagggtcgtaccgtcgtacggtcacgaccgtacgccgtccgtccccgtcggtactaccgttccgttcccgttccccgtcccttccgtactagttacgtacgtacgtactacggg

SEQ ID NO: 97533 - DNA, 742 bp, Homo sapiens
  misc_feature: GYAE6OF02J0FJP.41.25.C03.1.454.CMB.1.raw
  modified_base (260)..(260): a, c, t, g, unknown or other
  misc_feature (260)..(260): n is a, c, g, or t
  modified_base (650)..(650): a, c, t, g, unknown or other
  misc_feature (650)..(650): n is a, c, g, or t
tcagtctatactatcacgaccggtgctcgatttagtagtgtagatttggtttgggaagtagtggagcatctccactatggcctgggctccactacttctcaccctcctcgctcactgcacaggttcttgggcccacttttatattgacacagccccactctgtgtcggagtcttcggggaagacggtaaccctgtcctgcacccgcagcagcgcagcagttggcagcagctatgtgcagtggttccagcagccgcccggntagttcctcccggtcaccgtcgttaactttagtggtaaatgttttacggaacgtacccgttccccgttacggggttccccctttttagggttttcctgggtacccttcccgaagttccggaaactaccgttccccgtaccaacccgttcccgtcccttccctttacacgttactcgtacgggccttaaggagtacgttacggaggtaacgtggtactacggaccttaactttcgcgttacgtacgtttccttaagtacggtaacttaaacttaaaccgttaattttacggtaacgtacgttaaattacggtacgggtaacgggaacgggttacgaccgggttgtaacccggtcggttaaacgtcccgtacggtaacccgaagggttcccnccgggttaccccttacggtaccgttaccgtaccggtttcccgtacccgtccccgtttacaccggtacttacggtactacggtacctacgggg

SEQ ID NO: 97534 - DNA, 597 bp, Homo sapiens
  misc_feature: GYAE6OF02GJ1OM.41.25.C03.1.454.CMB.1.raw
  modified_base (399)..(399): a, c, t, g, unknown or other
  misc_feature (399)..(399): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggtccagcagcgcccgggcagttctcccgtcactctaatttatgaagtattttcgaagtacctccccgtgggggttcccccttttcgggtttttctgggtcctccatcgacacgtcccctccaacctcccgccctcccttaccatatcgtggctgaagngtgaggacgaggctgacttacttctgtcagttcttatgataataaactaatttatgtagtaattaagttgggacggagggaccgtaggggtcgtaccgttccgttaggtcgacgacccgaaggtcctccgcccccgtcggtcctaccttccgtcccgttccccgcccttccctctacgttacgtactacgacgtacgg

SEQ ID NO: 97535 - DNA, 910 bp, Homo sapiens
  misc_feature: GYAE6OF02HTXE9.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggccctatttttatattgacacacgccccactctgtgtcggagtcgttcggggaagacggtaaccctgtcctgccacccgcagcaggcggcagcattggcagcagctagtgtgctaggttcgtccgagcgacggccggcccgggctacggttccgtcccgtactaccttacgttaatttacgtaggtaacgttacgtttacggaacgtacccgttcccgggttccggggtttccccctttttcgggttttccgtcggtcccttccgtaacgtcccgtaaccgtcccggttacccctaccccgtaacccgttccccgttaccccgttaacccctttacctaacctttaccgttccgggtacgggtaccgttaacggtaaggttacggtacggggtaaacgggtaccggtaacgggttcctaaccgggttaacccttttacgtttcccggtttcggttaccgttacggttttcctttaaggacgttaaaactttaaacgtaaaactttaaggtttttccgtaaggttaattaaaccggtttacgggtcgggggaacggggttaacccgggttaaccgggtacggggtttaccggtaaacccccggttgggtaaccgggtacccgtaaccggacccggtttaaacgggccccggtttcccccggtacccccggtttaggtaaccccgttccggttttaccccgtccccccggttccccccgttacccgtttacctacggttaaacgttttaccggaaacgttccgggtaaacccgttcggggg

SEQ ID NO: 97536 - DNA, 633 bp, Homo sapiens
  misc_feature: GYAE6OF02F75G9.41.25.C03.1.454.CMB.1.raw
  modified_base (237)..(237): a, c, t, g, unknown or other
  misc_feature (237)..(237): n is a, c, g, or t
  modified_base (284)..(284): a, c, t, g, unknown or other
  misc_feature (284)..(284): n is a, c, g, or t
  modified_base (335)..(335): a, c, t, g, unknown or other
  misc_feature (335)..(335): n is a, c, g, or t
  modified_base (407)..(407): a, c, t, g, unknown or other
  misc_feature (407)..(407): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtncagtggttccagcagcgcccggcagttctcccgtcactctaatttangaagtatttgaagactccgtgggttcccctttggttttctgctcatcgacncgtcctcaactcccgcctcccttacatatcgtggctagaagtgtacgacggacgaggctacgactactttcngtcagttcttatgaataataaactaagtttatgttacgtaattaaagtgggtacgggaacgggtaccgtacgggtacgtaccgttaccgttaggtaccacggaccccgtaacggtccgttacccggtcccccgttacccgggttccaacccgtttcggttccccggttacccccgtacccccgttcccttacggtacgttaacggttacgttaccgcgttaccggg

SEQ ID NO: 97537 - DNA, 701 bp, Homo sapiens
  misc_feature: GYAE6OF02GKG98.41.25.C03.1.454.CMB.1.raw
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcacgttcctccccgtcactcttaatttatgaagtattttcgaagtacctcccgtcggggttccccttttcggtttctcggtctccatccgacncgtccctaccaactcccgccctccctacactactcgtggtctggaagnggtagacggacgagtcgtacgacttacttcgtgtcctaggttcttagtacgtaactaaagttaaactaaagtttacttaggttagtaaagttaagtttacggggcgggtaaacggggtacccggttagggggtaccgttacccgggttaaccgttacggggtacctaaccgggtacccgaacggggtcccttcccgggtaccccccgttacgggtcccttaacccggtttcccgttcccggttccccccgtaccccgttccgtaccttaacgttacgtaacgttacggtaaccgtacgggg

SEQ ID NO: 97538 - DNA, 626 bp, Homo sapiens
  misc_feature: GYAE6OF02HALY6.41.25.C03.1.454.CMB.1.raw
  modified_base (402)..(402): a, c, t, g, unknown or other
  misc_feature (402)..(402): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccactctgtgtcggagtcttcggggaagacggtaaccctgtcctgcacccgcagcagcggcagcattggcagcagctatgtgcagtggtccagcagcgcccgggcagttctcccgtcactctaatttatgaagtattttcgaagtacctcccgtcggggttcccctttcggttttcctggtctccatccgactacgtccctacctaactcccgccctaccccttacacttactcgtgggctagaagngtggaggacgaggcctgaccttacttcgtgtactagttcttatagaattataaaactaatttagtgttagtaattaagttcgggacggtagggaacccgtagggtacgacccgttacgtaaggtccaacgaccccgaaggccgtccgcccccgttaccgggtcctaccgttccgttccgttcccccgtcccttcccgtactacgttacgtactacgcgtacggg

SEQ ID NO: 97539 - DNA, 845 bp, Homo sapiens
  misc_feature: GYAE6OF02JZB19.41.25.C03.1.454.CMB.1.raw
  modified_base (113)..(113): a, c, t, g, unknown or other
  misc_feature (113)..(113): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
tcagtctatactatcacgaccggtgctcgatttagtagtgtagatttggtttgggaagtagtggagcatctccactatggcctgggctccactacttctcaccctcctcgctnactgcacaggttcttcgggcccatttttatatttgacactagccccactctgtgtcggagtcgttggggaagacggtaacctgtcctgccaccgnacgnacgcggctagctattggcagcgagtctatgtcgctaggtgttccagcacggcgccggntacggttccaccgtcacttactaatttnacggtaatttacgtttacggaataccctttccccggttgggttccccgtttttagggttttccngggccctttacctaacggttccgaacgttccccggttaccccacccggttaaaccctccccggtaccccctttaccccgttaaactacgtttaccggttttaccggtcggggttaccgttacgggaaaacggtttaccggacgggggaaaacgggtccgggtaacgggtcccgttaaacgttaccgtaacccgttttgtttacgggtactttaacgggtcttttaacggttaactaacgtttaaactaaaatttaacgtttatttaaccgggtagttaaaagttcggtttaccggaggggtaaaccgggtacccggtaaaggggtttcccgtaccccggttagttaaccgggttacccgaacggtacccgtaaacggggtcccctaccggccccgtttacgggcccttaccgttaccgttaccccgttccccaacccgtttcctaacggtaggttacccttaaggtccgttaacccgtcgggg

SEQ ID NO: 97540 - DNA, 632 bp, Homo sapiens
  misc_feature: GYAE6OF02GFAZU.41.25.C03.1.454.CMB.1.raw
  modified_base (282)..(282): a, c, t, g, unknown or other
  misc_feature (282)..(282): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccggcagttctcccgtcactctaatttntgaagtatttacgaagtactcccgtcggggttccccttttcggttttctggtcctccatcgactcgtccctcccaacctcccgtcccttacccttaccacttactcgtgggtctagaagtgtgaggacgaggtctgacttacttctgtactagttcttatacgtattaaactaaactaatttagttagtagtaacttaaggttggacgggtagggaccgtaggggtacgtaccgtccgtaggtcacgaccgtaaggtaccgtccggtcccccgtcggtacctaccgttcccgttccgttacccctaccccgttccgtacctaacgttacggtaactacggtacgtacggg

SEQ ID NO: 97541 - DNA, 560 bp, Homo sapiens
  misc_feature: GYAE6OF02JFJN1.41.25.C03.1.454.CMB.1.raw
  modified_base (207)..(207): a, c, t, g, unknown or other
  misc_feature (207)..(207): n is a, c, g, or t
  modified_base (289)..(289): a, c, t, g, unknown or other
  misc_feature (289)..(289): n is a, c, g, or t
  modified_base (389)..(389): a, c, t, g, unknown or other
  misc_feature (389)..(389): n is a, c, g, or t
  modified_base (554)..(554): a, c, t, g, unknown or other
  misc_feature (554)..(554): n is a, c, g, or t
tcagtctatactatcacgaccggtgctcgatttagtagtgtagatttgggtttgggaagtagtggagacatctccactatggcctgggctccactacttctcaccctcctcgctcactgcacaggttcttgggccctattttatattgacacagccccactctgtgtcggagtcttcggggaagacggtaaccctgtcctgcaccgnagcagcggcagcattggcagcagctatgtgcagtggttccagcagtccgcccgggctagttcctcccgtcactctaatttanggaagtattttcgaaacgtccttcccgtcggggttcccctttggtttctggtctccatcgactacgtccctacactccgcctaccttacattatcgtggntagaagtagtgaggtacgagctgactcttctgtctagttctatagataataacattatgtatattagtcggaggacggacgtaggtacgaccgttcgtagtcacgaccgagtcctccgtcccgtcgtaccgcttccgtcgtcccgtccttctctattagtctagngtacgg

SEQ ID NO: 97542 - DNA, 730 bp, Homo sapiens
  misc_feature: GYAE6OF02JQ4EY.41.25.C03.1.454.CMB.1.raw
  modified_base (204)..(204): a, c, t, g, unknown or other
  misc_feature (204)..(204): n is a, c, g, or t
  modified_base (257)..(257): a, c, t, g, unknown or other
  misc_feature (257)..(257): n is a, c, g, or t
  modified_base (280)..(280): a, c, t, g, unknown or other
  misc_feature (280)..(280): n is a, c, g, or t
  modified_base (329)..(329): a, c, t, g, unknown or other
  misc_feature (329)..(329): n is a, c, g, or t
tcagtctatactatcacgaccggtgctcgatttagtagtgtagatttgggtttgggaagtagtggagcatctccactatggcctgggctccactacttctcacctcctcgctcactgcacagttcttggcccattttatattgacacagccccactctgtgtcggagtcgttcggggaagacggtaaccctgtcctgcacccgnagcagcggcagcattggcagcagctatgtgcagtcgtccagcagcgcccgggnagttcctccgtacactctaattngaagtattttacgaagcctaccgtgggtcccctttggtttctcggctcntcgactacgtccctcaactccgcccttacccttacacttactccgttaggggccttacggaaacgtagttacggaagggtaccgagggacctacgggtaacctttaccttacgttcggttacctacggtttacctttagttacggtaattaacgttaaaactaattttacgtagttacgtaatttaacgtggggtaaccgggtaggggtaacccgtaggggttaccgtaaccggtttacccggttaaggttacccggaaccggtaacccgtaaacggggtcccttaaccgggttcccccctacgggttacccaccggtttacccgttcccgggttaacccccgttcccccgttaccgttactaacccgttaaccgtttcgtaaaccggttacgtaaccggg

SEQ ID NO: 97543 - DNA, 605 bp, Homo sapiens
  misc_feature: GYAE6OF02FQ81B.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgccccgggcagttctcccgtcactctaatttatgaagattttcgaagactcccgtggggtcccctttcggttttctggtctccatcgacacgtccctccaactcccgcctcccttaccatactctggctgaagagtgaggacgaggctagactacttctgtcagtcttatgtataactaaaactaattagttagttagtaattaagttgggacgggaaggggaccgtaggggtcgtaacccggttcccgttagggtcaacggaccctaagggccgttcgcccccgtcggttccgaccttccgtccgttcccctaccccttccctaccgaacgttacgtattacgtaccgtcgg

SEQ ID NO: 97544 - DNA, 749 bp, Homo sapiens
  misc_feature: GYAE6OF02HS90Y.41.25.C03.1.454.CMB.1.raw
  modified_base (141)..(141): a, c, t, g, unknown or other
  misc_feature (141)..(141): n is a, c, g, or t
  modified_base (278)..(278): a, c, t, g, unknown or other
  misc_feature (278)..(278): n is a, c, g, or t
tcagtctatactatcacgaccggtgctcgatttagtagtgtagatttgggtttgggaagtagtggagcatctccactatggcctggctccactactctcaccctcctcgctcactgccacaggttcttgggcccattttanattgacacagccccactctgtgtcggatcttcggggaagaccggtaaccctggtcctgccacccgcagcagcggcagctagtggcaggcagctatgtcgctagttggtccaggtcagccgtacccgggttagttccncccgttcgacttaccttaaagttactagtaacgtatttacgaacgacccgttccccgttcgggggttaccccttttggttttcctagggcctttaccagttcctaccgtacgtccccctaccgtaaccgtcccgtacccttccccgttaactaactcgtacggtaggtcctaaggtaagaggttaggaacgggacgttaggccgttacacgttacctttcgcggtactacggttacttacgttaacgtaactaaacttaaaacgtaaagttacgtagttgtaaacgtttagtacgggtaacgggcggttaaaccggtcggggtagaaccccggttctaacgggtaccgttacccgaaccgtaacgggtacccttaccgtccccccgtacgttaccctacccgttcgttccccggtcccccgttacccgttacccttacgtacttaaccgtgttaacggccttagggacggg

SEQ ID NO: 97545 - DNA, 799 bp, Homo sapiens
  misc_feature: GYAE6OF02JKWCZ.41.25.C03.1.454.CMB.1.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactcctgtgtcggagtcttcggggaagacggtaaccctgtcctgcacccgcagcagcggcagcattggcagcagctatgtgcagtgtccagcagcgcccgggnacgttctccgtcactctaatttangtaagtattttacgaacgtaccttcccgtcggggttaccccctttttcgggttttacctcgggtccttaccgacgttaccgtaaccgtaccggttcccccttacccgaacccgttccccgtacccctttacccccgtttaaccactttaccgttaccgttcgggggcctttacgggaaaacggttacgggtacgggaaaccggggtaccgggtacgggtacccgtaacggttaaccctttaccggtttccttaccgggttacctaacggttttcctttaagttacgttaaacgttaaaacttaaaaccgtttaaagtttaacgttaggtttaaactaagttttaacggtacggggtacggggtaaggggtaccgttaagggggtaccgttaacccggttcgttacgggtacgaccgtaacccggacgtaccgtcccgtccccgtacggttcctaccttccggttcccgtccccgttcccgttccgttactaccgttagtaacgttacgattacggg

SEQ ID NO: 97546 - DNA, 564 bp, Homo sapiens
  misc_feature: GYAE6OF02GFOSC.41.25.C03.1.454.CMB.1.raw
  modified_base (180)..(180): a, c, t, g, unknown or other
  misc_feature (180)..(180): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttggcccattttatattgacacagccccatctgtgtcggagtcttcggggaanacggtaaccctgtcctgcacccgcagcagcggcagcattggcagcagctatgtncagtgttccagcagcgcccggnagttcncccgtnactctaatttangaacgattttcgaagtactcccgtgggtcccctttggtttctggctccgatcgacacgtcccacaactccgcctcctacatatctggctgaacgngtgaggacgaggctgactcttcncgtnagttctatagatanaaactattatgtagattaaagtcggacgacgggactacgggtacgtaccgttacgttacgtcaacggcccgaaggtcctacgccccgttacggcctaccgttccgtccgtttcccgccctttcgactacgtagtactacgtctacggg

SEQ ID NO: 97547 - DNA, 564 bp, Homo sapiens
  misc_feature: GYAE6OF02FJIFJ.41.25.C03.1.454.CMB.1.raw
  modified_base (233)..(233): a, c, t, g, unknown or other
  misc_feature (233)..(233): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctangtgcagtggttccagcagcgcccgggcagttctccgtcactctaatttatgaatattttcgaagtactcccgtgggttcccctttcggtttctcggctccatcgactcgtccctccaactccgtcctcccttacattactcgtggctagaagtagtagacggacgacggctagtacttacgttctgtactacgttcttatgtaataataaactaattagtgtacgattagtggcggaggtacgaggtcgtacgtcgtagtcacgccgaagtctaccgcccgtgtcctactctcgttcccgcctccgtctattacgtacgtacgtcgtacgg

SEQ ID NO: 97548 - DNA, 641 bp, Homo sapiens
  misc_feature: GYAE6OF02GA2M0.41.25.C03.1.454.CMB.1.raw
  modified_base (347)..(347): a, c, t, g, unknown or other
  misc_feature (347)..(347): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcgggaagacggtaaccctgtcctgcacccgcacgcagcggcagcattggcagcagctatgtgcagtcggttccagcagccgcccggctagttcctcccgtcacttcttaattctgtaagtacgtttacgaagtcctccgttcgggttccctttcggttctgtcctcatcgacncgtccctccactcccgacctcccgttacactagtccgtggtactaggaacgtacggtacgacggtacgacgtctacgtacttacgttctcgtactacgttcttagtcgtaattaacgttaaacttaagttagttagtacgtaagttagttacgggacgggaacggacgtacgggtacgtaccgttccggtacgtacgaccgaccgtaacggcctaccggtccccgtacggtcctaccgttccgttcccgttaccctacccttcctcttaacgtacgttacgtacgacgtacggg

SEQ ID NO: 97549 - DNA, 791 bp, Homo sapiens
  misc_feature: GYAE6OF02JHEJ5.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttggccctattttatattgacacagccccatctgtgtcggagtcttcggggaagaccggtaaccctgtcctgccacccgcagcagcggcagcagttggcagcagctatgtcgcgagttcggttccagcacgccgcccggctacgttcctacccgtcacttacttaatttataggaagttagttttacgaaacgtccgttcccgttcggggtttccccgtttttcggttttacgtcggtcctaccctagttaccgacgtaaccgttcccctacctaacccgttcccgtcccttaccccttactattacgtcgtcgggtactaggaagtacgtaggaacggtaccgaaggttccgtaacgttaccgtttactttcggtacttcctaaggtttaccttaagtacgttaaacttaaaccgttaaaaccttattttaacggtagttaacgtaaacttttaacgggttaccggggaccgggtaaaccggggtaccgtacgggggttaccgtaacccgggtttaccgtacgggtacccgtaaccgggaccccgttaaaggtccccgtttaccccggacccccgtttgggtccccttaaccgttcccgttaccccggtttccccaccccgtttacctacgttaacgttaacgttacgtactaccggttacgg

SEQ ID NO: 97550 - DNA, 758 bp, Homo sapiens
  misc_feature: GYAE6OF02GUBFU.41.25.C03.1.454.CMB.1.raw
  modified_base (209)..(209): a, c, t, g, unknown or other
  misc_feature (209)..(209): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttggccctatttttatattgacacacgcccactctgtgtcggagttcgttcggggaagacggtaaccctgtcctgcacccgnagcagcggcagcattggcagcagtctatgtgcaggtgtccagcagcgccggnacgttcctccgtcacttcttaaatttnaggtaacgtattttacgaaacgtctccccggtttaggggttccccctttttcggttttcgacgggtcctttccgacgttccgtaccgtccgttaccccttaccgaacccttccccgtaccccctttaccccgttaactaaccgttacgtttccggcgggtacttaacgggaacggttacgttcgggaacggacgggtaacggtcctacgtacctttacgtttacgtcggttacgtactttcttacgtacgtaattaaacttaaaactaggtttactagtacgtaaacgttagtttggggacggtaacgggtaccggttaaggggtaccgttacccggtaagttcggggacccacggaaaccctaaccggtcttccccgtacccggttcccgtatacccggttttacccgtcccggtttccccctaacccgttctaccgtaaacgttcggttaagtaccgtacggtacggg

SEQ ID NO: 97551 - DNA, 775 bp, Homo sapiens
  misc_feature: GYAE6OF02HLSY0.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggttccagcagcgcccgggcacgttctcccgtcactctaatttactgaagtattttcgaacgtaccttcccgtacgggggttcccccttttagggttttccgtcggtccttccgtatccgaccgtaacggttcccctacctaaccgtcccgtcccttaccccgtttaaccacttaacgttccgttcgggaccgttaggaacggtacggttgggaacggaccgggtaacgggtcctacgggtaaccctttaaccgtttccgttacggttcccgtaacgtttaccgtttaagttacggtaaactttaaacgttaaaaaccgtaaattttacgtacggtttaagtaagtttaaagttcggggtacgggtaaacggggtaccgtaagggggtaccgtaacccggttaccgttacggtacgtaccggaacccgtaacgggtcctacccggtccccgttaccgggtctaacccgttcggttacccggttaccccgtcccgttaccctacggtaccttaaggtacttacggacgttacggg

SEQ ID NO: 97552 - DNA, 807 bp, Homo sapiens
  misc_feature: GYAE6OF02G2I0Z.41.25.C03.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttcgggcctattttatattgacacagccccatcgtgtgtcggagtcgtacggggaagacggtaaccctgtcctgccacccgnagcagcggcagcagtggcagcagctatgnctggtgttccagcacgccgccggctacgttcctccgtacacttattaacgtttanacggtaagttctttacggaacgtaccgttcccggttccgggtttcccgttttcggtttccgacggtcctaccggtataccggtactaccgttaccccgtcctaacccgttcccgtaccccttcccgttaaccacgtttacttcggtacgggtaccgtaggtaaggtacggacggtaacgggtccgaagggtcgtaccgttaaccgtttaccggttttacgcggtttacccgttaaggtttaccctttaagttaacggttaaccttaaaacttaaacgttaacgttttacggttaagttaacggtttaaaggtttaacgggtcgggtaacccggggttaaacggggacccggttaaggggtaccgttacccggttacgtacggtaacccgacggtacccgtaaggccccgtttaccccggaccccggttacggtccgtaccgtttacccgttacccgttaccccgtaccctacgtttaccctagggtttaactacggttacctacggtaacgggg

SEQ ID NO: 97553 - DNA, 603 bp, Homo sapiens
  misc_feature: GYAE6OF02GHBNI.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttcctcccgtcactctaattatgaagtattttacgaagtacctcccgtcggggttccccttttcggttttctggtccttccagtccgactacgtccctaccaacctcccgtcccttcccttaccattactcgtgggctagaagtagtgacggacgaggctcgtactacttctgtctagttcttatacgtataactaaactaattacgtagtagtaattagttgggacgggtagggaccgagggtacgaccgttcgtacgtacacgacccgaggcctccgcccctcggtcctacttccgtccgttccccgaccttcctacgacgttagtactacgactacgg

SEQ ID NO: 97554 - DNA, 791 bp, Homo sapiens
  misc_feature: GYAE6OF02GSF9Y.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccatctgtgtcggagtcgttcggggaagtacggtaaccctgtcctgccacccgcagccagccggcaggcagttcggcagcagctagtgtgcgtaggttcggttaccagcgacggccggcccggactacgttccgtcccgtaccgtacttattaactttatacgtaacgttacgtttaggaaccgttacccgttccccggttcggggtttaccccctttttcgggttttccgtacggtcccttaccgtaacgtcccggaccgtaccgttcccccctaactaaaccccgtcccggttacccctaccctttaacctaccttaagttccgtcggggtctaagaacgtgtacggacggacgtacggctacgtaccttcgttcgttcgtacctagttacttagtacgtaattaaactaaacgttagtttacgttaggtacgttaagttacggttagggggaccgggtaacggtacggtaccgggtcgtaacccggttacggttagaacccgtacgaacccggtacgggtccctacccgggtacccccttggggttacctaacccgtttcccgtaccccgttaccccccgttccgaccctttacgtaactttaaccggggtacttaaccgggtctaaccgggg

SEQ ID NO: 97555 - DNA, 701 bp, Homo sapiens
  misc_feature: GYAE6OF02GADM8.41.25.C03.1.454.CMB.1.raw
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccctaatttttatattcggactacgagccccctacttctgttgtcggagttcgtttcgggggaaanaccggttaaccctgtccctgccacccgcagcagcggcagcattcggcngctaggctatgtgctaagtcggttaccagtccagccgcccgggnagttcctccgttcactcttaatttancgtaagtattttacgaacgtcttccccgtcggggttcccccttttggttttcgtcggtccttcccgattcggactacgtccctaccaactcccgccttcccttacactactcgcgtctagaacgtgtggaacgacggaggtcctgacttactcgtcgtacgtgttcttatgtaactagtaaacctaatttactagtagtacttaaaggttcggaacgggtaggtaccggtaacggtcggtaacccgttccgaacggttaccaacggaaccccgttagggcccgttaccctacccccggtcgggttacccctacgttcccgttacccgttccccggtcccccttacggtccttaaccgttacgtaaccgttacgtaggtaaccgg

SEQ ID NO: 97556 - DNA, 851 bp, Homo sapiens
  misc_feature: GYAE6OF02I0Y7Q.41.25.C03.1.454.CMB.1.raw
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
tcagtctatactatcacgaccggtgctcgatttagtagtgtagatttgggtttgggaagtagtggagcatctcactatggcctgggctccactacttctcaccctcctcgctcactgcacacggttcttcgggccctattttatattgacacacgccccactctgtgtcggagtcgttcggggaagaccggtaccctgcctcgcccaccgngacncgacgcgcgacgtcgttagtcggcacgacgacgtgtacgttgcgtacggttacggtccggttaccacgcggtaccggcccggccggtacgtccgttacccggtccactacttactttaatacgttgaagtttactacgacgtcccgttccggttccggttccgtttacgttcgtccgtcctacggtaccacggtctaccgtccctaccgtacctaccccgtccccttacccttacgtactttaccggtgtacgggttacgaagtaacgggtacggttagggaaaccggagggttacccgcgttaccgttacctttaacgtttccgttacttacgttacgtttaacgttattaacgttaaacttaaaccgttaaaactttaagtttaacggttacgtaagtttaaacgggtacgggttaggggtaaccggggtaccgggttacgggttaaccgggtaccgtttacccgggtaccggttaccgtaaccgaacccgggtaaaccggttcccggtaccccggttacccgggttcccccgtaggttaccccgtttacccggttcccgttaaccccgtttccccgttacccgttacctaccggttaacgtaccggttaacggtcccggtttaggacccgggg

SEQ ID NO: 97557 - DNA, 775 bp, Homo sapiens
  misc_feature: GYAE6OF02HJYYN.41.25.C03.1.454.CMB.1.raw
tcagtctatactatcacgaccggtgctcgatttagtagtgtagatttgggtttggggggcacaagaggcagcactcaggacaatctccagcatggcctggtctcctctcctcctcactctcctcgctcactgcacagggtcctgggcccactctgtgctgacgcagcccgccctcagttgtcgtcgggggccccgggcaggagggtcaccatcctcctgcaccgtgggacgcaggactaccaacgacgtcgggacagtacttcgtgtagttcgtaccgtacttacggtaaccaaccgtacctttaccgaacggaaccaccgaaccccaaactccctactacttacgtttacggtaaactaactacgtcccgtacccgtaccgtacggggtccctacgtaccgtactttcgtccgtaggacctaccgaacgttcgtcgacctaaccgtccgacgtcccttcccgtaccggcctacgttccgtaccggtacgggtccctaccggtacggtacgtacggaacggtaggttaccgggaaggggttacgttactttaacgtttaccgtccgttaccgtaaccgttaccgttacgtacgtaccgaaccggtacgtaccgacccgtcgggttacgggttttacggggtttggggttaccgggtttcggggacgggtacgggaaccggtaccgggtcggtcccggttacggtacccggttacgggttcccgtaccggtaccggtaaccggtcccggtccccggttccccgtacggttaccccg

SEQ ID NO: 97558 - DNA, 837 bp, Homo sapiens
  misc_feature: GYAE6OF02HGR49.41.25.C03.1.454.CMB.1.raw
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccatctgtgtcggagtcttcggggaagacggtaaccctgtcctgcacccgcagcagcggcagcattggcagcagctatgtncagtgttccagcagcgcccggnagttctcccgtcactctaattatgaagtattttacgaagaccttcccgtcggggttcccctttcggttttcgtcgggtccttccagtccgacacggttccctccaaccgttcccgcccgtacccctttaaccgattacttcgtacgggcttacggaaagtaggttacggaacgggtacgaacgggtacctacggtaaaccctttaacgtttcccgtaggtttacccgtaaggtttccgtttaaactaggttaaacttaaaacttaaaaccgtaaattttaagttacgttaacggttaaagtttaaacggtttcggggtaccggggtaaacggggggttaaacccgtaacggggggtttacgtaacccggttacccggttaaacggggttcccgtaaaaccggtaaccccggtaacgggttacccgttaccccggtacccccccggtttacccggggtaacccttaaacccggtttcccctttaaccccgggtttaacccccccgtaaccccccgtttaccccgtttaaccgtaaaccgtttaaccggtttaaccgttaacggttaacccgttaaccgggg

SEQ ID NO: 97559 - DNA, 804 bp, Homo sapiens
  misc_feature: GYAE6OF02JL8R7.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccactctgtgtcggagtcttcggggaagaccggtaaccctggtcctcgcacccgcagcagcggcagcagttggcagcagctatgtgcgagtcggttccagcgaggccgcccgggtctagttccgtccccgctaccttcttaattttacgagtaaaggttaacttttccggaaacgtcccgtttccccgggttccgggggtttccccccgtttttacgggtttttcgtccggttacccgttcccgtaaccgttaccggtaacctaccggttcccccttaccgtaaacccgtcccgttaccccgttaccccttttaaccacgttaaccgtcgttcggggaccttagggtaaccgggtaggttacggaaccgggtcggtaaggtccgttacggtaaccctttcgtttccggttagttacccgtacggtttgtttaaacgtaggtaaacctttaaacttaaaaacttaacgtttaacttacgggtaagtaacgtttaacgggtgggggtacgaccggggttaacggacgggtccgtaaccggttcgttaacgccgtaaccgaccgacgggtccctcccggtcccggtcggtactacccgtcgtccccgttacccgtcccttccgtacgtagttcgtttaacggccgtatacgg

SEQ ID NO: 97560 - DNA, 821 bp, Homo sapiens
  misc_feature: GYAE6OF02HP72I.41.25.C03.1.454.CMB.1.raw
  modified_base (245)..(245): a, c, t, g, unknown or other
  misc_feature (245)..(245): n is a, c, g, or t
  modified_base (589)..(589): a, c, t, g, unknown or other
  misc_feature (589)..(589): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccatctgtgtcggagtcttcggggaagaccggtaaccctgtcctgccacccgcagcgaggcggcaggcagttgggcagcagcttagtcgngacgtagttcggtccagcgacggccggaccccgggctaggttccctaccccgtcctaacttacgttaaatttacgtaggtaagttacttttacggaacgttacccgttcccgttcggggtttcccccttttggttttccgtcggtaccttccgtacgtcgtaacctccggttacccctacccgtaaccgttcccccgttccccttaccccgtttaaaccactttaccggttacccggtcggggtccttaaaggtaacggtacggttacggaacgggaccgtacggtcgttaacggttaacccttacgtttccgttacggtaacgttacgttctttaacggttanaaacgtttaaactaaaccgttaatttaacggttgttaacgtaagttttaaacgggtcgggtaacgggttaaccgggaaccggttacggggacccgttaccgggtaccgtttaacgggttaaccgcggtaacccgtaacgtcccgtccgggttacccccgttcggtaacctccgtttccgtccccgttaccccacgttcctaacgtacgttaacgacgttacggccttacggg

SEQ ID NO: 97561 - DNA, 656 bp, Homo sapiens
  misc_feature: GYAE6OF02IKUCO.41.25.C03.1.454.CMB.1.raw
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (609)..(609): a, c, t, g, unknown or other
  misc_feature (609)..(609): n is a, c, g, or t
  modified_base (630)..(630): a, c, t, g, unknown or other
  misc_feature (630)..(630): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccatttttatattgacacagcccccactctgtgtcggagtcttcggggaagaccgggtaaccctgtcctgccacccgcagcagcggcagcattggcagcagctatgtgcagttgtccagnagcggcccggnacgttcctcccgtcacgttactaatttatgtaacgtattttaccggaagtacccttccccggttacgggggttcccccctttttcggggttttctcgggtcctaccgtatcggacctacgtccccttaccacctcccgccctacctttacccattactcgtcgggtctacgaagtacggtgaacgggacgacggtcgtacgtaccttaacgtttctaggttccgagtttccttagtagtattaaactaaactagttttatgtagtattaggtgacggggacggaaccgtgggtacgaccgtccgtaggcctcggaaccaggtccctccggcccctcgggttaccnccttcgttccgtccctacccnccttcgacttcggtactcgtaccgtg

SEQ ID NO: 97562 - DNA, 728 bp, Homo sapiens
  misc_feature: GYAE6OF02H1UA9.41.25.C03.1.454.CMB.1.raw
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttcgggcctatttttatattgacacacgccccactctgtgtcggagttcgttggggaagaccggtaaccctgtcctgccaccgnagcagcggcagcagttggcagcacgnttatcgtgntaggttcggttaccagcgacggcccggcccgggtactcgttcccctccgtcaccttactttaatttagtagtaaagttcgttttaaccgaacgtacccgtttcccggtttaccggggtttcccctttttcgggtttctcggaccttccacgtccgtaactccgtcccctaccacctcccgtccccttacccgttacatttctcgtcggtactaggaacggtagtacgggacggacggtacggtacctacggttaacttaccggtttacgtacgtaccgttaacgttcctttaaaggtcttaaagttaaacctaaagtttaatttacgtagtttaagtaaagttaggttacgggacgggtacgggtaacggtacggtaccgtaccgttcgttagccgaaacgtcgaccgtcgcccgtacccgtcgtacctccgtcttcccgtacccctccctacgacttacgtaacgtcgtacgtactacggg

SEQ ID NO: 97563 - DNA, 940 bp, Homo sapiens
  misc_feature: GYAE6OF02F3F0I.41.25.C03.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagccccactctgtgtcggagtcttcggggaagacggtaaccctgtcctgcacccgnagcagcggcagcatggcngcagctatcgtgctagtcggttccagcagccggcccgggcaggttcctccccgtctacttccttaattttactggtaaacttagtttttaccgaaacggtacccttaccccggttcggggggtttacccccctttttccggggttttccgttcgggtcctaccgtacgttccgacctacggttcccctaacccgtaacccttccccggtaccccttacccctttaacccgaattacgtttcccgtacggggtccttaggtaaaccggtaggttacgggaaggggtacccgggtaacgggtacccttacggtaaccgttttaaccccgttttccgttacgggtttacccgttaacgtttaccgttttaaacgttacggtaaactttaaaaccggttaaaaaaccttaaacgtttttagtttacgggtttaagttaaagtttaaaacggggtttcgggggaaccggggttaacggggggtaacccggttaaggggggttacccgggtaacccgggtttacccggttaaacggggttacccgaaaccgggtaaccccgtaaacggggtcccgttccccggtcccccccggtttaccggggtttaccctaaccggtttttccccggttcccccgggttttacccccggtccccccgtttacccgtttacccggttaacttaaccgggtttaaacgtttaccggtacccgtttaaccgggg

SEQ ID NO: 97564 - DNA, 703 bp, Homo sapiens
  misc_feature: GYAE6OF02H4QNZ.41.25.C03.1.454.CMB.1.raw
  modified_base (208)..(208): a, c, t, g, unknown or other
  misc_feature (208)..(208): n is a, c, g, or t
  modified_base (667)..(667): a, c, t, g, unknown or other
  misc_feature (667)..(667): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacagccccactctgtgtcggagtcttcggggaagacggtaaccctgtcctgccacccgnagcagcggcagctattggcagctagctatggtcgactaggtggttccagcgaggcccggccgggctacggttccctcccggtacacttacttaaagtttagtagtaagttacttttaccgaaacgtccgttacccggttcggggttcccctttttcggtttctcggtaccttccgacgtacgtactaccgtccctacctaaccgtccccgtcccttacccttaactacttacgtacgtcggtacttagaacggtagtacgggtacggacggtagtacgtagtaacctttcgttcgttcgtacgttacgttactagtaagtaattaaataaacgtagtttagtagtacgttaagtaacggtggacgggtacggaaccggtaggtcgtacccgtagttacggactaccggaccgtaacggtcctcccgtccccgtggacctaccgttctccccgttacccncccgttccataacgttacggtactcggttacaccgg

SEQ ID NO: 97565 - DNA, 879 bp, Homo sapiens
  misc_feature: GYAE6OF02IQONJ.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttcgggccctattttatattgacacagccccactctgtgtcggagtcgttcggggaagacggtaaccctgtcctgccacccgcagcgagcggacagcgtagttggcgacgcacgtctagtgtcgacgtaggttcggttccaggccgacggcccggcccggctacgtttccgtcccgtactacgttacttaatttagtagtaagttacgtttacgaacgtccgttacccggttccggggtttacccctttttcggttttcgtccggttacctaccgtacgtaccgtaccgtacccgttccccgtaacccgtacccgtccccgttccccttaccccgttaacctaacgtttaccggtccggtacgggtaccgttaagggaacggtagggtacggaacggtacggtacggtctaacggttacctttaccgttcggtcgtcttaaaggttcctttaaggtacgtaaaacttaaacgttaaaaactttacgtttagggttacgttaaggttaaactttaacggggtaccggggggaacggtacggggttaaacccgggtacgggtttacccggaacccgggtttacgtaccggggacccggaaaccgtccgggtaaaccgggtccctcccccgggttacccccgtttacccgggtaccttcccccggtttacttaccccccccgtttaaccccgacccccggttactaaaccggttaacggtttaacttaaccggtttaccgtaccgggttacgggg

SEQ ID NO: 97566 - DNA, 850 bp, Homo sapiens
  misc_feature: GYAE6OF02I1AGA.41.25.C03.1.454.CMB.1.raw
  modified_base (210)..(210): a, c, t, g, unknown or other
  misc_feature (210)..(210): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttggccctattttatattgacacacgccccactctgtgtcggagtcgttacggggaagtacggtaacctcgtcctgcacccgnagcacgcggacagcgtacgttggacaggccaagtccttaagtcgtcgcgaggtttcggttccaagccgcggcccggacccggggcttaaccggttcctccccggttagtaacccctttattaaacttttacgaggttaacgtttacttttacggaaacttcccgttccccggtttcgggttccccctttttcggttttctccggtccttacgtacgtacgtacctaccgttcccctaacgtaccctcccggttccctttaaccctacccgtatttaccgtcggtcggggtactaacgggtaaacggtggtacggtaccgggaacggtacgggtctaacggttaacccgtttacccttggttcgttacccgtagggttttccttaacgtaataaacgtttaaaactaaaccggttaagtttagtttacggtagtttaaaacgttaggtcgggggaacgggtaacggttacgggacgggtccgttaacccgtacgttaacggccgtaccggtaccggaacgggtcccgtttcccggaccccgtttacgggtacccttccggtttacccgtttccccggtacccccgtttaacccgcgtttaaccggtttaaccgtaggtaaagttcccggtaacgttcgggg

SEQ ID NO: 97567 - DNA, 800 bp, Homo sapiens
  misc_feature: GYAE6OF02GJ240.41.25.C03.1.454.CMB.1.raw
  modified_base (286)..(286): a, c, t, g, unknown or other
  misc_feature (286)..(286): n is a, c, g, or t
  modified_base (657)..(657): a, c, t, g, unknown or other
  misc_feature (657)..(657): n is a, c, g, or t
  modified_base (742)..(742): a, c, t, g, unknown or other
  misc_feature (742)..(742): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatattgacacacgccccatcgtgtgtcggagtcgttcggggaagtaccggtaaccctgtccgtgccacccgcagcgagcggacaggccagttcgggcacggccaggtctatggtgactggtcggttccagcgacgccggcccggntacgttcctcccgtctactacttaacgtttagtacggaagttacgttttacgaacgtaccgtccccggttcggggtttcccccttttcgggttttccgtcggtacccgttaccgacgtttccggaaccgtacccggttccctaccccgtaaaccgtccccggttaccccttaccccgttttaacccgatttaaccgttcgggtaccggggtaaccttaggggtaaaccgtaggggttaccgggaaacggggttaccgaggtccgttaacggtaaccgtttacgtttcgttaacgttacgtaccggtttaacttacggtacgtaattaaacgttaaacttagtttagtacggttataaaggttagtacgggngggacggtaaccgtacgggtaccgaacccggttaccgtacgggtctaacgaccggtaacgccggtccgtacccgtcggttaaccnccggttacctccggttacccgtcccttacgtctacgtatacggtttaccaggttacgg

SEQ ID NO: 97568 - DNA, 795 bp, Homo sapiens
  misc_feature: GYAE6OF02FX6YC.41.25.C03.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
tcagtctatactatcacgaccggtgctcgatttagtagtgtagatttgggtttgggaagtagtggagcatctccactatggcctgggctccactactctcaccctcctcgctcactgcacaggttcttgggcccattttatattgacacagccccactctgtgtcggagtcttcggggaagacggtaaccctgtcctgcacccgcagcacgcggnagcattggcngcagctatgtgcgagtcggttaccagcagccggcccgggntacgttccncccgtctaccttacttaatttactagtagtattttacggaaccgtaccgttccccggttcggggttccccctttttcggtttacgttcgggtccttaccgtacgtccgacctacggttccccctacccgtaacgtccccgtccccttacccctttacctacttacgttcgtcgggctaggaacgaggtacggacggacggtcggtacgtacgtacgttaccgttacgtcgtactacggttcttaagttagtaaacttaacttaaacgttaaacgttaacgttgttaacgggttaaatttaaacgggttccggggtaacggggttaaccgggaacccgggttagggggtacccggtaccggttaaccggttacgggaccgtaacccggacccggtaacgttccgggttacccccgcccccggtttacgtcccggtacccgttttacccggtacccgttaccccccgtaccccgttcccgttaaccgttaacggaactttacccgtacggtcccgtaacgggg

SEQ ID NO: 97569 - DNA, 792 bp, Homo sapiens
  misc_feature: GYAE6OF02JMPND.41.25.C03.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttcgggccctattttatattgacacgacgccccatctgtgtcggattcgtggggaataccggtaacctgtcctgccaccgnagccaggcggcagctagtggcagcagtctagtgtcncgtagttcggtaccagctaacggcccggtcccgggnttacgttcctacccgtnacctttactaatttgagaaactttntttaccggaaacgtccgttccggttaccggggtttccccttttcggttttcgcggtcccttaccgtaagttccgacgttcccgtcccctaccgtaaacctcccggtcccttaaaccccgtttgtaacttcgtcccggttagggtccttaggggaaacggtaaggttaccggggaaaccggggacggtcggttacctaggttaaaccctttcgtttccgttacggtacttaacgtttcttaaacgtagtaaaccttaaacttaaaggttaatttcgtacgttcggtaaattacgggttcgggacgggtaacggttaccggttacggtaccggtaaccgttgggttaaccgtcgaaccggtaccgtacgggtccgttccccgtcccgttaaccgtccggttacgttccgtacccttacccgaccccgttgttaacccggtagtttacgtaaccgttagcccgtttaacgggg

SEQ ID NO: 97570 - DNA, 692 bp, Homo sapiens
  misc_feature: GYAE6OF02FWYT4.41.25.C03.1.454.CMB.1.raw
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccagttttatagttgacacacgccccatctgtgtcggatcgttcggggaagtacggtaaccctgtcctgccacccgcagcagcggcagctagttggcagcagctatgtgctagtcggttccagcagcgccggnagttcnccgtcactctattangtaatcttttacgaagtctccggtcgggttcccttttcggtttctcggcttccagttccgacgtacgttccccactaacctcccgtcccgttaccttccgtatactcgtgggtactaggaacgtaggtacggacggtacgacggtctacggtaacttaccgtttcgtcgttcgtacgttccgttaagtacgtaattaacgttaaaacttatttaacgtaggttaacgtaagttacggttcgggacgggtaacggtacccggtagggtccgtaaccgggtccttacgaccgtacgaccggtaacgtccgtcccggtaccctacggtaccgtaaccgttcccgttaccggttcccccgtacccgttcccgtacggttaactaccggtacgtacggtacgtaaccggg

SEQ ID NO: 97571 - DNA, 779 bp, Homo sapiens
  misc_feature: GYAE6OF02I9NYE.41.25.C03.1.454.CMB.1.raw
  modified_base (216)..(216): a, c, t, g, unknown or other
  misc_feature (216)..(216): n is a, c, g, or t
  modified_base (297)..(297): a, c, t, g, unknown or other
  misc_feature (297)..(297): n is a, c, g, or t
  modified_base (626)..(626): a, c, t, g, unknown or other
  misc_feature (626)..(626): n is a, c, g, or t
  modified_base (751)..(751): a, c, t, g, unknown or other
  misc_feature (751)..(751): n is a, c, g, or t
  modified_base (772)..(772): a, c, t, g, unknown or other
  misc_feature (772)..(772): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggccctattttatatttgacacacgccccactctggtgtcggagttcgttagggggaagaccgggtaaccctgtccctgcacccgnacgcagcgcacggctagtggcagcagctatgtgctagtcggtacacgcacggccggccggcgtacgttaccgtccccgtanaccttattaaactttaagacgaaaggttacttttacggaaccttaccttcccggttacgggtttcccctttttcgggttttaccgcggtaccctccgtactaccggtacgtaccgttcccaacccgtaaaccgttccccgcccttaccccttaccgtatttaacttccggacgggttacctaacggaaacgttaggacgggaacgggacgtaacggtcgttaaccgtaactttacccgtttcgttacgtactttaggttacttaaacgttagttaaaaacttaaataaaaccgttaagttttaaacgaagttaataacgtttaaccggngggaaccgggacgggtaaccgtaggtacccgtcgggtaaccgttagggtcgtaaccgaccgtaacgggctcccggtcccgtttccgaacgtccttacctttccggttaccccgtaccgttccctntaaaccgttgtaagttaccgnggtacgg

SEQ ID NO: 97572 - DNA, 737 bp, Homo sapiens
  misc_feature: GYAE6OF02FQNET.41.25.C03.1.454.CMB.1.raw
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccccactctgtgtcggagtcgttcggggaagacggtaaccctgtcctgcacccgcagcagcgcagcattggcagcagtctatgtacgcgtaggttcggtccacggcgacgcccggtacccgggctacgtttcccgccccgttcaccttcgttaattttagtagtaagttattttaacggaacgttacccgttacccggtttccggggtttcccccgttttttacggttttccgtacggtcccttaccgtacttccgtaccgtaaccggtcccccttaaccgacccttcccgtacccctaccccttttaacgacttaacgttcggtcgggtacaacggtaagtaccggtcggaacggtacgtacggtaccgtacgtacctttaacgtccttagtaccgtagttacttatacgtaaataaaccttaacgttaattgttacgtattaaagttcggtagggacgggtacggtaccggtacggtaccgtaccgtacgttacggacctcgaccgacgtacgtcccgtccgtaccggtctacccgtcgttacccgccctccgtactacgtagtcgttactcggtagtccgg

SEQ ID NO: 97573 - DNA, 587 bp, Homo sapiens
  misc_feature: GYAE6OF02GXHOA.41.25.C03.1.454.CMB.1.raw
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattcgacacagccccactcgtgtgtccggagtcttcggggaagacggtaaccctgtcctgccacccgcagcagcggcagcattggcagcagctatgtncagtgtccagcagcgccggnagttctccgtcacttctaattngaagtatttaganacctccgtggtccctttggtttcngctcatcgacnctccctacactccgccctcctacatctcgtcggactagaacgtgtcgacggacgngtactgtaaccttcgttcgtacttcncgttacttagtagtaactaataaacgtntttaagtacgtatagttaagtcgggaggtacggacgtagggtcctaaccgtcgtacggaccaccgaaccgtagtccctccgtcccctacggtcctacgtcccgtacccgtcccgtcctacctcgtacttacggtactacgcgtaacgg

SEQ ID NO: 97574 - DNA, 572 bp, Homo sapiens
  misc_feature: GYAE6OF02J0LM5.41.25.C03.1.454.CMB.1.raw
  modified_base (208)..(208): a, c, t, g, unknown or other
  misc_feature (208)..(208): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagtctatactatcacgaccggtgctcgatttagtagtgtagatttgggtttgggaagtagtggagcatctccactatggcctgggctccactacttctcaccctcctcgctcactgcacaggttcttgggcccattttatattgacacagcccctatctgtgtccggagtcttcggggaagaccggtaaccctgtcctgcacccgnagcagcggcagcattggcagcagtctatgtgcagtggtaccagcagcgccggnagttctccgnctctaattangaatctttgagtacctccgtgggttccctttcggtttctcggctcatccgacagtcccncaactccgcctccctanctancgtggctgagngtgagcgngctgactctntgtcagtctangtaataatagtattagtgtataattaagtggtacggaggacccgtagggtacgaaccggtaccgttacggctaccggacccgtaagggcctcccgtacccgtcgttaccgtacctccgtaccggtttccccacccgttcgttaccgatttacggtaacttcgaccgtacgg

SEQ ID NO: 97575 - DNA, 753 bp, Homo sapiens
  misc_feature: GYAE6OF02GCN2Q.41.25.C03.1.454.CMB.1.raw
  modified_base (557)..(557): a, c, t, g, unknown or other
  misc_feature (557)..(557): n is a, c, g, or t
tcagtctatactatcacgaccggtgctcgatttagtagtgtagatttgggtttgggggcttcagctgtgggcacaagaggcagcactcaggacaatctccagcatggcctggtctcctctcctcctcactctcctcgctcactgcacgagggtcctcgggcccactctgtgctgaccgcacgcccgtccctagagttcgttccggtaccggggggcccccgggcagggtacgggtaccacccgtacttccgtcccgtagcctacggtggggaacgaccgacgactacccaagtacggtaccgggaacaagttacttccgtagacgttcgtacccgtacgttaccggtaaccctaaccgtaccctaccggaaacggaacccaacccgtaaccccctaaagtccctacgtacgtttcgtttaaacgaaactacttcgtcccggtacccttacgggacccggttacctacggtaccttcttcgtacgtcggtacctacggtaacgttcgacgccctacctccgtaccgtcctccgtacgacctcgtacgtcgtcggtccncgtacggtctaaggtagtgtaggtacggttattaagtttacgtacgtacgacgttaccgtcgtaacgtacgaccgtaactcgtaccgtacgttcggtagggttcgggttcgggttccggtacgggtaacggtaccggtaaccgtaggttccgtaaccggtccggttacggtaaccgggtccgtaccggtacccggg

SEQ ID NO: 97576 - DNA, 414 bp, Homo sapiens
  misc_feature: GYAE6OF01BWNZG.35.23.C01.1.454.CMB.1.raw
  modified_base (412)..(414): a, c, t, g, unknown or other
  misc_feature (412)..(414): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctctgggggcacagcggccctgggctgcctggtcaaggctacttccacgatctgtactgagcgggctggcaaggcgcatagnnn

SEQ ID NO: 97577 - DNA, 414 bp, Homo sapiens
  misc_feature: GYAE6OF01C5ICL.35.23.C01.1.454.CMB.1.raw
  modified_base (411)..(414): a, c, t, g, unknown or other
  misc_feature (411)..(414): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactactttgactcctggggccagggaacctggtcaccgtctcagcttccaccaagggcccatcggtcttccccctggcgccctgctccaggagcacctctgggggcacagcggccctggctgcctggtcaaggactacttccacgatctgtactgagcgggctggcaaggcgcatagnnnn

SEQ ID NO: 97578 - DNA, 466 bp, Homo sapiens
  misc_feature: GYAE6OF01CIWBR.35.23.C01.1.454.CMB.1.raw
  modified_base (226)..(226): a, c, t, g, unknown or other
  misc_feature (226)..(226): n is a, c, g, or t
  modified_base (408)..(411): a, c, t, g, unknown or other
  misc_feature (408)..(411): n is a, c, g, or t
  modified_base (413)..(415): a, c, t, g, unknown or other
  misc_feature (413)..(415): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (424)..(425): a, c, t, g, unknown or other
  misc_feature (424)..(425): n is a, c, g, or t
  modified_base (427)..(427): a, c, t, g, unknown or other
  misc_feature (427)..(427): n is a, c, g, or t
  modified_base (429)..(430): a, c, t, g, unknown or other
  misc_feature (429)..(430): n is a, c, g, or t
  modified_base (432)..(433): a, c, t, g, unknown or other
  misc_feature (432)..(433): n is a, c, g, or t
  modified_base (436)..(437): a, c, t, g, unknown or other
  misc_feature (436)..(437): n is a, c, g, or t
  modified_base (440)..(440): a, c, t, g, unknown or other
  misc_feature (440)..(440): n is a, c, g, or t
  modified_base (442)..(443): a, c, t, g, unknown or other
  misc_feature (442)..(443): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (457)..(458): a, c, t, g, unknown or other
  misc_feature (457)..(458): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccgntccaagtctacttgactcctggggccagggaaccctggtcaccgtctcagcttccaccaagggcccatcggtcttccccctggcgccctgctccaggagcacctctggggctacagcggcctgggctgcctggtcaaggctacttcacgatctgtactgagcgggctggcaaggcgcatagnnnntnnntgcngnctnntngnntnntcnntgntnngtcntcntngntcnngntgngtc

SEQ ID NO: 97579 - DNA, 415 bp, Homo sapiens
  misc_feature: GYAE6OF01CTDG8.35.23.C01.1.454.CMB.1.raw
  modified_base (411)..(415): a, c, t, g, unknown or other
  misc_feature (411)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaacctggtcaccgtctcagcttccaccaagggcccatcggtcttcccctggcgccctgctccaggagcacctctgggggcacagcggcctgggctgcctggtcaaggactacttccacgatctgtactgagcgggctggcaaggcgcatagnnnnn

SEQ ID NO: 97580 - DNA, 433 bp, Homo sapiens
  misc_feature: GYAE6OF01DNBID.35.23.C01.1.454.CMB.1.raw
  modified_base (323)..(323): a, c, t, g, unknown or other
  misc_feature (323)..(323): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (407)..(433): a, c, t, g, unknown or other
  misc_feature (407)..(433): n is a, c, g, or t
tcagtacagatcgtcacgaccggtgctcgattagtacacgtgattagggagtggggagatcaatcatagtggaaccacctactacaaccgtccctcaagagtccgagtcaccatatcagtagactcgtccaagaaccagttctccctggagctgagctctgtgaccgccgcggacacggctgtgtattactgtgcgagagcgttcctagcagcggctggccccgctccaagtctactttgactctggggccaggaacctggtcaccgtcgtcagcttccaccaagggccccatacggtcttcccctggcgccctgctccaggngcacctctgggggcacagcggcctgggctgcctggtcaaggctacttcacgatctgtactgagcgggntggcaaggcncatagnnnnnnnnnnnnnnnnnnnnnnnnnnn

SEQ ID NO: 97581 - DNA, 418 bp, Homo sapiens
  misc_feature: GYAE6OF01CIQA5.35.23.C01.1.454.CMB.1.raw
  modified_base (413)..(418): a, c, t, g, unknown or other
  misc_feature (413)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaccctggtcaccgtctcagcttccaccaagggcccatcggtcttccccctggcgccctgctccaggagcacctctgggggcacagcggcctgggctgcctggtcaaggactacttccacgatctgtactgagcgggctggcaaggcgcatagnnnnnn

SEQ ID NO: 97582 - DNA, 418 bp, Homo sapiens
  misc_feature: GYAE6OF01ASMCJ.35.23.C01.1.454.CMB.1.raw
  modified_base (227)..(227): a, c, t, g, unknown or other
  misc_feature (227)..(227): n is a, c, g, or t
  modified_base (413)..(418): a, c, t, g, unknown or other
  misc_feature (413)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaaccctggtcaccgtctcagcttccaccaagggcccatcggtcttccccctggcgccctgctccaggagcacctctggggcacagcggccctgggctgcctggtcaaggactacttccacgatctgtactgagcgggctggcaaggcgcatagnnnnnn

SEQ ID NO: 97583 - DNA, 418 bp, Homo sapiens
  misc_feature: GYAE6OF01BMEXD.35.23.C01.1.454.CMB.1.raw
  modified_base (413)..(418): a, c, t, g, unknown or other
  misc_feature (413)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnnn

SEQ ID NO: 97584 - DNA, 415 bp, Homo sapiens
  misc_feature: GYAE6OF01EGWJF.35.23.C01.1.454.CMB.1.raw
  modified_base (413)..(415): a, c, t, g, unknown or other
  misc_feature (413)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnn

SEQ ID NO: 97585 - DNA, 416 bp, Homo sapiens
  misc_feature: GYAE6OF01DY7TX.35.23.C01.1.454.CMB.1.raw
  modified_base (327)..(327): a, c, t, g, unknown or other
  misc_feature (327)..(327): n is a, c, g, or t
  modified_base (413)..(416): a, c, t, g, unknown or other
  misc_feature (413)..(416): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggancacctctgggggcacagcggccctgggctgcctggtcaaggctacttccacgatctgtactgagcggggctggcaaggcgcatagnnnn

SEQ ID NO: 97586 - DNA, 420 bp, Homo sapiens
  misc_feature: GYAE6OF01CE0MJ.35.23.C01.1.454.CMB.1.raw
  modified_base (227)..(227): a, c, t, g, unknown or other
  misc_feature (227)..(227): n is a, c, g, or t
  modified_base (416)..(420): a, c, t, g, unknown or other
  misc_feature (416)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccaggggaaccctggtcaccgtctcagcttccaccaagggcccatcggtcttccccctggcgccctgctccaggagcacctctgggggcacagcggccctggggctgcctggtcaaggactacttccacgatctgtactgagcgggctggcaaggcgcatagnnnnn

SEQ ID NO: 97587 - DNA, 459 bp, Homo sapiens
  misc_feature: GYAE6OF01D55TI.35.23.C01.1.454.CMB.1.raw
  modified_base (331)..(331): a, c, t, g, unknown or other
  misc_feature (331)..(331): n is a, c, g, or t
  modified_base (415)..(415): a, c, t, g, unknown or other
  misc_feature (415)..(415): n is a, c, g, or t
  modified_base (420)..(427): a, c, t, g, unknown or other
  misc_feature (420)..(427): n is a, c, g, or t
  modified_base (429)..(459): a, c, t, g, unknown or other
  misc_feature (429)..(459): n is a, c, g, or t
tcagtacagatcgtcacgaccggtgctcgattttagtacacgtgattagggagtttgggggagatcaatcatagtggaaccacctactacaacccgtccctcaagagtcgagtcaccatatcagtagactcgtccaaagaaccagttctccctggagctgagtcttctgtgaccgccgtcggacacggctggtgtattactgtgcgagagcgttccttagcagcggctggccccgctccaagtactactttgactcgtggggccagggacctggtcacgtctcagcttccaccaagggcccatcggtcttcccctgcgcctgctccgaggngcacctcgtggggcacagcgccctggctgcctggtcaaggactacttccacgactcgtgtactggagcgggctggcgaaggcgnatagnnnnnnnngnnnnnnnnnnnnnnnnnnnnnnnnnnnnnnn

SEQ ID NO: 97588 - DNA, 421 bp, Homo sapiens
  misc_feature: GYAE6OF01BXD4J.35.23.C01.1.454.CMB.1.raw
  modified_base (227)..(227): a, c, t, g, unknown or other
  misc_feature (227)..(227): n is a, c, g, or t
  modified_base (415)..(421): a, c, t, g, unknown or other
  misc_feature (415)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnnnn

SEQ ID NO: 97589 - DNA, 411 bp, Homo sapiens
  misc_feature: GYAE6OF01CQOI5.35.23.C01.1.454.CMB.1.raw
  modified_base (411)..(411): a, c, t, g, unknown or other
  misc_feature (411)..(411): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactactttgactcctggggccagggaccctggtcaccgtctcagcttccaccaagggcccatcggtcttccccctggcgccctgctccaggagcacctctgggggcacagcggccctgggctgcctggtcaaggctacttccacgatctgtactgagcgggctggcaaggcgcatagn

SEQ ID NO: 97590 - DNA, 414 bp, Homo sapiens
  misc_feature: GYAE6OF01DGBSF.35.23.C01.1.454.CMB.1.raw
  modified_base (228)..(228): a, c, t, g, unknown or other
  misc_feature (228)..(228): n is a, c, g, or t
  modified_base (413)..(414): a, c, t, g, unknown or other
  misc_feature (413)..(414): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgntccaagtactactttgactccgtggggccagggaccctggtcaccgtctcagcttccaccaagggcccatcggtcttcccctggcgccctgctccaggagcacctctggggcacagcggccctgggctgcctggtcaaggactacttccacgatctgtactgagcgggctggcaaggcgcatagnn

SEQ ID NO: 97591 - DNA, 417 bp, Homo sapiens
  misc_feature: GYAE6OF01AS0AO.35.23.C01.1.454.CMB.1.raw
  modified_base (411)..(417): a, c, t, g, unknown or other
  misc_feature (411)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactactttgactcctggggccagggaccctggtcaccgtctcagcttccaccaagggcccatcggtcttcccctggcgccctgctccaggagcacctctgggggcacagcggccctgggctgcctggtcaaggactacttccacgatctgtactgagcgggctggcaaggcgcatagnnnnnnn

SEQ ID NO: 97592 - DNA, 416 bp, Homo sapiens
  misc_feature: GYAE6OF01BTZQ1.35.23.C01.1.454.CMB.1.raw
  modified_base (414)..(416): a, c, t, g, unknown or other
  misc_feature (414)..(416): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnn

SEQ ID NO: 97593 - DNA, 421 bp, Homo sapiens
  misc_feature: GYAE6OF01DN64Z.35.23.C01.1.454.CMB.1.raw
  modified_base (417)..(421): a, c, t, g, unknown or other
  misc_feature (417)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccaggggaaccctggtcaccgtctcagcttccaccaagggcccatcggtcttcccctggccgccctgctccaggagcacctcgtgggggcacagcggccctgggctgcctggtcaaggactacttccacgatctgtactgagcgggctggcaagggcgcatagnnnnn

SEQ ID NO: 97594 - DNA, 415 bp, Homo sapiens
  misc_feature: GYAE6OF01DNBO3.35.23.C01.1.454.CMB.1.raw
  modified_base (412)..(415): a, c, t, g, unknown or other
  misc_feature (412)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggccccatcggtcttcccctggcgccctgctccaggagcacctctgggggcacagcggccctgggctgcctggtcaaggctactccacgatctgtactgagcgggctggcaaggcgcatagnnnn

SEQ ID NO: 97595 - DNA, 421 bp, Homo sapiens
  misc_feature: GYAE6OF01BP3VT.35.23.C01.1.454.CMB.1.raw
  modified_base (226)..(226): a, c, t, g, unknown or other
  misc_feature (226)..(226): n is a, c, g, or t
  modified_base (414)..(421): a, c, t, g, unknown or other
  misc_feature (414)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgntccaagtactactttgactcctggggccagggaaccctggtcaccgtctcagcttccaccaagggccatcggtcttccccctggcgccctgctccaggacgcacctctgggggcacgagcggccctgggctgcctggtcaaggactacttccacgatctgtactgagcgggctggcaaggcgcatagnnnnnnnn

SEQ ID NO: 97596 - DNA, 414 bp, Homo sapiens
  misc_feature: GYAE6OF01ECJW4.35.23.C01.1.454.CMB.1.raw
  modified_base (225)..(225): a, c, t, g, unknown or other
  misc_feature (225)..(225): n is a, c, g, or t
  modified_base (410)..(414): a, c, t, g, unknown or other
  misc_feature (410)..(414): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccntccaagtactactttgactccgtggggccagggaccctggtcaccgtctcagcttccaccaagggcccatcggtcttccccctggcgccctgctccaggagcacctctgggggcacagcggccctgggctgcctggtcaaggctactccacgatctgtactgagcgggctggcaaggcgcatagnnnnn

SEQ ID NO: 97597 - DNA, 589 bp, Homo sapiens
  misc_feature: GYAE6OF01CSD2I.35.23.C01.1.454.CMB.1.raw
  modified_base (227)..(227): a, c, t, g, unknown or other
  misc_feature (227)..(227): n is a, c, g, or t
  modified_base (580)..(580): a, c, t, g, unknown or other
  misc_feature (580)..(580): n is a, c, g, or t
tcagtacagatcgtcacgaccggtgctcgatttagtacacgtgattagggaggttggggagatcaatcatagtggaaccacctactacaaccgtcctcaagagtcgagtccaccatactcagtagactcgtccaagaccagttctccctggagctgagctctgtgaccgccgcgacacggtctgtgtatacgtgtgcgagagtcgttctagcaggcgctcggcccgntacaagtctacttgactcgtgggcaggacctgtcacgtctcagcttccacaagggccatccggtcttccccgtggccgtcctgcctccaggacgcaccgtcgtcggggcacgagccggcctggctgtccgtggtaccaacgggtacttaccgttaccacgtaacgtctacggtacgttaggaacggcggggtaactcgggaccgtaaacgggccgtaacgtaagttacgtagaccgtgttaactgtacgtgtcgtactcgtacagtacgtacgtacgtacgtcgtacgtacgtcgtacgtacgacgtacgacgtacgtacgtacgtacgtacacgtctcgtacgcgtcactanctcgtgtcg

SEQ ID NO: 97598 - DNA, 457 bp, Homo sapiens
  misc_feature: GYAE6OF01DWIT0.35.23.C01.1.454.CMB.1.raw
  modified_base (432)..(457): a, c, t, g, unknown or other
  misc_feature (432)..(457): n is a, c, g, or t
tcagtacagatcgtcacgaccggtgctcgattttagtacacgtgattagggattggggagaagtcaatcatagtggaaccaccctactacaaacccgtccctcaagacgtcgagtcaccattatcagtagactcgtccaagaaccagttcctccctggagctgagctactgtgaccgccgcggacacggctgtgtattactgtgcgagagcgttccgtagcagccggctcggccccgctccgaagtactactttgactccgtggggccagggaacctggtcaccgtcgtcagcttaccaccaagggcccatccggtcttccccctggcgccctgctccaggagccacctcgtggggcacgagcggccctgggctgcctggtcaaggactacgttccacgatctgtactgagcgggctggcaaggcgcatagnnnnnnnnnnnnnnnnnnnnnnnnnn

SEQ ID NO: 97599 - DNA, 419 bp, Homo sapiens
  misc_feature: GYAE6OF01C9TTO.35.23.C01.1.454.CMB.1.raw
  modified_base (326)..(326): a, c, t, g, unknown or other
  misc_feature (326)..(326): n is a, c, g, or t
  modified_base (406)..(406): a, c, t, g, unknown or other
  misc_feature (406)..(406): n is a, c, g, or t
  modified_base (411)..(419): a, c, t, g, unknown or other
  misc_feature (411)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactactttgactcctggggccagggaccctggtcaccgtctcagcttccaccaaggcccatcggtcttcccctggccgccctgctccaggacncacctcgtggggcacagcggccctgggctgcctggtcaaggactactccacgatctgtactgagcgggctggcaaggcgnatagnnnnnnnnn

SEQ ID NO: 97600 - DNA, 418 bp, Homo sapiens
  misc_feature: GYAE6OF01D92I8.35.23.C01.1.454.CMB.1.raw
  modified_base (414)..(418): a, c, t, g, unknown or other
  misc_feature (414)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnn

SEQ ID NO: 97601 - DNA, 420 bp, Homo sapiens
  misc_feature: GYAE6OF01DL71R.35.23.C01.1.454.CMB.1.raw
  modified_base (415)..(420): a, c, t, g, unknown or other
  misc_feature (415)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttcccctggcgccctgcctccaggagcacctctgggggcacagcggccctggggctgcctggtcaaggactacttccacgatctgtactgagcgggctggcaaggcgcatagnnnnnn

SEQ ID NO: 97602 - DNA, 142 bp, Homo sapiens
  misc_feature: GYAE6OF01CXX10.35.23.C01.1.454.CMB.1.raw
  modified_base (131)..(142): a, c, t, g, unknown or other
  misc_feature (131)..(142): n is a, c, g, or t
tcagtacagatcgtcacgaccggtgctcgatttagtacacgtgattagggagttgggcacagcggccctgggctgcctggtcaaggactacttccacgatctgtactgagcgggctggcaaggcgcatagnnnnnnnnnnnn

SEQ ID NO: 97603 - DNA, 417 bp, Homo sapiens
  misc_feature: GYAE6OF01B8FM8.35.23.C01.1.454.CMB.1.raw
  modified_base (226)..(226): a, c, t, g, unknown or other
  misc_feature (226)..(226): n is a, c, g, or t
  modified_base (412)..(417): a, c, t, g, unknown or other
  misc_feature (412)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccntccaagtactactttgactcctggggccagggaaccctggtcaccgtctcagcttccaccaagggcccatcggtcttccccctggcgccctgctccaggagcacctctgggggcacagcggccctgggctgcctggtcaaggctacttccacgatctgtactgagcgggctggcaaggcgcatagnnnnnn

SEQ ID NO: 97604 - DNA, 420 bp, Homo sapiens
  misc_feature: GYAE6OF01A56LZ.35.23.C01.1.454.CMB.1.raw
  modified_base (227)..(227): a, c, t, g, unknown or other
  misc_feature (227)..(227): n is a, c, g, or t
  modified_base (411)..(420): a, c, t, g, unknown or other
  misc_feature (411)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaccctggtcaccgtctcagcttccaccaagggcccatcggtcttcccctggcgccctgctccaggagcacctctgggggcacagcggccctgggctgcctggtcaaggactacttccacgatcgtactgagcgggctggcaaggcgcatagnnnnnnnnnn

SEQ ID NO: 97605 - DNA, 420 bp, Homo sapiens
  misc_feature: GYAE6OF01C93T8.35.23.C01.1.454.CMB.1.raw
  modified_base (414)..(420): a, c, t, g, unknown or other
  misc_feature (414)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctgggggccagggaaccctggtcaccgtctcagcttccaccaagggcccatcggtcttccccctggcgccctgctccaggagcacctctgggggcacagcggccctgggctgcctggtcaaggactacttcacgatctgtactgagcgggctggcaaggcgcatagnnnnnnn

SEQ ID NO: 97606 - DNA, 419 bp, Homo sapiens
  misc_feature: GYAE6OF01DAOC3.35.23.C01.1.454.CMB.1.raw
  modified_base (382)..(382): a, c, t, g, unknown or other
  misc_feature (382)..(382): n is a, c, g, or t
  modified_base (412)..(419): a, c, t, g, unknown or other
  misc_feature (412)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactactttgactccgtggggccagggaacctggtcaccgtctcagcttccaccaagggcccatcggtcttcccctggcgccctgctccaggagcacctctgggggcacagcggcctgggctgcctggtcaaggactacttccacgatcngtactgacgcgggctggcaaggcgcatagnnnnnnnn

SEQ ID NO: 97607 - DNA, 418 bp, Homo sapiens
  misc_feature: GYAE6OF01CDHCK.35.23.C01.1.454.CMB.1.raw
  modified_base (413)..(418): a, c, t, g, unknown or other
  misc_feature (413)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaccctggtcaccgtctcagcttccaccaagggcccatcggtcttccccctggcgccctgctccaggagcacctctgggggcacagcggccctgggctgcctggtcaaggctacttccacgatctgtactgagcgggctggcaaggcgcatagnnnnnn

SEQ ID NO: 97608 - DNA, 461 bp, Homo sapiens
  misc_feature: GYAE6OF01DONQM.35.23.C01.1.454.CMB.1.raw
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (389)..(390): a, c, t, g, unknown or other
  misc_feature (389)..(390): n is a, c, g, or t
  modified_base (393)..(394): a, c, t, g, unknown or other
  misc_feature (393)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (435)..(436): a, c, t, g, unknown or other
  misc_feature (435)..(436): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
tcagtacagatcgtcacgaccggtgctcgatttagtacacgtgattagggagttggggagatcaatcatagtggaaccacctactacaaccgtcctcaagagtcagtcaccatactccagtagactcgtccaagaaccagttctccctggagctgagctctgtgaccgccgcggacacggctgtgtattactgtgcgagagcgttcctagcagcggctcggccccgntccaagtcctactttgactcgtggggaccagggaacctggtcaccgtntcagcttcacaggccatcgtctcccngcncctgctcaggncactgtgggctcagcgcctggctgctggtcagctactcacgatctgtactgagcggtctggcaagtcgctatgnncanncntnctgctgnctncngtnctgctnangtctagntaggctnnttacgntcgacttncgntcngtcgc

SEQ ID NO: 97609 - DNA, 420 bp, Homo sapiens
  misc_feature: GYAE6OF01DQ7ZZ.35.23.C01.1.454.CMB.1.raw
  modified_base (331)..(331): a, c, t, g, unknown or other
  misc_feature (331)..(331): n is a, c, g, or t
  modified_base (416)..(420): a, c, t, g, unknown or other
  misc_feature (416)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcctcgctccaagtactactttgacctccgtggggccagggaaccctggtcaccgtctcagcttccaccaagggcccatcggtcttccccctggcgccctgctccaggacncacctctgggggcacagcggccctgggctgcctggtcaaggactacttcacgatctgtactgagcgggctggcaaggcgcatagnnnnn

SEQ ID NO: 97610 - DNA, 429 bp, Homo sapiens
  misc_feature: GYAE6OF01DGXSE.35.23.C01.1.454.CMB.1.raw
  modified_base (228)..(228): a, c, t, g, unknown or other
  misc_feature (228)..(228): n is a, c, g, or t
  modified_base (422)..(429): a, c, t, g, unknown or other
  misc_feature (422)..(429): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccccgntccaagtacttactttgactccgtggggccagggaaccctggtcaccgtctcagcttccaccaagggcccatcggtcttcccctggccgccctgctccaggactcacctctgggggcacgacgcggccctgggctgcctggtcaaggactacttccacgatctgtactggagcgggctgggcaaggcgcatagnnnnnnnn

SEQ ID NO: 97611 - DNA, 422 bp, Homo sapiens
  misc_feature: GYAE6OF01DQ655.35.23.C01.1.454.CMB.1.raw
  modified_base (416)..(422): a, c, t, g, unknown or other
  misc_feature (416)..(422): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagtactactttgactccgtggggccagggaaccctggtcaccgtctcagcttccaccaagggcccatcggtcttcccctggccgccctgctccaggagcacctctgggggcacgagcggccctggctgcctggtcaaggactacttccacgatctgtactgagcgggctggcaaggcgcatagnnnnnnn

SEQ ID NO: 97612 - DNA, 419 bp, Homo sapiens
  misc_feature: GYAE6OF01BGNHU.35.23.C01.1.454.CMB.1.raw
  modified_base (414)..(419): a, c, t, g, unknown or other
  misc_feature (414)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggccgccctgctccaggagcacctctgggggcacagcggccctgggctgcctggtcaaggactacttccacgatctgtactgagcgggctggcaaggcgcatagnnnnnn

SEQ ID NO: 97613 - DNA, 419 bp, Homo sapiens
  misc_feature: GYAE6OF01CW8L9.35.23.C01.1.454.CMB.1.raw
  modified_base (413)..(419): a, c, t, g, unknown or other
  misc_feature (413)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggccgccctgctccaggagcacctctgggggcacagcggccctggctgcctggtcaaggactactccacgatctgtactgagcgggctggcaaggcgcatagnnnnnnn

SEQ ID NO: 97614 - DNA, 448 bp, Homo sapiens
  misc_feature: GYAE6OF01D7CNA.35.23.C01.1.454.CMB.1.raw
  modified_base (232)..(232): a, c, t, g, unknown or other
  misc_feature (232)..(232): n is a, c, g, or t
  modified_base (422)..(448): a, c, t, g, unknown or other
  misc_feature (422)..(448): n is a, c, g, or t
tcagtacagatcgtcacgaccggtgctcgatttagtacacgtgattagggagttagggggagatcaatcatagtggaaccacctactacaaccccgtccctcaagagtcgagtcaccatactcagtagactcgtccaagaaccagttctccctggagcctgagctctgtgaccgccgcggacacggctgtgtattactgtgcgagagcgttcctagccagcggctggccccntccaagtctacttgactcgtggggccagggaccctggtcaccgtctcagcttccaccaagggcccatcggtcttcccctggcgccctagcctccaggacgcacctcgtgggggcacaggcggccctgggctgccgtggtcaaggctactccgacgatctgtactgagcgggctggcaagggcgcatacgnnnnnnnnnnnnnnnnnnnnnnnnnnn

SEQ ID NO: 97615 - DNA, 416 bp, Homo sapiens
  misc_feature: GYAE6OF01C5VAX.35.23.C01.1.454.CMB.1.raw
  modified_base (409)..(416): a, c, t, g, unknown or other
  misc_feature (409)..(416): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctcggccccgctccaagtactactttgactccgtggggccagggaccctggtcaccgtctcagcttccaccaaggcccatcggtcttcccctggcgccctgctccaggagcacctctgggggcacagcggccctggctgcctggtcaaggctactccacgatctgtactgagcgggctggcaaggcgcatagnnnnnnnn

SEQ ID NO: 97616 - DNA, 539 bp, Homo sapiens
  misc_feature: GYAE6OF01AY7HC.35.23.C01.1.454.CMB.1.raw
  modified_base (227)..(227): a, c, t, g, unknown or other
  misc_feature (227)..(227): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (486)..(486): a, c, t, g, unknown or other
  misc_feature (486)..(486): n is a, c, g, or t
  modified_base (514)..(514): a, c, t, g, unknown or other
  misc_feature (514)..(514): n is a, c, g, or t
tcagtacagatcgtcacgaccggtgctcgatttagtacacgtgattagggagttggggagatcaatcatagtggaaccacctactacaacccgtccctcaagagtcgagtcaccatatcagtagactcgtccaagaaccagttctcctggagctgagctctgtgaccgccgcggacacggctgtgtattactgtgcgagagcgttccttagcagcggctggccccgntaccaagtactactttgactccgtggggccagggaaccctggtcacgtctcagcttccacaacggccatcggtcttccccgtggcgccctgctccaggagcaccgtcgtggggcctacgacgccggcccgtgggacctcggccgtcgggtaccaagggtaccttaccgttccgacgacgtctcgtactggagcgggactggacaaggcgtacagtacgngtcngatnancngcntgngangatcgtctacgtctacgcncgcgcgtcgaacgcgtacgctgtacgcncgtcgcgtctactctctcgtcgtcg

SEQ ID NO: 97617 - DNA, 419 bp, Homo sapiens
  misc_feature: GYAE6OF01BASGV.35.23.C01.1.454.CMB.1.raw
  modified_base (227)..(227): a, c, t, g, unknown or other
  misc_feature (227)..(227): n is a, c, g, or t
  modified_base (411)..(419): a, c, t, g, unknown or other
  misc_feature (411)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaaccctggtcaccgtctcagcttccaccaagggcccatcggtcttcccctggcgccctgctccaggagcacctctggggcacagcggccctgggctgcctggtcaaggctacttccacgatctgtactgagcgggctggcaaggcgcatagnnnnnnnnn

SEQ ID NO: 97618 - DNA, 552 bp, Homo sapiens
  misc_feature: GYAE6OF01A7BYN.35.23.C01.1.454.CMB.1.raw
  modified_base (243)..(243): a, c, t, g, unknown or other
  misc_feature (243)..(243): n is a, c, g, or t
  modified_base (291)..(291): a, c, t, g, unknown or other
  misc_feature (291)..(291): n is a, c, g, or t
  modified_base (371)..(371): a, c, t, g, unknown or other
  misc_feature (371)..(371): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
  modified_base (551)..(551): a, c, t, g, unknown or other
  misc_feature (551)..(551): n is a, c, g, or t
tcagtacagatcgtcacgaccggtgctcgattttagtacacgtgattagggaggttggggagatcaatcatagtggaaccgacctactacaacccgtccctcaagagtccgagtccaccatacttccagtagactcgtcaagaaccagttctccctggagcctgagctctgtgaccgccgcggtacacggctgtgtattacgtgtgcgagagccggttccttagccaggcggactcggccccntaccaagtctactttgactccgtggggcctagggacctggtcaccgtntcagtcttccacgaacgggccagtcggtccttccccgtggccgcctcggccttcccgaaggcgccaccgtcgtggggacncgtagcggtccctgggctcgacgttggacctaagggaccttactaccacgtactcgtggtactcggaaggcggtcgtggaccgtaagcgactagtacggntagngatgcgangtancctaagcatnaancngtcgatcgatcncgcagncgagntcgaattcgntcgctctcgntcatcnc

SEQ ID NO: 97619 - DNA, 490 bp, Homo sapiens
  misc_feature: GYAE6OF01EX7MW.35.23.C01.1.454.CMB.1.raw
  modified_base (171)..(171): a, c, t, g, unknown or other
  misc_feature (171)..(171): n is a, c, g, or t
  modified_base (345)..(345): a, c, t, g, unknown or other
  misc_feature (345)..(345): n is a, c, g, or t
  modified_base (433)..(433): a, c, t, g, unknown or other
  misc_feature (433)..(433): n is a, c, g, or t
  modified_base (435)..(436): a, c, t, g, unknown or other
  misc_feature (435)..(436): n is a, c, g, or t
  modified_base (443)..(459): a, c, t, g, unknown or other
  misc_feature (443)..(459): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (467)..(468): a, c, t, g, unknown or other
  misc_feature (467)..(468): n is a, c, g, or t
  modified_base (470)..(471): a, c, t, g, unknown or other
  misc_feature (470)..(471): n is a, c, g, or t
  modified_base (473)..(473): a, c, t, g, unknown or other
  misc_feature (473)..(473): n is a, c, g, or t
  modified_base (475)..(477): a, c, t, g, unknown or other
  misc_feature (475)..(477): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (486)..(486): a, c, t, g, unknown or other
  misc_feature (486)..(486): n is a, c, g, or t
  modified_base (488)..(489): a, c, t, g, unknown or other
  misc_feature (488)..(489): n is a, c, g, or t
tcagtacagatcgtcacgaccggtgctcgattttagtacacgtgattagggagggttggggagagtcgaatcatagtggaaccgacctactaccaaacccgtccctcgaacgaggtcgagtcaccattactcacgtagactcgtccaaggaaccagttcgtccctgggacnctgagcctctgtgaccgccgcggacacgggctgtggtatttactggtgcgagagcgttccttagccagcggctggccccgctccaagtctactttgactcgtgggaccagggaccctggtcacgtctcagcttccacaggccactcggtcttcccctgcgtcctggctcaggancacctctggggctacagcggcctggctgctgcaggctactccacgactcctgtactgacgcgggctcggcaagggcgacgaagtaggncnngtatcgnnnnnnnnnnnnnnnnngngngngnngnncncnnncncncnncncnnc

SEQ ID NO: 97620 - DNA, 418 bp, Homo sapiens
  misc_feature: GYAE6OF01DS1I8.35.23.C01.1.454.CMB.1.raw
  modified_base (414)..(418): a, c, t, g, unknown or other
  misc_feature (414)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttcccctggcgccctgctccaggagcacctctgggggcacagcggccctgggctgcctggtcaaggactacttccacgatctgtactgagcgggctggcaagggcgcatagnnnnn

SEQ ID NO: 97621 - DNA, 425 bp, Homo sapiens
  misc_feature: GYAE6OF01BDPN4.35.23.C01.1.454.CMB.1.raw
  modified_base (418)..(425): a, c, t, g, unknown or other
  misc_feature (418)..(425): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagcgttccttagcaggcggctggccccgcccaagtactactttgactccgtggggccagggaccctggtcaccgtctcagcttccaccaagggcccatcggtcttccccctggccgccctgcctccaggagcacctctgggggcacagcggccctgggctgcctggtcaaggactacttccacgatctgtactgagcgggctggcaaggcgcagtagnnnnnnnn

SEQ ID NO: 97622 - DNA, 455 bp, Homo sapiens
  misc_feature: GYAE6OF01ATRKP.35.23.C01.1.454.CMB.1.raw
  modified_base (438)..(455): a, c, t, g, unknown or other
  misc_feature (438)..(455): n is a, c, g, or t
tcagtacagatcgtcacgaccggtgctcgatttagtacacgtgatttaggggtaggttggggagatacaatcatagtgggaaccacctactaacaacccgtccctcaagagtcgagtcaccatattcagtagactcgtccaagaaccagttctcccgtggagcgtgagctctgtgaccgccgcggtacacggctgtgtattactgtgcgaggagcgttccgtagcagcggctggccccgctccaagtactactttgacttccgtggggcccaggaacctggtcaccgtctcagcttccaccaagggccccatcggtcttcccccctggaccgccctgccttccaggagcacccgtctgggggcaccagcggccctgggctgcctgggtcaagggctacttccacgatctgtactgagcgggctggcaaggcgcatagnnnnnnnnnnnnnnnnnn

SEQ ID NO: 97623 - DNA, 426 bp, Homo sapiens
  misc_feature: GYAE6OF01A7YRV.35.23.C01.1.454.CMB.1.raw
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
  modified_base (412)..(426): a, c, t, g, unknown or other
  misc_feature (412)..(426): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcgctggccccgntccaagtactactttgactcctggggccagggaccctggtcaccgtctcagcttccacaagggcccatcggtcttccccnggccgccctgctccaggacgcacctcgtgggggcacgagcggccctgggctgctggtcaaggctactccacgatctgtactgagcgggctggcaaggcgacatagnnnnnnnnnnnnnnn

SEQ ID NO: 97624 - DNA, 413 bp, Homo sapiens
  misc_feature: GYAE6OF01AXR0M.35.23.C01.1.454.CMB.1.raw
  modified_base (227)..(227): a, c, t, g, unknown or other
  misc_feature (227)..(227): n is a, c, g, or t
  modified_base (411)..(413): a, c, t, g, unknown or other
  misc_feature (411)..(413): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaaccctggtcaccgtctcagcttccaccaagggcccatcggtcttcccctggcgccctgctccaggagcacctctggggcacagcggccctgggctgcctggtcaaggactacttccacgatctgtactgagcgggctggcaggcgcatagnnn

SEQ ID NO: 97625 - DNA, 415 bp, Homo sapiens
  misc_feature: GYAE6OF01A395Q.35.23.C01.1.454.CMB.1.raw
  modified_base (412)..(415): a, c, t, g, unknown or other
  misc_feature (412)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaaggcccatcggtcttcccctggcgccctgctccaggagcacctctgggggcacagcggccctgggctgcctggtcaaggactacttccacgactctgtactgagcgggctggcaaggcgcatagnnnn

SEQ ID NO: 97626 - DNA, 413 bp, Homo sapiens
  misc_feature: GYAE6OF01BFWHX.35.23.C01.1.454.CMB.1.raw
  modified_base (226)..(226): a, c, t, g, unknown or other
  misc_feature (226)..(226): n is a, c, g, or t
  modified_base (407)..(413): a, c, t, g, unknown or other
  misc_feature (407)..(413): n is a, c, g, or t
tcagtacagatcgtcacgaccggtgctcgatttagtacacgtgattagggattggggagatcaatcatagtggaaccacctactacaaaccgtccctcaagagtcgagtcaccatatcagtagactcgtccaagaaccagttctccctggagctgagctctgtgaccgcgcggacacggctgtgtattactgtgcgagagcgttccttagcagcggctggccccgntccaagtactactttgactcctggggccagggaccctggtcaccgtctcagcttccaccaagggcccatcggtcttcccctggcgccctgctcaggagcacctctggggcacgagcgccctgggctgcctggtcaaggctactccacgatctgtactgagcgggctggcaaggcgcatagnnnnnnn

SEQ ID NO: 97627 - DNA, 421 bp, Homo sapiens
  misc_feature: GYAE6OF01CYGQG.35.23.C01.1.454.CMB.1.raw
  modified_base (313)..(313): a, c, t, g, unknown or other
  misc_feature (313)..(313): n is a, c, g, or t
  modified_base (408)..(408): a, c, t, g, unknown or other
  misc_feature (408)..(408): n is a, c, g, or t
  modified_base (414)..(421): a, c, t, g, unknown or other
  misc_feature (414)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctcggccccgctccaagtactactttgactccgtggggccagggaacctggtcaccgtctcagcttccaccaagggcccatcggtcttcccctggcnccctgctccaggagcacctctgggggcacagccggccctgggctgcctggtcaaggactacttccacgatctgtactgagcgggctggcaaggcncatagnnnnnnnn

SEQ ID NO: 97628 - DNA, 411 bp, Homo sapiens
  misc_feature: GYAE6OF01AVBI6.35.23.C01.1.454.CMB.1.raw
  modified_base (408)..(411): a, c, t, g, unknown or other
  misc_feature (408)..(411): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttcccctggcgccctgctccaggagcacctctggggcacagcggccctgggctgcctggtcaggactactcacgatctgtactgagcgggctggcaaggcgcatagnnnn

SEQ ID NO: 97629 - DNA, 492 bp, Homo sapiens
  misc_feature: GYAE6OF01CZ3IH.35.23.C01.1.454.CMB.1.raw
  modified_base (100)..(100): a, c, t, g, unknown or other
  misc_feature (100)..(100): n is a, c, g, or t
  modified_base (165)..(165): a, c, t, g, unknown or other
  misc_feature (165)..(165): n is a, c, g, or t
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (362)..(362): a, c, t, g, unknown or other
  misc_feature (362)..(362): n is a, c, g, or t
  modified_base (432)..(432): a, c, t, g, unknown or other
  misc_feature (432)..(432): n is a, c, g, or t
  modified_base (451)..(492): a, c, t, g, unknown or other
  misc_feature (451)..(492): n is a, c, g, or t
tcagtacagatcgtcacgaccggtgctcgattagtacacgtgattagggaggttggggagatcaatcatagtggaaaccacctactacaacccgtccctnaagagtccgagtcaccatatcagttagctcgccaagaaccagttctccctggagctgagctctgngaccgccgcggacacggtctgtgtattctgtgcganagcttcctagcaggcgtcnggccccntaccgaagtactactttgactccgtaggggcctaacgggaaccctggtcaccgttcgtcaggcttaccaccgaagggtacccaacgtcggtccttccccgtggccgcccttgcctccgaggacgcaaccgttcgngggggcacaggccggcctggctgcctggtacgaggacgtacttcagtactcgctactgacggcggcgagngaacggcgacttagaagtnnnnnnnnnnnnnnnnnnnnnnnnnnnnnnnnnnnnnnnnnn

SEQ ID NO: 97630 - DNA, 413 bp, Homo sapiens
  misc_feature: GYAE6OF01AZ01G.35.23.C01.1.454.CMB.1.raw
  modified_base (228)..(228): a, c, t, g, unknown or other
  misc_feature (228)..(228): n is a, c, g, or t
  modified_base (376)..(376): a, c, t, g, unknown or other
  misc_feature (376)..(376): n is a, c, g, or t
  modified_base (407)..(413): a, c, t, g, unknown or other
  misc_feature (407)..(413): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccccgntccaagtactactttgactcctggggccagggaccctggtcaccgtctcagcttccaccaagggcccatcggtcttccccctggcgccctgctccaggagcacctctggggcacagcggcctgggctgcctggtcaggctactcacgntctgtactgagcgggctggcaggcgcatagnnnnnnn

SEQ ID NO: 97631 - DNA, 420 bp, Homo sapiens
  misc_feature: GYAE6OF01B3YUS.35.23.C01.1.454.CMB.1.raw
  modified_base (415)..(420): a, c, t, g, unknown or other
  misc_feature (415)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttctagcagcggctggccccgctccaagtactactttgactccgtggggccagggaccctggtcaccgtctcagcttccaccaagggcccatcggtcttccccctggcgccctgcctccaggacgcacctcgtggggcacagccggcctgggctgcctggtcaaggactacttccacgatctgtactgagcgggctggcaagggcgcatagnnnnnn

SEQ ID NO: 97632 - DNA, 417 bp, Homo sapiens
  misc_feature: GYAE6OF01D3EAE.35.23.C01.1.454.CMB.1.raw
  modified_base (414)..(417): a, c, t, g, unknown or other
  misc_feature (414)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagtactactttgactccgtggggccagggaaccctggtcaccgtctcagcttccacaaggcccatcggtcttccccctggcgccctgctccaggagcacctctgggggcacagcggccctgggctgcctggtcaaggactacttccacgatctgtactgagcgggctggcaaggcgcatagnnnn

SEQ ID NO: 97633 - DNA, 433 bp, Homo sapiens
  misc_feature: GYAE6OF01C1F5D.35.23.C01.1.454.CMB.1.raw
  modified_base (310)..(310): a, c, t, g, unknown or other
  misc_feature (310)..(310): n is a, c, g, or t
  modified_base (381)..(381): a, c, t, g, unknown or other
  misc_feature (381)..(381): n is a, c, g, or t
  modified_base (420)..(433): a, c, t, g, unknown or other
  misc_feature (420)..(433): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagtcgttcctagcaggcggctcggccccgctccaagtactactttgactccgtggggcagggaacctggtcaccgtctcagcttccacaggccatcggtctcccctggcncctcgctccagagcacctcgtggggcacgacgcggccgtggctgcctggtcaaggactacttccacgactntcgtactgacggcgggacgtggcaaggcgactagtagannnnnnnnnnnnnn

SEQ ID NO: 97634 - DNA, 482 bp, Homo sapiens
  misc_feature: GYAE6OF01EFJ19.35.23.C01.1.454.CMB.1.raw
  modified_base (232)..(232): a, c, t, g, unknown or other
  misc_feature (232)..(232): n is a, c, g, or t
  modified_base (335)..(335): a, c, t, g, unknown or other
  misc_feature (335)..(335): n is a, c, g, or t
  modified_base (442)..(468): a, c, t, g, unknown or other
  misc_feature (442)..(468): n is a, c, g, or t
  modified_base (470)..(482): a, c, t, g, unknown or other
  misc_feature (470)..(482): n is a, c, g, or t
tcagtacagatcgtcacgaccggtgctcgattttagtacacgtgattagggattgggggaggatcaatcatagtggaaccacctactacaacccgtccctcaagagtcgagtcaccatatcagtagactcgtccaaagaaccagttctccctggagctgagctctgtgaccgtccgcggacacggctgtgtattactgtgcgagagcgttcctagcagcggctcggccccgntccaagtctactttgactctggggccagggaccctggtcaccgtctcagcttccacgaggcccatccggtccttcccccgtggccgccctgcctccgaggacncgtacctcgtgggggcacgaggcggccctgggctgccgtggtccgaaggacctacgttccgacgtactcgtcgtactggacgcggggctggacaaggcgacatacgnnnnnnnnnnnnnnnnnnnnnnnnnnngnnnnnnnnnnnnn

SEQ ID NO: 97635 - DNA, 417 bp, Homo sapiens
  misc_feature: GYAE6OF01DJU6V.35.23.C01.1.454.CMB.1.raw
  modified_base (416)..(417): a, c, t, g, unknown or other
  misc_feature (416)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccaggggaaccctggtcaccgtctcagcttccaccaagggcccatcggtcttccccctggcgccctgctccaggagcacctctgggggcacagcggccctgggctgcctggtcaaggactacttccacgatctgtactgagcggggctggcaaggcgcatagnn

SEQ ID NO: 97636 - DNA, 479 bp, Homo sapiens
  misc_feature: GYAE6OF01ETY2G.35.23.C01.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (446)..(479): a, c, t, g, unknown or other
  misc_feature (446)..(479): n is a, c, g, or t
tcagtacagatcgtcacgaccggtgctcgattttagtacacgtgattagggagttggggagatcaatcatagtggaaccacctactacaacccgtccctcaagagtcgagtccaccatatccagtagactcgtccaagaaccagttctccctggagctgagctctgtgaccgccgcggacacggctgtgtattactgtgcgagagcgttccttagcagcggctggccccgntccaagtactacttgactcgtggggccagggacctggtcaccgtctcagcttcacaaggccatcggtcttcccccnggcgcccctaggcctccgaggacgcacctctgggggcctacgagccggccctgggcctcgccgtcggttcgaagggacctacttccgacgatctggtaccttggaggccgggntgggaccaaggcgcagtagcngangnnnnnnnnnnnnnnnnnnnnnnnnnnnnnnnnnn

SEQ ID NO: 97637 - DNA, 547 bp, Homo sapiens
  misc_feature: GYAE6OF01AKVRC.35.23.C01.1.454.CMB.1.raw
  modified_base (142)..(142): a, c, t, g, unknown or other
  misc_feature (142)..(142): n is a, c, g, or t
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (523)..(524): a, c, t, g, unknown or other
  misc_feature (523)..(524): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
tcagtacagatcgtcacgaccggtgctcgatttagtacacgtgattagggaggttggggagatcaatcatagtggaaccacctactacaacccgtcctcaagagtccgagtcaccatactcagtagactcgtccaagaaccngttctccctggagctgagtctctgtgaccgcgcgacacggctcgtgtattcngtgcgagagcgttctagcagcggctggcccntaccaagtctacgtttgactcgtggggtccaggtaaccctggtcaccgtctcgactccttccaccgaacggtcccaacgtcggtccttccccgcggccgaccctgcctcgacggacgcctaccgtcgtcggggcaacgcggccgccgtgggtctcggccgttggacgtaacggcctaacgttccgaacgacgtcgtacgtacgtcggacgtcgggtctcggtacaaggtcgacctagtacgngctcgancgntgtgctgcaagngcngtacncgtnaacgntngcngcttacatcacnngctgctnaaacnctgcgntcncg

SEQ ID NO: 97638 - DNA, 449 bp, Homo sapiens
  misc_feature: GYAE6OF01EYQTA.35.23.C01.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (427)..(449): a, c, t, g, unknown or other
  misc_feature (427)..(449): n is a, c, g, or t
tcagtacagatcgtcacgaccggtgctcgatttagtacacgtgattagggagttgggggagatcaatcatagtggaaccacctactacaacccgtccctcaagagtcgagtcaccatatcagtagactcgtccaagaaccagtttctccctggagctgtagctctgtgaccgccgcggacacggctgtgtattactgtgcgagngcgttcctagcagcggctggcccccgngtccaagtactactttgactccgtggggccagggacccctggtcaccgtctcagcttccaccaaggcccatcggtcttccccctggcgcccctgcctccgagggagcacctctgggggcacagcggccctgggctgcctggtcaagtactacttccacgactctgtacctgagcgggtctggcaaggcgcataagnnnnnnnnnnnnnnnnnnnnnnn

SEQ ID NO: 97639 - DNA, 541 bp, Homo sapiens
  misc_feature: GYAE6OF01ADBUV.35.23.C01.1.454.CMB.1.raw
  modified_base (229)..(229): a, c, t, g, unknown or other
  misc_feature (229)..(229): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (504)..(541): a, c, t, g, unknown or other
  misc_feature (504)..(541): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagcgttccttagcagcggctggcccccgntccaagtactactttgactccgtggggccagggaaccctggtcaccgtctcagctccaccaaggcccatcggtcttccccctggccgccctgctccgaggacgccacctcgtgggggccacgacggccggcccgtggggcctcggcccgtgggtaccgaaacgggtacccttaaccgttcccgaacggtacttccgtacgttaaccgtcgggaacgggtccggggtaccgttcggggaccggaaacggggcccgacgtaacgttaacggngnngnnnnnnnnnnnnnnnnnnnnnnnnnnnnnnnnnnnnnn

SEQ ID NO: 97640 - DNA, 418 bp, Homo sapiens
  misc_feature: GYAE6OF01ER1TG.35.23.C01.1.454.CMB.1.raw
  modified_base (414)..(418): a, c, t, g, unknown or other
  misc_feature (414)..(418): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgcctccaggagcacctctggggcacagcggccctgggctgcctggtcaaggactacttccacgatctgtactgagcgggctggcaaggcgcatagnnnnn

SEQ ID NO: 97641 - DNA, 421 bp, Homo sapiens
  misc_feature: GYAE6OF01C0D1U.35.23.C01.1.454.CMB.1.raw
  modified_base (415)..(421): a, c, t, g, unknown or other
  misc_feature (415)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtatactgtgcgagagcgttcctagcagcggctggccccgctccaagtactactttgactccgtggggccagggaaccctggtcaccgtctcagcttccaccaaggcccatcggtctcccctggccgcctgctccaggacgcacctcgtcgggggcacgagccggccgtggctgcctggtcaagactactccacgatctgtactgaggcgggctggcgaaggcgacatagnnnnnnn

SEQ ID NO: 97642 - DNA, 499 bp, Homo sapiens
  misc_feature: GYAE6OF01EBVJV.35.23.C01.1.454.CMB.1.raw
  modified_base (479)..(499): a, c, t, g, unknown or other
  misc_feature (479)..(499): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggcccccgctccaagttactactttgactccgtggggccagggaccctggtccaccgtctcacgtccttaccaccgaacgggcccacgtccggttcccttccccccgtggccgtccccgtcgcctccgacggacgcctaccgtcggtcggggccacgacggccggcccgtcgggcctcgccgtcggtacgaacggtactaccttccgacgtactcgtgtacgtgacggcggggtctcgggaccgaagggcacgagtagnnnnnnnnnnnnnnnnnnnnn

SEQ ID NO: 97643 - DNA, 423 bp, Homo sapiens
  misc_feature: GYAE6OF01EC03K.35.23.C01.1.454.CMB.1.raw
  modified_base (322)..(322): a, c, t, g, unknown or other
  misc_feature (322)..(322): n is a, c, g, or t
  modified_base (416)..(423): a, c, t, g, unknown or other
  misc_feature (416)..(423): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggccgcccttcnccaggacgccacctcgtggggcacagccggcctggctcgctggcaaggactacttccacgatctgtaactgagcgggctggcaaggcgcatagnnnnnnnn

SEQ ID NO: 97644 - DNA, 479 bp, Homo sapiens
  misc_feature: GYAE6OF01DUKEN.35.23.C01.1.454.CMB.1.raw
  modified_base (235)..(235): a, c, t, g, unknown or other
  misc_feature (235)..(235): n is a, c, g, or t
  modified_base (333)..(333): a, c, t, g, unknown or other
  misc_feature (333)..(333): n is a, c, g, or t
  modified_base (463)..(463): a, c, t, g, unknown or other
  misc_feature (463)..(463): n is a, c, g, or t
  modified_base (468)..(479): a, c, t, g, unknown or other
  misc_feature (468)..(479): n is a, c, g, or t
tcagtacagatcgtcacgaccggtgctcgatttagtacacgtgattaggggattggggagatcaatcatagtggaaccacctactacaacccggtccctcaagagtcgagtcaccatatcagtagactcgtccaagaaccagttctccctggagctgagctctgtcgacccgccgcggacacggctgtgtattactgtgcgagagcgtttcccttagcagccggctcggccccgntccaacgtactactttgacctccgtggggccaaggggaaccctggtcaccgtctcgacgtccttccaccgaacgggccctagtccggtccttccccgnggccgccctcgcctccgaaggcgtaccaccgtcggtcggggcacgacgggcggtcccgtgggcctcggccgtgggacaacggtcctacgttccacggtatcgtagacgtggacggcggcgtggacaggcncatgnnnnnnnnnnnn

SEQ ID NO: 97645 - DNA, 497 bp, Homo sapiens
  misc_feature: GYAE6OF01EPMX1.35.23.C01.1.454.CMB.1.raw
  modified_base (313)..(313): a, c, t, g, unknown or other
  misc_feature (313)..(313): n is a, c, g, or t
  modified_base (470)..(497): a, c, t, g, unknown or other
  misc_feature (470)..(497): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaccctggtcaccgtctcagcttccaccgaacggcccatccggtccttcccccnggccgccctcgcctccgaggacgccaccgtcgtcgggggcacgacggccggtcccgtgggcctcggccgtgggtaccgaaacgggtaccttaccgttccacgtactcgttagtacgtggacggcggggtcgtcgggacgaagggcgacgagtagcgnnnnnnnnnnnnnnnnnnnnnnnnnnnn

SEQ ID NO: 97646 - DNA, 469 bp, Homo sapiens
  misc_feature: GYAE6OF01CCJR2.35.23.C01.1.454.CMB.1.raw
  modified_base (459)..(469): a, c, t, g, unknown or other
  misc_feature (459)..(469): n is a, c, g, or t
tcagtacagatcgtcacgaccggtgctcgatttagtacacgtgattagggagttggggagatcaatcattagtggaaccacctactaacgaacccggtccctcaacgagtcgagttcaccactactcagtagactcgtccaagaaccagttctccctggagctgagctctgtgaccgccgcggacacggctgtgtattactgtgcgagagcgttccttagcagcggctggcccccgctccaagtactactttgactcctggggccagggaccctggtcaccgtctcagcttccaccaagggcccatccggtccttccccctggccgcccctgcctccaggacgccaccgtcgtcgggggccacgaggccggccccgttggggcctcggccgtgggtccaaagggaccttaccttccacgatcgtgtactggagcggggactgggacaaggcgcagtagnnnnnnnnnnn

SEQ ID NO: 97647 - DNA, 413 bp, Homo sapiens
  misc_feature: GYAE6OF01ARTVR.35.23.C01.1.454.CMB.1.raw
  modified_base (227)..(227): a, c, t, g, unknown or other
  misc_feature (227)..(227): n is a, c, g, or t
  modified_base (409)..(413): a, c, t, g, unknown or other
  misc_feature (409)..(413): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaccctggtcaccgtctcagcttccaccaggcccatcggtctcccctggcgccctgctccaggagcacctcgtggggcacagcggccctggggctgcctggtcaacggactactcacgatctgtactgagcgggctggcaaggcgcatagnnnnn

SEQ ID NO: 97648 - DNA, 419 bp, Homo sapiens
  misc_feature: GYAE6OF01DVVVG.35.23.C01.1.454.CMB.1.raw
  modified_base (309)..(309): a, c, t, g, unknown or other
  misc_feature (309)..(309): n is a, c, g, or t
  modified_base (411)..(419): a, c, t, g, unknown or other
  misc_feature (411)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtccaccgtctcagcttccaccaaggcccatcggtcttccccnggccgcctgctcaggagcacctcgtggggcacgagccggccgtgggctgcctggcaaggactactccagatctgtctgagcgggctggcgaggcgcagtagnnnnnnnnn

SEQ ID NO: 97649 - DNA, 452 bp, Homo sapiens
  misc_feature: GYAE6OF01BMEZY.35.23.C01.1.454.CMB.1.raw
  modified_base (227)..(227): a, c, t, g, unknown or other
  misc_feature (227)..(227): n is a, c, g, or t
  modified_base (442)..(452): a, c, t, g, unknown or other
  misc_feature (442)..(452): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggccagggaaccctggtcaccgtctcagcttccaccaaggcccatcggtccttcccctggccgccctgcctccgaggcgccacctcgtggggccacgagccggccctggggctcgccgtggtcaacggtactacttcccacgtactcgtagtactggacggtcgggccgtgggccgaagggcgacatagnnnnnnnnnnn

SEQ ID NO: 97650 - DNA, 505 bp, Homo sapiens
  misc_feature: GYAE6OF01C39U6.35.23.C01.1.454.CMB.1.raw
  modified_base (478)..(505): a, c, t, g, unknown or other
  misc_feature (478)..(505): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactactttgactccgtggggccagggaaccctggtcaccgtctcagcttccaccaaggcccatcggtcttccccctggccgccctgcctccaggacgcaccctcgtcggggggccaccaggccgggcccgtcggggcctcgcccgtcgggtaccgaacgggtaccttaccgttcccaacgaacgttctacggttacctagggacggcggggcgttcgggcgaaaggggtccgcgataaggcagnnnnnnnnnnnnnnnnnnnnnnnnnnnn

SEQ ID NO: 97651 - DNA, 513 bp, Homo sapiens
  misc_feature: GYAE6OF01BKXHQ.35.23.C01.1.454.CMB.1.raw
  modified_base (225)..(225): a, c, t, g, unknown or other
  misc_feature (225)..(225): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (466)..(467): a, c, t, g, unknown or other
  misc_feature (466)..(467): n is a, c, g, or t
  modified_base (469)..(469): a, c, t, g, unknown or other
  misc_feature (469)..(469): n is a, c, g, or t
  modified_base (471)..(472): a, c, t, g, unknown or other
  misc_feature (471)..(472): n is a, c, g, or t
  modified_base (476)..(482): a, c, t, g, unknown or other
  misc_feature (476)..(482): n is a, c, g, or t
  modified_base (484)..(498): a, c, t, g, unknown or other
  misc_feature (484)..(498): n is a, c, g, or t
  modified_base (500)..(513): a, c, t, g, unknown or other
  misc_feature (500)..(513): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttctagcagcggctggccccncccaagtctactttgacctcgtggggccagggaccctggtcaccgtctcagctccacgaaggcccatcggtccttcccccnggccgcctgcctccgaggcnccacctcgagacgccaacgacggccggcccgtgggggctcggcccgtgggtacgaacgggtccttaccttcccgaacggtacttccgtagtacgtagggacggtaccgggcgtcgggacctaacgggccgacaagtacgnngngnngacnnnnnnncnnnnnnnnnnnnnnngnnnnnnnnnnnnnn

SEQ ID NO: 97652 - DNA, 454 bp, Homo sapiens
  misc_feature: GYAE6OF01C0IUP.35.23.C01.1.454.CMB.1.raw
  modified_base (153)..(153): a, c, t, g, unknown or other
  misc_feature (153)..(153): n is a, c, g, or t
  modified_base (227)..(227): a, c, t, g, unknown or other
  misc_feature (227)..(227): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
  modified_base (420)..(421): a, c, t, g, unknown or other
  misc_feature (420)..(421): n is a, c, g, or t
  modified_base (423)..(454): a, c, t, g, unknown or other
  misc_feature (423)..(454): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcggtccaagaaccagttctccctgganctgagctctgtgaccgccgcggacacggctgtgtattactgtgcgagagcgttcctagcagcggctcggccccntccaagtctactttgactccgtggggccagggaacctggtcaccgtctcagcttccaccaagggcccatcggtctttccccctggcgccctgaccttccaggagcacctcgtgggggcactagcggccgtgggctgcctggtcaaggctactccacgntctgtactgagccgggntggccaaggcgcagtagnnannnnnnnnnnnnnnnnnnnnnnnnnnnnnnnn

SEQ ID NO: 97653 - DNA, 635 bp, Homo sapiens
  misc_feature: GYAE6OF01A1M4M.35.23.C01.1.454.CMB.1.raw
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagtacagatcgtcacgaccggtgctcgattttagtacacgtgattagggaggttggggagatcaatcatagtggaaccacctactacaacccgtccctcaagagtccgagtccaccatatccagttagactcgtccaagaaccagttctccctggagctgagctctgtgaccgccgcgacacggctgtgtattactgtgcgagagcgttccttagccgaggcggactcgggcccctntaccaaagtcctactttgacctcgtggggccagggacctggcacgtntcagtcttccacctaaggcccagtccggtcttccccgnggccncctgcctccgaggacgccacgtcgnggggcacgtaggccggtacccgtgggcttcggaccgttgacgtaacggacttaaccgttccgaacggtacttcgtcgtaaccgtggaacggcggtctaggacgaacgggtcacgtaaagtggancgtatgagtacctgngtccgtagtcctaatcggtaacctaagggctttacggggctttaaccggtcgtacgacgtaccggtaccgtacggtaccgtacgtcgtaacggtagtacggtaccgtacgtaccgacgtcgttacgacgtcgtcgtcgtacg

SEQ ID NO: 97654 - DNA, 420 bp, Homo sapiens
  misc_feature: GYAE6OF01A7XF2.35.23.C01.1.454.CMB.1.raw
  modified_base (227)..(227): a, c, t, g, unknown or other
  misc_feature (227)..(227): n is a, c, g, or t
  modified_base (411)..(420): a, c, t, g, unknown or other
  misc_feature (411)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaccctggtcaccgtctcagcttccaccaaggcccatcggtcttcccctggcgccctgctccaggagcacctctgggggcacagcggccctgggctgcctggcaaggactacgttccacgatctgtactgagcgggctggcaaggcgcatagnnnnnnnnnn

SEQ ID NO: 97655 - DNA, 456 bp, Homo sapiens
  misc_feature: GYAE6OF01CZJ8I.35.23.C01.1.454.CMB.1.raw
  modified_base (448)..(456): a, c, t, g, unknown or other
  misc_feature (448)..(456): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagtactactttgacctccgtggggccaggggacctggtcaccgtctcagcttccaccaacgggcccagtcggtccttcccccgtgccgccctgcctccaggacgccacctcgtcgggggcacgaggccggcccgtggggctcgccgtgggtacaacggtacctacttccgacgactctagtactgaggccgggcgtgggacgaacggcgacatagnnnnnnnnn

SEQ ID NO: 97656 - DNA, 437 bp, Homo sapiens
  misc_feature: GYAE6OF01CDLTG.35.23.C01.1.454.CMB.1.raw
  modified_base (426)..(427): a, c, t, g, unknown or other
  misc_feature (426)..(427): n is a, c, g, or t
  modified_base (429)..(437): a, c, t, g, unknown or other
  misc_feature (429)..(437): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagtactactttgactccgtggggccagggaccctggtcaccgtctcagcttccaccaagggcccatcggtcttcccctggcgccctgctccaggacgcaccgtcgtcgggggcacagcggccctgggctgcctggtcaaggactacttccacgtactctgtactggacgcgggtcgtggcgaagggcgcatagnngnnnnnnnnn

SEQ ID NO: 97657 - DNA, 428 bp, Homo sapiens
  misc_feature: GYAE6OF01B1KWJ.35.23.C01.1.454.CMB.1.raw
  modified_base (413)..(413): a, c, t, g, unknown or other
  misc_feature (413)..(413): n is a, c, g, or t
  modified_base (418)..(428): a, c, t, g, unknown or other
  misc_feature (418)..(428): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccaggggaccctggtcaccgtctcagcttccaccaagggcccatcggtctccccctggcgccctgctccaggagcacctctgggggcacacggcggccctggggctgcctggtcaagggactacttccacgatctgtactgagcgggctggcaagggcgnatagnnnnnnnnnnn

SEQ ID NO: 97658 - DNA, 432 bp, Homo sapiens
  misc_feature: GYAE6OF01D116J.35.23.C01.1.454.CMB.1.raw
  modified_base (153)..(153): a, c, t, g, unknown or other
  misc_feature (153)..(153): n is a, c, g, or t
  modified_base (232)..(232): a, c, t, g, unknown or other
  misc_feature (232)..(232): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (398)..(401): a, c, t, g, unknown or other
  misc_feature (398)..(401): n is a, c, g, or t
  modified_base (403)..(432): a, c, t, g, unknown or other
  misc_feature (403)..(432): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctgganctgagctctgtgaccgccgcggacacggctgtgtacttactgtgcgagagtcgtttccttagcagcggctcgggccccntccaagtactactttgactccgtggggccagggaccctggtcaccgtctcacgctccacaggccatcgtctcccngcncctgctcngncactntgggcncngcgccgtggcngctggcaggactctcacgatcgtgtactgagcgggctggacaacggcgcagtgnnnngnnnnnnnnnnnnnnnnnnnnnnnnnnnnnn

SEQ ID NO: 97659 - DNA, 421 bp, Homo sapiens
  misc_feature: GYAE6OF01EZYUI.35.23.C01.1.454.CMB.1.raw
  modified_base (227)..(227): a, c, t, g, unknown or other
  misc_feature (227)..(227): n is a, c, g, or t
  modified_base (415)..(421): a, c, t, g, unknown or other
  misc_feature (415)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaaccctggtcaccgtctcagcttccaccaagggcccatcggtcttccccctggcgccctgctccaggagcacctctgggggcacagcggccctgggctgcctggtcaagggactacttccacgatctgtactgagcgggctggcaaggcgcatagnnnnnnn

SEQ ID NO: 97660 - DNA, 430 bp, Homo sapiens
  misc_feature: GYAE6OF01AS7ZG.35.23.C01.1.454.CMB.1.raw
  modified_base (412)..(412): a, c, t, g, unknown or other
  misc_feature (412)..(412): n is a, c, g, or t
  modified_base (418)..(430): a, c, t, g, unknown or other
  misc_feature (418)..(430): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaaccctggtcaccgtctcagcttccaccaaggcccatcggtcttccccctggccgccctgctccaggagccacctcgtgggggcacacgcggcccgtgggctgccgtggtcaaggctacttccacgatctgtactgagcgggctggcaggcncatagnnnnnnnnnnnnn

SEQ ID NO: 97661 - DNA, 457 bp, Homo sapiens
  misc_feature: GYAE6OF01CCRKS.35.23.C01.1.454.CMB.1.raw
  modified_base (442)..(444): a, c, t, g, unknown or other
  misc_feature (442)..(444): n is a, c, g, or t
  modified_base (446)..(447): a, c, t, g, unknown or other
  misc_feature (446)..(447): n is a, c, g, or t
  modified_base (449)..(457): a, c, t, g, unknown or other
  misc_feature (449)..(457): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagcgttcctagcagcggctcggccccgctaccaagtactactttgactccgtggggccagggacctgtcacgtctcagcttccaccaagggccactcggtccttcccctggccgcccctgcctccgaggacgccacctcgtggggggccacgacggccggcccgtggggcctcggccgtgggtcaagggacctacgttaccgacgactctagtactgacgcgggctggacaggcgcagtagnnngnngnnnnnnnnn

SEQ ID NO: 97662 - DNA, 537 bp, Homo sapiens
  misc_feature: GYAE6OF01DJX9F.35.23.C01.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (333)..(333): a, c, t, g, unknown or other
  misc_feature (333)..(333): n is a, c, g, or t
  modified_base (500)..(501): a, c, t, g, unknown or other
  misc_feature (500)..(501): n is a, c, g, or t
  modified_base (503)..(505): a, c, t, g, unknown or other
  misc_feature (503)..(505): n is a, c, g, or t
  modified_base (507)..(522): a, c, t, g, unknown or other
  misc_feature (507)..(522): n is a, c, g, or t
  modified_base (524)..(525): a, c, t, g, unknown or other
  misc_feature (524)..(525): n is a, c, g, or t
  modified_base (527)..(537): a, c, t, g, unknown or other
  misc_feature (527)..(537): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaccagttctccctggagctgagctctgtgaccgccgcggacacggctgtgtattactgtgcgagngtcgttcctagcagcggctcggccccgntaccaagttacctactttgacctccggtgggccaagggaccctggtcctaccgtcctctcacgtcctaccacgaacggcccagtccggtcccttccccgtggccnccctgcctccgaggcacctaccgtccggagtacgacgaccgacggcccggtccgtggggacttcggccgttacggacgaaacgggtacttacccgtccgaagtaacttcgttaggtacgtacgggcgacgggtacgtcgggaacgtacgggcacgagtagctgatgnntnnnannnnnnnnnnnnnnnngnnannnnnnnnnnn

SEQ ID NO: 97663 - DNA, 562 bp, Homo sapiens
  misc_feature: GYAE6OF01CI6U1.35.23.C01.1.454.CMB.1.raw
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
  modified_base (422)..(422): a, c, t, g, unknown or other
  misc_feature (422)..(422): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (531)..(531): a, c, t, g, unknown or other
  misc_feature (531)..(531): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
tcagtacagatcgtcacgaccggtgctcgattagtacacgtgattagggagttggggagatcaatcatagtggaaccacctactacaacccgtccctcaagagtccgagtcaccatatcagtagactcgtccaagaaccagttctcccctggagctgagctctgtgaccgccgcggacacggcctgtgtatttactgtgcgagagcgttcctagcagcggctggccccgntccaagtactactttgactcgtgggccaggaaccgtggtcaccgtcgtcagcttaccgaaccaacgggccaactcggtccttcccctggccncctgctccgagcgcacgtcgtcggggcactacgcgccgtgggctcgcgtggtacgaaggtcgtaacgttccgaacgatcgtacgtactagacgaccgggntacgggacaacgggccgacgtaagttacggcttagacagtactacgntaagctaanacananatatagtagtacgcgacgacgtacgtcgtacgtacgacgacgagcgngcgcgacgagtacgtactatancncgcgtcg

SEQ ID NO: 97664 - DNA, 509 bp, Homo sapiens
  misc_feature: GYAE6OF01C5HJT.35.23.C01.1.454.CMB.1.raw
  modified_base (152)..(152): a, c, t, g, unknown or other
  misc_feature (152)..(152): n is a, c, g, or t
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
  modified_base (483)..(483): a, c, t, g, unknown or other
  misc_feature (483)..(483): n is a, c, g, or t
  modified_base (485)..(509): a, c, t, g, unknown or other
  misc_feature (485)..(509): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctgganctgagctctgtgaccgccgcggacacggctgtgttattactgtgcgagagcgttcctagcagcggctcggccccnctcaagtctactttgactccgngggccacgggacctggtcaccgtctcagcttccacgaaggtccatcggtccttccccgtggccgtccctgcctaccgaggacgcacccgtcgtgggggacacgacggtccggccgtcggggcttcggacccgttgggtaccgtaacgggtaccttaccttacccgaacggtacttacgtcgttacttcgggacggtccggggtcgtacgggcgaaacgggcgaccgtagtaagngnnnnnnnnnnnnnnnnnnnnnnnnn

SEQ ID NO: 97665 - DNA, 505 bp, Homo sapiens
  misc_feature: GYAE6OF01DK822.35.23.C01.1.454.CMB.1.raw
  modified_base (216)..(216): a, c, t, g, unknown or other
  misc_feature (216)..(216): n is a, c, g, or t
  modified_base (430)..(430): a, c, t, g, unknown or other
  misc_feature (430)..(430): n is a, c, g, or t
  modified_base (482)..(505): a, c, t, g, unknown or other
  misc_feature (482)..(505): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttctagcagcggntcggccccgctaccaagtcttacttgacctcgtcggggccacgggaaccctggtccaccgtctcacgtccttccaccgaacgggccctacgtccggttccttccccccgtggccgcccctcgcctccgacgggacgcctaccgttcggtcgggggccacgacgggcccggccgtcggggcgtcgcgtggacaacgggtacctaccttcaacgtntccgtgtactggacggtcgggtctgggacgtacgggcacgtaagtcgagcgnnnnnnnnnnnnnnnnnnnnnnnn

SEQ ID NO: 97666 - DNA, 548 bp, Homo sapiens
  misc_feature: GYAE6OF01CY2YI.35.23.C01.1.454.CMB.1.raw
  modified_base (508)..(508): a, c, t, g, unknown or other
  misc_feature (508)..(508): n is a, c, g, or t
  modified_base (510)..(512): a, c, t, g, unknown or other
  misc_feature (510)..(512): n is a, c, g, or t
  modified_base (514)..(548): a, c, t, g, unknown or other
  misc_feature (514)..(548): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagtactactttgactccgtggggccagggaaccctggtcaccgtctcacgcttccaccaagggcccatccggtccttccccctggccgccctcgctcccgaggacgcaccctcgtcggggggcaccgaggcccgggcccgtcggggctcggcccgttgggtccgaaggggtaaccttaccgttcccaaccggtacttccgttacggttaaccgtcggtaacgggccgggggtaccgttggggaccgtaaacggggccggacccgtaagtaaggcngnnngnnnnnnnnnnnnnnnnnnnnnnnnnnnnnnnnnnn

SEQ ID NO: 97667 - DNA, 482 bp, Homo sapiens
  misc_feature: GYAE6OF01BFDWH.35.23.C01.1.454.CMB.1.raw
  modified_base (225)..(225): a, c, t, g, unknown or other
  misc_feature (225)..(225): n is a, c, g, or t
  modified_base (276)..(276): a, c, t, g, unknown or other
  misc_feature (276)..(276): n is a, c, g, or t
  modified_base (468)..(482): a, c, t, g, unknown or other
  misc_feature (468)..(482): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccatttctccctggagctgagctctgtgaccgccgcggacacggctgtgtattactgtgcgagagcgttcctagcagcgctggccccgntccaagtctacttgactccgtggggccagggaccctggtcaccgtctcctnacgcctccaccgaacgggccccatccggtccttccccccgtgggcccgtcccctcgcctccgaggacgccacccgtccgagacgccaacaggccggcccgttgggcctcgccgtggtcaaaggtaccttacttcccgacgtacttccgtagtacgtggacggcggggctgggacgaagggccgacagtacgnnnnnnnnnnnnnnn

SEQ ID NO: 97668 - DNA, 132 bp, Homo sapiens
  misc_feature: GYAE6OF01DF3VZ.35.23.C01.1.454.CMB.1.raw
  modified_base (130)..(132): a, c, t, g, unknown or other
  misc_feature (130)..(132): n is a, c, g, or t
tcagtacagatcgtcacgaccggtgctcgatttagtacacgtgattagggattgggcacagcggccctgggctgcctggtcaaggactacttccacgatctgtactgagcgggctggcaaggcgcatagnnn

SEQ ID NO: 97669 - DNA, 404 bp, Homo sapiens
  misc_feature: GYAE6OF01A7OIC.35.23.C01.1.454.CMB.1.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (361)..(361): a, c, t, g, unknown or other
  misc_feature (361)..(361): n is a, c, g, or t
  modified_base (392)..(404): a, c, t, g, unknown or other
  misc_feature (392)..(404): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggccaggaacctggtcaccgtctcagctcacaaggccatcgtctcccngcgcctgctcagncacctgtggggcacagcggcctggctgctggtcaggctactcacgtanctgtactgagcggctggcaaggcgcatacgnnnnnnnnnnnnn

SEQ ID NO: 97670 - DNA, 698 bp, Homo sapiens
  misc_feature: GYAE6OF01E5GB8.35.23.C01.1.454.CMB.1.raw
  modified_base (201)..(201): a, c, t, g, unknown or other
  misc_feature (201)..(201): n is a, c, g, or t
  modified_base (660)..(662): a, c, t, g, unknown or other
  misc_feature (660)..(662): n is a, c, g, or t
  modified_base (664)..(665): a, c, t, g, unknown or other
  misc_feature (664)..(665): n is a, c, g, or t
  modified_base (667)..(698): a, c, t, g, unknown or other
  misc_feature (667)..(698): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagngtccgttccttagcaggcggcgtcgggcccccgctccaaagttacttaccgttttgaccttccggtcgggggaccctaacgggggaacccccttgggtaccctacccggttccttaccgacggtccctttacccgaaccggaaaccggggcccctacgttcccgggttccccctttcccccccggtcggggccccgtcccccgttcggccccttacccggacgggaccgtcccgtacccggttccgggtcgggggaccaaccggaccgggtcccgggtccccggttcgggggtcccgttccggcccggtttacggggtaaccgaaaacggggtttaacccttaacccgtttacccgaaccggttacgttacccgtttggttaacccgtggggtaaccgggtccgggggtcgttaccggggaccgaaacggggtcccgtacgtaaacggtagcgacacgnnncnngnnnnnnnnnnnnnnnnnnnnnnnnnnnnnnnn

SEQ ID NO: 97671 - DNA, 554 bp, Homo sapiens
  misc_feature: GYAE6OF01DX59A.35.23.C01.1.454.CMB.1.raw
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
  modified_base (328)..(328): a, c, t, g, unknown or other
  misc_feature (328)..(328): n is a, c, g, or t
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
  modified_base (458)..(459): a, c, t, g, unknown or other
  misc_feature (458)..(459): n is a, c, g, or t
  modified_base (463)..(463): a, c, t, g, unknown or other
  misc_feature (463)..(463): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (494)..(494): a, c, t, g, unknown or other
  misc_feature (494)..(494): n is a, c, g, or t
  modified_base (519)..(519): a, c, t, g, unknown or other
  misc_feature (519)..(519): n is a, c, g, or t
tcagtacagatcgtcacgaccggtgctcgattttagtacacgtgattagggattggggagatcaatcatagtggaaccactactacaacccgtcctcaagagtcgagtcaccatatcagtagactcgtccaaggaaccagttctccctggagtctgagctcttagtgaccgcgcggacacggctgtgttattacgtgtgcgagagcgtttcctagcagcggctggcccntccaagtctactttgactccgtggggccaggtacctgtcacgtctcagcttcacaacggccagtccggtccttccccgnggccgccgtgcctcgagganctacctcgtggggctacgaggccgccgtgggcttggcctggacaaggtctaacttccacgtatcgtagtacgttagacggtcggtcngggacgaacggtccgactaaataacggntcagcgtatangacnngtangtncgaacncgtacgactagacgtactacgngtacgacgagagagtacgacgacgngacgtcgacgtacgacgttacgtacgtgtcgtacg

SEQ ID NO: 97672 - DNA, 450 bp, Homo sapiens
  misc_feature: GYAE6OF01BNVMM.35.23.C01.1.454.CMB.1.raw
  modified_base (425)..(425): a, c, t, g, unknown or other
  misc_feature (425)..(425): n is a, c, g, or t
  modified_base (431)..(450): a, c, t, g, unknown or other
  misc_feature (431)..(450): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagtcgttcctagcagcggctcggccccgctccaagtactacttgactccgtggggccagggaaccctggtcaccgtctcagcttccaccaagggcccatcggtccttccccctggccgccctgcctccaggacgccacctcgtcggggcacgagccggcccgtggctgcctggtccgaagacctactcccacgatctgtactggacgcgggcgtggcaaggcganagtagnnnnnnnnnnnnnnnnnnnn

SEQ ID NO: 97673 - DNA, 517 bp, Homo sapiens
  misc_feature: GYAE6OF01BO32N.35.23.C01.1.454.CMB.1.raw
  modified_base (470)..(470): a, c, t, g, unknown or other
  misc_feature (470)..(470): n is a, c, g, or t
  modified_base (479)..(480): a, c, t, g, unknown or other
  misc_feature (479)..(480): n is a, c, g, or t
  modified_base (482)..(517): a, c, t, g, unknown or other
  misc_feature (482)..(517): n is a, c, g, or t
tcagtacagatcgtcacgaccggtgctcgattttagtacacgtgattagggatttgggggagatcaaatcatagtggaacccacctactacaaccccgtccctcaagagtcgagtcaccatatcagtagactcgtccaagaacccagtttctccctggagctgagctctgtgaccgccgcggacacggctgtgtattactgtgcgagagcgttccttagcagcggctggccccgctccaagtctactttgactccgtggggccagggaccctggtcaccgtctcagcttccgaccaacggggccccagtccggtccttcccccgtggccgccctgcctccgagggacgccacctcggtgggggccacgaggcccggccctgggcctcggcccgtgggtaccgaacgggtacctaccttccgacgtacttcgtacgtactggaaggccggggactagggaccaagggtccncgaagtagnnannnnnnnnnnnnnnnnnnnnnnnnnnnnnnnnnnnn

SEQ ID NO: 97674 - DNA, 431 bp, Homo sapiens
  misc_feature: GYAE6OF01D8WEW.35.23.C01.1.454.CMB.1.raw
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (413)..(414): a, c, t, g, unknown or other
  misc_feature (413)..(414): n is a, c, g, or t
  modified_base (416)..(431): a, c, t, g, unknown or other
  misc_feature (416)..(431): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccccgctccaagtaccttactttgacctccgtggggccagggaaccctggtcaccgtctcagctccacaggccatcgtcttccccnggccncctgctcgagngcactcgtggggcacgagcgcccgtggctgcctggcaaggctactccacgatctgtactgacgcgggcgtggacgaaggcgcagtagnncnnnnnnnnnnnnnnnn

SEQ ID NO: 97675 - DNA, 438 bp, Homo sapiens
  misc_feature: GYAE6OF01DYQNM.35.23.C01.1.454.CMB.1.raw
  modified_base (226)..(226): a, c, t, g, unknown or other
  misc_feature (226)..(226): n is a, c, g, or t
  modified_base (430)..(438): a, c, t, g, unknown or other
  misc_feature (430)..(438): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgntccaagtactactttgactccgtggggccagggaaccctggtcaccgtctcagccttccaccaaggccccatcggtccttccccctggccaccctcctccaacgacgccacctcgtcgggggcacacgccggccctcgggctcgccgtggtcgaacggactacttccacgatctgtactgagcgggctggcaaggcgcagtagnnnnnnnnn

SEQ ID NO: 97676 - DNA, 462 bp, Homo sapiens
  misc_feature: GYAE6OF01AZ7W2.35.23.C01.1.454.CMB.1.raw
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (447)..(462): a, c, t, g, unknown or other
  misc_feature (447)..(462): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagttactactttgactccgtggggccacgggaccctggtcaccgtctcagcttccacacggccactcggtcctcccctggccgccctgcctcnggcgccaccgtcgnggggcacgacggccggcccgtggggctcggcctggtacgaacggtacctacttccgaacgtactccgtagtacgtggaggccgggtcgtcgggacgaggcgcagtagnnnnnnnnnnnnnnnn

SEQ ID NO: 97677 - DNA, 440 bp, Homo sapiens
  misc_feature: GYAE6OF01C0X0Q.35.23.C01.1.454.CMB.1.raw
  modified_base (226)..(226): a, c, t, g, unknown or other
  misc_feature (226)..(226): n is a, c, g, or t
  modified_base (427)..(440): a, c, t, g, unknown or other
  misc_feature (427)..(440): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctcggccccntccaagtactactttgactccgtggggccacgggaacctggtcaccgtctcagcttccaccaaggcccatcggtccttcccctggccgccctgcctccaggacgcacctcgtgggggcacgacggcggccctggggctcgccgtgggtcaaggactacttccacgattctgtactgacgcgggctggcgaaggcgcatagnnnnnnnnnnnnnn

SEQ ID NO: 97678 - DNA, 521 bp, Homo sapiens
  misc_feature: GYAE6OF01D7QY4.35.23.C01.1.454.CMB.1.raw
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (431)..(431): a, c, t, g, unknown or other
  misc_feature (431)..(431): n is a, c, g, or t
  modified_base (491)..(491): a, c, t, g, unknown or other
  misc_feature (491)..(491): n is a, c, g, or t
  modified_base (494)..(521): a, c, t, g, unknown or other
  misc_feature (494)..(521): n is a, c, g, or t
tcagtacagatcgtcacgaccggtgctcgatttagtacacgtgattagggattggggagatcaatcatagtggaaccacctactacaacccgtccctcaagagtcgacttaccatatcagtagacacgtctaagaaccagttctccctgaagctgagctctgtgactgccgcggacacggccgtgtattactgtgcgagagattccttactagttgggttcggggagtttattataattatcgcgtcttttgattagtttggggaccaaaggggtacaagtggtcaccgtcttcttcacgccctccaaccgaacgggcccctagtccggtcccttcccccgtggcccgcccctgcctccgaggcnccacctcgagcncacgacgccggcccgtgggctcgccgtggtacgaagtacctacttccgaacgtnttccgtagttaccgtgggacgggtccgggcttaggggactaacggggcgtacgaagtagncgnnnnnnnnnnnnnnnnnnnnnnnnnnnn

SEQ ID NO: 97679 - DNA, 493 bp, Homo sapiens
  misc_feature: GYAE6OF01COTT0.35.23.C01.1.454.CMB.1.raw
  modified_base (461)..(493): a, c, t, g, unknown or other
  misc_feature (461)..(493): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaaccagttctccctggagctgagctctgtgaccgccgcggacacggctgtgtattactgtgcgagagcgttcctagcagcggctcggccccgctccaagtactactttgactccgtggggccagggacctggtcacgtctcagcttccaccaagggccccatccggtccttcccccgtgggccgcccctgcctcccagggacgccaccctcgtgggggccacgacgccggcccgtcggggctcggccctgggtaccgaaggactaccttccacgacttcgtgtactggacggcggggcgtggacgtaacgggcgacgaagtacggnnnnnnnnnnnnnnnnnnnnnnnnnnnnnnnnn

SEQ ID NO: 97680 - DNA, 565 bp, Homo sapiens
  misc_feature: GYAE6OF01BXXFN.35.23.C01.1.454.CMB.1.raw
  modified_base (508)..(508): a, c, t, g, unknown or other
  misc_feature (508)..(508): n is a, c, g, or t
  modified_base (515)..(516): a, c, t, g, unknown or other
  misc_feature (515)..(516): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (528)..(529): a, c, t, g, unknown or other
  misc_feature (528)..(529): n is a, c, g, or t
  modified_base (537)..(541): a, c, t, g, unknown or other
  misc_feature (537)..(541): n is a, c, g, or t
  modified_base (543)..(546): a, c, t, g, unknown or other
  misc_feature (543)..(546): n is a, c, g, or t
  modified_base (548)..(549): a, c, t, g, unknown or other
  misc_feature (548)..(549): n is a, c, g, or t
  modified_base (551)..(565): a, c, t, g, unknown or other
  misc_feature (551)..(565): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagcgttccttagcagcggctcggccccgctccaagtactactttgaccttccgtggggccacgggaccctggtcaccgtctcagcttccaccaaggcccatcggtctcccctggccgccctgcctcaggcgcacctcgtgggggcacgacggccgggccctcgggggctcggcccgttgggtaccaaacgggaccttaacctttcccaacggtacttaccgtttcgttaaacgtcgggtaacgggccgggggttaccgttacggggaccgtaaaaggggcccggtacccgtaaaagtaaccggggtnacgtcgnngnacgcncgtcnncgcgtgcnnnnngnnnncnngnnnnnnnnnnnnnnn

SEQ ID NO: 97681 - DNA, 475 bp, Homo sapiens
  misc_feature: GYAE6OF01CB5ZO.35.23.C01.1.454.CMB.1.raw
  modified_base (229)..(229): a, c, t, g, unknown or other
  misc_feature (229)..(229): n is a, c, g, or t
  modified_base (457)..(475): a, c, t, g, unknown or other
  misc_feature (457)..(475): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctcccctggagctgagctctgtgaccgccgcggacacggctgtgtattactgtgcgagagcgttccttagcagcggctcggccccgntccaagtacctactttgacctccgtggggccagggaacctggtcaccgtctcagcttccaccaacgggccatcggtccttcccctggccgccctgcctccgaggacgcacctcgtgggggcacgacggccggcccgtggggctcgccgttcgggtacgaaacggtacctacctccacgtactcgtagtacgtggacggcggggtcgtcgggacaagggcgacagtagnnnnnnnnnnnnnnnnnnn

SEQ ID NO: 97682 - DNA, 467 bp, Homo sapiens
  misc_feature: GYAE6OF01DT441.35.23.C01.1.454.CMB.1.raw
  modified_base (332)..(332): a, c, t, g, unknown or other
  misc_feature (332)..(332): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
  modified_base (436)..(467): a, c, t, g, unknown or other
  misc_feature (436)..(467): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctcaagtactacttgactccgtggggccagggaccctggtcaccgtctcagccttccaccagggcccagtcgtccttccccctggccgccctgcctccgaggancctacctcggtgggcacaggccggccctgggctgcctggcaaggctacctccacgtntcgtagtactgaggcgggtctgggacgaagggcacgaagtagnagtnnnnnnnnnnnnnnnnnnnnnnnnnnnnnnnn

SEQ ID NO: 97683 - DNA, 424 bp, Homo sapiens
  misc_feature: GYAE6OF01EJ112.35.23.C01.1.454.CMB.1.raw
  modified_base (227)..(227): a, c, t, g, unknown or other
  misc_feature (227)..(227): n is a, c, g, or t
  modified_base (418)..(424): a, c, t, g, unknown or other
  misc_feature (418)..(424): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagcgttcctagcagcggctggccccgntccaagtactactttgactccgtggggccagggaccctggtcaccgtctcagcttccaccaagggccatcggtcttcccctggcgccctgctccaggagcacctcgtggggcacagcggcccgtggctgcctggtcaaggacttacttccacgtatctgtacctgagcgggctggcaagggcgcagtacgnnnnnnn

SEQ ID NO: 97684 - DNA, 540 bp, Homo sapiens
  misc_feature: GYAE6OF01ECRPQ.35.23.C01.1.454.CMB.1.raw
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (499)..(500): a, c, t, g, unknown or other
  misc_feature (499)..(500): n is a, c, g, or t
  modified_base (507)..(507): a, c, t, g, unknown or other
  misc_feature (507)..(507): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagtacagatcgtcacgaccggtgctcgattttagtacacgtgattagggaggttggggagatcaatcatagtggaaccacctactacaacccgtccctcaagagtcgagtcaccatatccagtagactcgtcaagaaccagttctccctggagctgagtctctgtgaccgccgcggacacggctgtgtattactgtgcgagagcgttcctagcaggcggctggccccatccaagtactacttgactcgtggggccaggacctggcaccgtctcatccttacacacggccatcggtccttcccctggccgtacccgtgcctaccgaggacgccacctcgtcggggtacacgacgccggcccgtgggctcgtccgtacgggtacgaacggtaccgttacgttacccgacgtactccgttacggtaacgttgggaacggtccggggctacgggaccgaaggccgactagtagntcganctagactnctancgtacgntcnncagtcangtcnncntcagtngntncactnctncancangn

SEQ ID NO: 97685 - DNA, 510 bp, Homo sapiens
  misc_feature: GYAE6OF01CJ07A.35.23.C01.1.454.CMB.1.raw
  modified_base (144)..(144): a, c, t, g, unknown or other
  misc_feature (144)..(144): n is a, c, g, or t
  modified_base (202)..(202): a, c, t, g, unknown or other
  misc_feature (202)..(202): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (434)..(434): a, c, t, g, unknown or other
  misc_feature (434)..(434): n is a, c, g, or t
  modified_base (470)..(470): a, c, t, g, unknown or other
  misc_feature (470)..(470): n is a, c, g, or t
  modified_base (475)..(489): a, c, t, g, unknown or other
  misc_feature (475)..(489): n is a, c, g, or t
  modified_base (491)..(502): a, c, t, g, unknown or other
  misc_feature (491)..(502): n is a, c, g, or t
  modified_base (504)..(510): a, c, t, g, unknown or other
  misc_feature (504)..(510): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttcnccctggagctgagctctgtgacccgccgcggacacggctgtgtattactgtcgcgagngccgttcctagcaggccgctcggccccgctccaagttccttactttgaccttccgtggggaccacgggaaccctcggtccaccgtctccgaacgtcttaccaccgaacggcctacgtcggtccttccccgtgccncccgtgcctccgngtaccgccnccgtcgtcggggccacgacggtccgccggtcggctcgccgtggtacaaggacctacgtccacgactctgtaccgngacgcggcgtggacacggtcgactagtgcagctgcngagcnnnnnnnnnnnnnnncnnnnnnnnnnnncnnnnnnn

SEQ ID NO: 97686 - DNA, 133 bp, Homo sapiens
  misc_feature: GYAE6OF01BE8KV.35.23.C01.1.454.CMB.1.raw
  modified_base (130)..(133): a, c, t, g, unknown or other
  misc_feature (130)..(133): n is a, c, g, or t
tcagtacagatcgtcacgaccggtgctcgatttagtacacgtgattagggattgggcacagcggccctgggctgcctggtcaaggactacttccacgatctgtactgagcgggctggcaaggcgcatagnnnn

SEQ ID NO: 97687 - DNA, 451 bp, Homo sapiens
  misc_feature: GYAE6OF01D7H8G.35.23.C01.1.454.CMB.1.raw
  modified_base (228)..(228): a, c, t, g, unknown or other
  misc_feature (228)..(228): n is a, c, g, or t
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (420)..(451): a, c, t, g, unknown or other
  misc_feature (420)..(451): n is a, c, g, or t
tcagtacagatcgtcacgaccggtgctcgatttagtacacgtgattagggattgggggagatcaatcatagtggaaccacctactacaaacccgtccctcaagagtcgagtcaccatatcagtagactcgtccaagaaccagttctccctggagctgagctctgtgaccgccgcggacacggctgtgtattactgtgcgagagcgttcctagcagcggctggccccgntccaagtactacttgactcgtggggccagggacctggtcaccgtctcngcttccacaaggccatcgtcttcccctgccgcctgctcaggngcactcgnggggcacgagcggcctggctcgcgtggtacaaggactacttccacgtactctagtactgacggcggggtctgggaccaagggcgtcaagtaggnnnnnnnnnnnnnnnnnnnnnnnnnnnnnnnn

SEQ ID NO: 97688 - DNA, 536 bp, Homo sapiens
  misc_feature: GYAE6OF01DSQLA.35.23.C01.1.454.CMB.1.raw
  modified_base (421)..(421): a, c, t, g, unknown or other
  misc_feature (421)..(421): n is a, c, g, or t
  modified_base (504)..(536): a, c, t, g, unknown or other
  misc_feature (504)..(536): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaaagaaccagttctccctggagctgagctctgtgacccgccgcggacacggctggtgtattacgtgtgcgagagtcgttcctagcaggcggctcggccccgctaccaagttaccttacgtttgacctccggtcgggggccacggggaaccctggtaccaccggttctcagtccttcccgaaccgaacgggcccctacgtcccggttacccttcccccgtcgggcccgtcccctcgcccgttacgacgggtacgcctaccgtcggtcggggccacgcgccggccgtggcncgccgtcggacgaaggtacctacgtccacgactcgtgtactggacggcgggtcggtaggaccgaacgggcgtacgagtagcgnnnnnnnnnnnnnnnnnnnnnnnnnnnnnnnnn

SEQ ID NO: 97689 - DNA, 487 bp, Homo sapiens
  misc_feature: GYAE6OF01AZDZV.35.23.C01.1.454.CMB.1.raw
  modified_base (228)..(228): a, c, t, g, unknown or other
  misc_feature (228)..(228): n is a, c, g, or t
  modified_base (318)..(318): a, c, t, g, unknown or other
  misc_feature (318)..(318): n is a, c, g, or t
  modified_base (456)..(487): a, c, t, g, unknown or other
  misc_feature (456)..(487): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgntccaagtactactttgacctccgtgggggccaggggaacccctggtcaccgtctcagcttccaccaagggcccatccggtccttcccccnggccgcccctgcctccgaggacgccacccgtcgtgggggccacgaggccggcccgtggggcctgccgtggtacaacggactaccttccgacgtatcgtcgtactgacggcgggtcgtggccgaacgggcgcagtacgnnnnnnnnnnnnnnnnnnnnnnnnnnnnnnnn

SEQ ID NO: 97690 - DNA, 725 bp, Homo sapiens
  misc_feature: GYAE6OF01AVFUU.35.23.C01.1.454.CMB.1.raw
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (661)..(661): a, c, t, g, unknown or other
  misc_feature (661)..(661): n is a, c, g, or t
  modified_base (665)..(665): a, c, t, g, unknown or other
  misc_feature (665)..(665): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (683)..(684): a, c, t, g, unknown or other
  misc_feature (683)..(684): n is a, c, g, or t
  modified_base (686)..(686): a, c, t, g, unknown or other
  misc_feature (686)..(686): n is a, c, g, or t
  modified_base (692)..(692): a, c, t, g, unknown or other
  misc_feature (692)..(692): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgacgcctctggtcgacccgccgcggacgcggctgtgtattacgtgtgcgagacgtccgtttacctagcgaggcggcgtccggcccccgacttacccgtaaggttaccttacgttttcggaccgtcccggtacgggggtacccacggggtaaccccgtggtcccacccgttcgtcctaccggtccttacccgaacccgaacggggtcccccacgtttccccgggttcccttcccccccggtgggtcccggccccgttggacccgttaccggaccggtacgtcctaacccgtccggtaccggggggaccaaccggaccggcccgggtccccgtcggggccgtcggtcccgtacgggtaccgaacggtacccgtaccgttacccgtaccgtacgttccgtaacggttacccgagggacccgggtcccgggggtcggttaccgggaaccggtaaccggggacccgtacggtaagttaaccggggnacgngcgngngngngngcgcgcgacncgcncgcncgcgngangngtannanagtagntcgagtgagagtacgacgacgtacacgtcgcgc

SEQ ID NO: 97691 - DNA, 549 bp, Homo sapiens
  misc_feature: GYAE6OF01DH4PP.35.23.C01.1.454.CMB.1.raw
  modified_base (228)..(228): a, c, t, g, unknown or other
  misc_feature (228)..(228): n is a, c, g, or t
  modified_base (510)..(512): a, c, t, g, unknown or other
  misc_feature (510)..(512): n is a, c, g, or t
  modified_base (514)..(536): a, c, t, g, unknown or other
  misc_feature (514)..(536): n is a, c, g, or t
  modified_base (538)..(549): a, c, t, g, unknown or other
  misc_feature (538)..(549): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccnctaccaagtactactttgactccgtggggccacgggaacctggtcaccgtctcacgcttccaccgaacgggcccagtccggtccttcccccgtcggccgccctcggcctccgacggacgcctaccgtcggtcgggggacaccgacggcccgggccgtcgggccgtcggtccgtcgggtacgaacggtaccgttaccgtacccgaacgtcgtcgttagtacgtaggacgggtcggggtaccggttagggacccggtaacggggcccgacgtaagttagacgannncnnnnnnnnnnnnnnnnnnnnnnngnnnnnnnnnnnn

SEQ ID NO: 97692 - DNA, 579 bp, Homo sapiens
  misc_feature: GYAE6OF01B4HOK.35.23.C01.1.454.CMB.1.raw
  modified_base (192)..(192): a, c, t, g, unknown or other
  misc_feature (192)..(192): n is a, c, g, or t
  modified_base (557)..(557): a, c, t, g, unknown or other
  misc_feature (557)..(557): n is a, c, g, or t
  modified_base (559)..(579): a, c, t, g, unknown or other
  misc_feature (559)..(579): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtcaagaaccagttctccctggagctgagctctgtgaccgccgcggacacggctgtgttattacngtgcgagagtcgttactagcagcggctcggccccgctacaacgttacctacgtttcgaccttccggtcggggacccacggggtaaccccgttcggtaccgtaacccggttctaccgacgtcccgtttacccaaccggtaaaccggcccctaacgttccccgggttcccctttcccccccggtcgggtcccgtcccccgtacgtcctcccggacggaccgcctacccgtccgggtcggggacaccgacggcccggtccggtcgggccgtcgtccggtaggtacgtaaccgggaccttaccgtacccgaagttactcgtattacgaggacggtcgggtcgacggtacggaaccggtcgactagtagnannnnnnnnnnnnnnnnnnnnn

SEQ ID NO: 97693 - DNA, 630 bp, Homo sapiens
  misc_feature: GYAE6OF01ACBPJ.35.23.C01.1.454.CMB.1.raw
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaccagttctccctggagctgagctctgtgaccgccgcggacacggctgtgtattactggtgcgagcgtcgttcctagcagcggcctcggccccgctacgaagtactattcgacctcgtgggccacggtacctcgtcgcgtcacnctcctaccgacgacggccncgtccgtcctcccgcggccgtcctcgtccgaccggacggaccgccgtacgtcgggacggacctacggccggtccggtccggtcggtccgtccggtacgtacggtaacgtaaccggtaccttacctacgtacgtacgtacgtacgtacgacgggtacggcggtccggtacggaccgtacggcgtagtaagtgacncgtancgtncgtacnggctaacgcagcgacgacttacgacgacgaccgtacgacggcccttagtcgtacgtacgtacgtacgtaacgtactacgtacgtacgtacgtacgtacgtacgtaagtacgtaacgtacgtacg

SEQ ID NO: 97694 - DNA, 570 bp, Homo sapiens
  misc_feature: GYAE6OF01AY7Q8.35.23.C01.1.454.CMB.1.raw
  modified_base (530)..(531): a, c, t, g, unknown or other
  misc_feature (530)..(531): n is a, c, g, or t
  modified_base (533)..(570): a, c, t, g, unknown or other
  misc_feature (533)..(570): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgtttcctagcagcggctcggcccccgctccaagtaccttacttttcggaccttccggtcgggggccaaggggtaaccccgttggtaccacccgttctccaagtcctttcccaaccgaacggggccccctaacgtccggttcccttccccccgtggcccgcccctgcctccgaggacgccaccgtcggtcgggggccacgacgggcccgggcccgtcgggctcggccgttcgggtacgaaacgggtacctaccgttccaacggtattccgttacgtacgttcgggacgggtccggggtgtcgggacgacggggtaccagtagtacgcnngnnnnnnnnnnnnnnnnnnnnnnnnnnnnnnnnnnnnnn

SEQ ID NO: 97695 - DNA, 487 bp, Homo sapiens
  misc_feature: GYAE6OF01EVEB1.35.23.C01.1.454.CMB.1.raw
  modified_base (454)..(454): a, c, t, g, unknown or other
  misc_feature (454)..(454): n is a, c, g, or t
  modified_base (456)..(487): a, c, t, g, unknown or other
  misc_feature (456)..(487): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcgggcccccgctaccaagtacttactttgacctccgtggggccagggaccctggtcaccgtctcagcttccacacggcccatcggtccttccccctggccgccctgcctccaggacgccacctcgtcgggggcacgacggccggccctggggcctcggcctggtcaaggacctaccgttccacgtactctgtacgtgacggcgggacgtgggaccgaagggccgacgtagtacgngnnnnnnnnnnnnnnnnnnnnnnnnnnnnnnnn

SEQ ID NO: 97696 - DNA, 511 bp, Homo sapiens
  misc_feature: GYAE6OF01BRPHF.35.23.C01.1.454.CMB.1.raw
  modified_base (489)..(511): a, c, t, g, unknown or other
  misc_feature (489)..(511): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagtcgttccttagcagccggctcggcccccgctaccaaagtaccttactttgacctccggtggggccacgggtaaccctggtccaccgtctcgacgcttaccaaccgaacggccctagtccggtccttccccgtggccgtccctcgcctccgaggacgccaccgtggtcggggaccacgcggccggtcccgtgggctcggccgtcgggtacaacggtacctacctccgacgtactcgttacgtacgtcggacgggccgggtcgtcgggacgaagggccgacgagtacgnnnnnnnnnnnnnnnnnnnnnnn

SEQ ID NO: 97697 - DNA, 505 bp, Homo sapiens
  misc_feature: GYAE6OF01DW5B1.35.23.C01.1.454.CMB.1.raw
  modified_base (483)..(505): a, c, t, g, unknown or other
  misc_feature (483)..(505): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcaggcggctcggcccccgctaccaagtaccttactttgaccttccgtggggccacggggaacctggtccaccgtctcacgccttccaccgaacggcccagtccggtccttcccccgtggccgccctgcctccgaggacgccaccgtcgtcggggcacgacggccggcccgtgggctcggccgtagggtacaacggtaccttacttcccgaacggtacttcgtaggttacgtggacggccggggtctcgggacgaacgggccgtacgagtacgnnnnnnnnnnnnnnnnnnnnnnn

SEQ ID NO: 97698 - DNA, 598 bp, Homo sapiens
  misc_feature: GYAE6OF01EVAHY.35.23.C01.1.454.CMB.1.raw
  modified_base (281)..(281): a, c, t, g, unknown or other
  misc_feature (281)..(281): n is a, c, g, or t
  modified_base (560)..(560): a, c, t, g, unknown or other
  misc_feature (560)..(560): n is a, c, g, or t
  modified_base (564)..(598): a, c, t, g, unknown or other
  misc_feature (564)..(598): n is a, c, g, or t
tcagtacagatcgtcacgaccggtgctcgatttagtacacgtgattagggattgggggagatcaatcatagtggaaccacctactacaaccccgtccctcaagagtcgagtcaccatatcagtagactcgtccaagaaccagttctccctggagctgagctctgtgaccgccgcggacacggctgtgtattactgtgcgagagcgttcctagcagcggctcggccccgctcaagtacttacttgactccgtggggccagggtacccgtggtcaccgtctcncgtccttcccaccgaacgggcccctacgtccggtccccgtttccccccgtcgggacccggtccccttacggcccttcccgaacggggacggtacccgtaaccccgttccggtcgggggggccaaccggtacggccccggggccccgttgggggcccgtccggtcccggtcgggttaccgaaacgggtaccttaccgttacccaaccggttacgtccgttacggtacgtcgggtacgggccggggtcgtaccgggaccgaacgggtccgtactagtaggnacgnnnnnnnnnnnnnnnnnnnnnnnnnnnnnnnnnnn

SEQ ID NO: 97699 - DNA, 561 bp, Homo sapiens
  misc_feature: GYAE6OF01BZ8M6.35.23.C01.1.454.CMB.1.raw
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (529)..(561): a, c, t, g, unknown or other
  misc_feature (529)..(561): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtcgaccgccgcggacacggctgtgtattactgtgcgagagtcgttcctagcacgcggctcggcccccgctccaagtaccttacttcgactccggtcggggccgacggaacccgtggtccaccgtctacacgtccttacccaaccgtaacggcctacgtccggtccctttcccccgcggccctacccctcctaccgaagcgacctacccgtcggtcggggccaacgacggtcccggtacccgtgggtccgtcggccgttagggtaccgaacggtaccctttacccgtcccgtacgaacttcgtacggtaacgtcgggacggccggggtacgtccgggacgaacggcgaacgtagtagnacgtnacgtnnnnnnnnnnnnnnnnnnnnnnnnnnnnnnnnn

SEQ ID NO: 97700 - DNA, 576 bp, Homo sapiens
  misc_feature: GYAE6OF01CMM81.35.23.C01.1.454.CMB.1.raw
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (486)..(486): a, c, t, g, unknown or other
  misc_feature (486)..(486): n is a, c, g, or t
  modified_base (528)..(528): a, c, t, g, unknown or other
  misc_feature (528)..(528): n is a, c, g, or t
  modified_base (535)..(536): a, c, t, g, unknown or other
  misc_feature (535)..(536): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (544)..(553): a, c, t, g, unknown or other
  misc_feature (544)..(553): n is a, c, g, or t
  modified_base (556)..(559): a, c, t, g, unknown or other
  misc_feature (556)..(559): n is a, c, g, or t
  modified_base (561)..(564): a, c, t, g, unknown or other
  misc_feature (561)..(564): n is a, c, g, or t
  modified_base (566)..(567): a, c, t, g, unknown or other
  misc_feature (566)..(567): n is a, c, g, or t
  modified_base (569)..(570): a, c, t, g, unknown or other
  misc_feature (569)..(570): n is a, c, g, or t
  modified_base (572)..(575): a, c, t, g, unknown or other
  misc_feature (572)..(575): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctcccctggagcctagagccttctgtgaccgccgcggacacgggctgtgtattactgtgcgngagcgttctagcagcgctggccccntaccaagtacactttgactccgtggggccagggaccctggtcaccgtctacagcttccaccaacggggccacgtcggttaccttccccccgtcggcccgtacccgtgccttccacggcgtaccaccctcggcgggggtcaccgacgggtcccggccggttcggggcctggcccgttaggggtaccaaacgggtaccttaaccgtaccgtaaccggtaagttccgttaaggttccctagggacgggccgggggttacnccggggtaaccaaggggtcccggaacgtagttaaccgtgcancgtgcgnngcnnantnnnnnnnnnntannnngnnnncnncnnannnng

SEQ ID NO: 97701 - DNA, 1008 bp, Homo sapiens
  misc_feature: GYAE6OF01EC9DK.35.23.C01.1.454.CMB.1.raw
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctgggacgtctggagctctgtcgaccgccggcggacacggtctgtagttattactggtgcgagacgtccgttacgttagccgagccggtcgtaccgggcccccgacttacccgtaaagttacctttaccgttttcgacccgttcccgggtacgggggtaccccgtaaacgggggaacccccgtttacggggtacccttaaccccggttcccgttaccgtaaaccggttccccgtttaacccccggaaaccggggtaaacccgggggtcccccgttaacgtttaccccccggggtttacccccgttttaccccccccgggacggggtacccccccggttccccgtttcccggtaccccggtaccccggtaaaccggggtaacccgtcccccggttaaccccggtttaacggggggttcccggggggaacccctaaaaccgggggtaccccgggtacccccggggttacccccggggttgggggtaccccgttaccgggggttcccggttttacgggtaaaaaccccggtaaaccggggtttaacccgtttaaacccccggtttaccccggttaaaaaccggtcccgttttaacccgggtttaaacggttttaacccccggtaaacgggggggtcccggggttaaacccggggtcccggggttaaacccgggggttaaccgggaaaccggggtcccgggggttaaaccctaaaggtttacgggtaccctaagggctaaccgggactacgcgtacgtacgtacgtacgtacgtacgtgacgtacgtcgtcgtacgtagtacgacgtacgtcacgtacgtcgtacgacgtagacgtctacgagcgacgtacagtctcggtcgtacg

SEQ ID NO: 97702 - DNA, 505 bp, Homo sapiens
  misc_feature: GYAE6OF01AHJKD.35.23.C01.1.454.CMB.1.raw
  modified_base (482)..(483): a, c, t, g, unknown or other
  misc_feature (482)..(483): n is a, c, g, or t
  modified_base (485)..(505): a, c, t, g, unknown or other
  misc_feature (485)..(505): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcaggcggctcggccccgctccaagtactactttgacctccgtggggccacgggacccgtggtccaccgtctcagccttccaccgacggcccagtccggtcccttcccccgtggccgcccctgcctccgacgggacgaccgtacccgtcggtcggggccacgacggcccggcccgtcggggccgtcggccgtcggtacgtaacgggtaccttaccgttcccacgtacgtcgttacgtacgtggacgggcgggacgtggacgaggcgcagtgnngnnnnnnnnnnnnnnnnnnnnn

SEQ ID NO: 97703 - DNA, 665 bp, Homo sapiens
  misc_feature: GYAE6OF01EJQD7.35.23.C01.1.454.CMB.1.raw
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
  modified_base (539)..(539): a, c, t, g, unknown or other
  misc_feature (539)..(539): n is a, c, g, or t
  modified_base (557)..(557): a, c, t, g, unknown or other
  misc_feature (557)..(557): n is a, c, g, or t
  modified_base (661)..(661): a, c, t, g, unknown or other
  misc_feature (661)..(661): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagtcgttcctagcagcgctcggccccgntaccaagtcctactttgactccgtggggccagggtaccctggtccacgtctcagtccttaccgacgaacggcccctagttcccggtccctttcccccgnggcccgcccgtgcctccgaggcgcctaccgtcggtcggggacctcgaccggccggtcccgtcgggtacgtccggtccgttcgggtaaccgtaacggtacccttaccgttcccgaacgttacgttccgtaacggttaccgttacgggtaaccggtcggggtaccggttacggaacccgggtaaacggggtccgtaaccgttaaggttaaccggngtacgtacgcgtcgtacncgtcgcgtcgctcgcgtcgtacgtgtcgtacgcgtcgtacgtacgtacgtgtacgtcgtcgacgtcgtacgtacgtcgacgtagtacgtacgtacgtagcgtgngtcg

SEQ ID NO: 97704 - DNA, 453 bp, Homo sapiens
  misc_feature: GYAE6OF01A6AHW.35.23.C01.1.454.CMB.1.raw
  modified_base (134)..(134): a, c, t, g, unknown or other
  misc_feature (134)..(134): n is a, c, g, or t
  modified_base (432)..(453): a, c, t, g, unknown or other
  misc_feature (432)..(453): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaanaaccgagttctccctggagctgagctctgtgaccgccgcggacacggctgtgtattactgtgcgagagcgttccttagcagcggctcggcccccgctccaagtacctactttgactccgtggggccagggaaccctggtcaccgtctcagcttccaccaggcccatcggtccttcccctggccgccctgcctccgaggcgcacctcgtggggcacgagccggccctgggctgcctggtcaaggactactccacgtactctcgtactggaggcgggcgtggacgaagggtcgcgatcgnnnnnnnnnnnnnnnnnnnnnn

SEQ ID NO: 97705 - DNA, 721 bp, Homo sapiens
  misc_feature: GYAE6OF01E1TEY.35.23.C01.1.454.CMB.1.raw
  modified_base (162)..(162): a, c, t, g, unknown or other
  misc_feature (162)..(162): n is a, c, g, or t
  modified_base (186)..(186): a, c, t, g, unknown or other
  misc_feature (186)..(186): n is a, c, g, or t
  modified_base (632)..(632): a, c, t, g, unknown or other
  misc_feature (632)..(632): n is a, c, g, or t
  modified_base (640)..(641): a, c, t, g, unknown or other
  misc_feature (640)..(641): n is a, c, g, or t
  modified_base (643)..(643): a, c, t, g, unknown or other
  misc_feature (643)..(643): n is a, c, g, or t
  modified_base (648)..(648): a, c, t, g, unknown or other
  misc_feature (648)..(648): n is a, c, g, or t
  modified_base (658)..(659): a, c, t, g, unknown or other
  misc_feature (658)..(659): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (691)..(691): a, c, t, g, unknown or other
  misc_feature (691)..(691): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggacgctgagctcngtgaccgccgcggacacggcttgngtattactgtgcgagagcgttccttagcagcggctcggccccgctacctaacgtactaccttttgaccgtccgtggggtcccaggggtaaccctggcctaccggtctacacgtccttacccgaaccgaaacgggcccctacgttccggttacccttccccccgttcggccgttccccgtacgcccgttcccgaagggaccgtacccgtaacccgtccgggttcgggaacccgaaaccgtacggccccgggtaccccggtacggggccgtttccggacccgtttcgggtaaaccccggtaaaacgggtacccctttaacccgttacccggtaaccgtaacgtttcccgtttaacggttaacccggttacgggaacgggttcccggggttacccgtcgggtaaacccgtaaccggggaccgaccggttaaaggtacgggccaggtacncgacgcanncnctacncgacgacacnncgtacacacgacncncgcncgtcncncgacanactcgcgcacgtcgacgacgcgtgtgtacg

SEQ ID NO: 97706 - DNA, 180 bp, Homo sapiens
  misc_feature: GYAE6OF01DAT56.35.23.C01.1.454.CMB.1.raw
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgcgcggacngctn

SEQ ID NO: 97707 - DNA, 564 bp, Homo sapiens
  misc_feature: GYAE6OF01CD4QN.35.23.C01.1.454.CMB.1.raw
  modified_base (232)..(232): a, c, t, g, unknown or other
  misc_feature (232)..(232): n is a, c, g, or t
  modified_base (521)..(521): a, c, t, g, unknown or other
  misc_feature (521)..(521): n is a, c, g, or t
  modified_base (526)..(528): a, c, t, g, unknown or other
  misc_feature (526)..(528): n is a, c, g, or t
  modified_base (530)..(533): a, c, t, g, unknown or other
  misc_feature (530)..(533): n is a, c, g, or t
  modified_base (536)..(557): a, c, t, g, unknown or other
  misc_feature (536)..(557): n is a, c, g, or t
  modified_base (559)..(564): a, c, t, g, unknown or other
  misc_feature (559)..(564): n is a, c, g, or t
tcagtacagatcgtcacgaccggtgctcgatttagtacacgtgatttagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgtttccttagcagcggctcggcccccgntccaagtactactttgactccgtggggccagggaacctggtcaccgtctcacgtccttcccaccgaacgggcccacgtccggttcccttccccccgtggccgtcccctcgtcctccgacgggacgcctacccgtcggttacgggggccacgacgggccgggccccggtggggaccgtcggcccgtgggtaccgaacgggtacccttaccgttacccgaacgtacgtccttaggttacgttggaccgggcgggtcgtcgggacgtaacgggaccgcgtaaagtcgtgagnagcgnnngnnnngcnnnnnnnnnnnnnnnnnnnnnncnnnnnn

SEQ ID NO: 97708 - DNA, 682 bp, Homo sapiens
  misc_feature: GYAE6OF01BKB4K.35.23.C01.1.454.CMB.1.raw
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (582)..(582): a, c, t, g, unknown or other
  misc_feature (582)..(582): n is a, c, g, or t
  modified_base (591)..(591): a, c, t, g, unknown or other
  misc_feature (591)..(591): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (649)..(649): a, c, t, g, unknown or other
  misc_feature (649)..(649): n is a, c, g, or t
  modified_base (671)..(671): a, c, t, g, unknown or other
  misc_feature (671)..(671): n is a, c, g, or t
  modified_base (675)..(675): a, c, t, g, unknown or other
  misc_feature (675)..(675): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagacctggagctctgtgaccgccgcggacacggctgtgtattactgtgcgagagcgtttacctaggactaggcggactgggcccccntaccaagtaccttacgtttnaccgtcgtggggaccaacggggaacccttggaccaccgttcgtaccagtcctttaccgaaccgaacgggccccgtaacgttaccggttcccctttaccccccgtcggccggtccccgttacggtcccgtaacccgtaggtaaccggacctaccccgtacgggtccgggggactaccgtaacggccgggtaaccccgtcggggaaccctggaccgttcgggtaaccaaacggggtacccttaaccgttaccgtaacgtacgttacttcggtaaacgtcgggagtacgggtacgacggtaccgaaacggtccgacaaagtacgtaanacgataggntaaccnacanacatacacncgagananacgctcgananagtacgcgagtacgcacganactacgacgacgacgtaactanagancagtacg

SEQ ID NO: 97709 - DNA, 617 bp, Homo sapiens
  misc_feature: GYAE6OF01CXL4B.35.23.C01.1.454.CMB.1.raw
  modified_base (152)..(152): a, c, t, g, unknown or other
  misc_feature (152)..(152): n is a, c, g, or t
  modified_base (352)..(352): a, c, t, g, unknown or other
  misc_feature (352)..(352): n is a, c, g, or t
  modified_base (541)..(541): a, c, t, g, unknown or other
  misc_feature (541)..(541): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (592)..(617): a, c, t, g, unknown or other
  misc_feature (592)..(617): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctgganctgagctctgtcgaccgccgcggacacggctgtgtattactgtgcgagagcgtttcctagcaggcggctccggcccgctaccgaagttactactttgacctccggtggggacctacggggaacccttgggtccacccgttcgccaacgtccttaccaaccgaacggccctagttcccggttccccttccccgcgggcccnccgtacgcctaccgacggtacgtccaccgtcgggtcggggacaccgtacggcccgggtccgccggggtctccggaccgtggtaccgtaaacgggtaccttaccggtccaaccgtacgtttaccggttacggtaaccggttacggaccgggttccggggtaacgtcccggggaaaacgccggggtaaccncgggtaaacgtgcgagcgtcaagtnaacgngacttgntnaacggtntcntnnnnnnnnnnnnnnnnnnnnnnnnnn

SEQ ID NO: 97710 - DNA, 686 bp, Homo sapiens
  misc_feature: GYAE6OF01A1I2C.35.23.C01.1.454.CMB.1.raw
  modified_base (211)..(211): a, c, t, g, unknown or other
  misc_feature (211)..(211): n is a, c, g, or t
  modified_base (609)..(609): a, c, t, g, unknown or other
  misc_feature (609)..(609): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (630)..(631): a, c, t, g, unknown or other
  misc_feature (630)..(631): n is a, c, g, or t
  modified_base (634)..(634): a, c, t, g, unknown or other
  misc_feature (634)..(634): n is a, c, g, or t
  modified_base (642)..(642): a, c, t, g, unknown or other
  misc_feature (642)..(642): n is a, c, g, or t
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (654)..(654): a, c, t, g, unknown or other
  misc_feature (654)..(654): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (668)..(669): a, c, t, g, unknown or other
  misc_feature (668)..(669): n is a, c, g, or t
  modified_base (672)..(672): a, c, t, g, unknown or other
  misc_feature (672)..(672): n is a, c, g, or t
  modified_base (677)..(678): a, c, t, g, unknown or other
  misc_feature (677)..(678): n is a, c, g, or t
  modified_base (682)..(682): a, c, t, g, unknown or other
  misc_feature (682)..(682): n is a, c, g, or t
  modified_base (684)..(685): a, c, t, g, unknown or other
  misc_feature (684)..(685): n is a, c, g, or t
tcagtacagatcgtcacgaccggtgctcgattttagtacacgtgattagggattggggagatcaatcatagtcggaaccacctactacaacccgtccctcaagagtcgagtcaccatatcagtagactcgtccaaagaaccagttcctccctggagctgagcttcgtgtcgacccggccgcgacgacggctgtagtattactgtgacgagngtccgttctgcgagcgctccggccccgctaccgtaaagttacttacctttcgaccgtccggttccgggaccgtaccgggtacccgtcggtcccgaccgttctaccgacgtcccgttacccaccgtaccgggccctacgtaccggttccccttcccgccggcccgtccctcgccctaccggacggtacctcccgtaccgttcgggccgggtaccgaaccgccgggtccccgggcccggtcggggttcctccggtacccgggttaggacggtaaaccgaccgtttaacccgtaccgtaaccgttacggtacttacggttaccgggttaggaccccgggggtccggggtacggttaccggggaaaccgttaccgggtacccggtaacgtaaaggtccgaanaccggtgcncgngngngngcnngtntctcgagngacnctncncgngcatctgngnancnncgnagtgnntcgngnng

SEQ ID NO: 97711 - DNA, 687 bp, Homo sapiens
  misc_feature: GYAE6OF01CC1I8.35.23.C01.1.454.CMB.1.raw
  modified_base (221)..(221): a, c, t, g, unknown or other
  misc_feature (221)..(221): n is a, c, g, or t
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
  modified_base (644)..(645): a, c, t, g, unknown or other
  misc_feature (644)..(645): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
  modified_base (654)..(656): a, c, t, g, unknown or other
  misc_feature (654)..(656): n is a, c, g, or t
  modified_base (659)..(687): a, c, t, g, unknown or other
  misc_feature (659)..(687): n is a, c, g, or t
tcagtacagatcgtcacgaccggtgctcgatttagtacacgtgattagggagttgggggagatcaatcatagtggaaccacctactacaacccgtccctcaagagtcgagtcaccatatcagtagactcgtaccaaagaaccagttcctcccgtggagctgagctctggtcgaccggccgcggacacggctgtgttattctgtgcgagcgtcgttctagcnggcggcgtccggcccctctaccaacgttaccttaccgttcgaccgtccggtcggggaccgaacggggtaacccttcggtacccgtaccgttctcgaccgtcccttacccgaaccggaaccgggtcccctacggtttccccggttcccccgtttcccccggtcgggtccccgccccgttcggcccgtacccggaacggaccgtcccgtaacccggttcgggtcgggggaccaaccggccggggcccgggtcccggttggggccgttccgggtccggttacgggtaaccgtaacggttaccctttaaccgttcccgaacgtacgtttccgtaacggttcggtagggaccgggttttttttttttttttttttttttttttcggggccggtcgggacggaacgggacgacgtacgtacgngcgncnncngngcncnnncgnnnnnnnnnnnnnnnnnnnnnnnnnnnnn

SEQ ID NO: 97712 - DNA, 735 bp, Homo sapiens
  misc_feature: GYAE6OF01CCL6O.35.23.C01.1.454.CMB.1.raw
  modified_base (119)..(119): a, c, t, g, unknown or other
  misc_feature (119)..(119): n is a, c, g, or t
  modified_base (600)..(600): a, c, t, g, unknown or other
  misc_feature (600)..(600): n is a, c, g, or t
  modified_base (617)..(617): a, c, t, g, unknown or other
  misc_feature (617)..(617): n is a, c, g, or t
  modified_base (635)..(635): a, c, t, g, unknown or other
  misc_feature (635)..(635): n is a, c, g, or t
  modified_base (647)..(647): a, c, t, g, unknown or other
  misc_feature (647)..(647): n is a, c, g, or t
  modified_base (650)..(650): a, c, t, g, unknown or other
  misc_feature (650)..(650): n is a, c, g, or t
  modified_base (673)..(673): a, c, t, g, unknown or other
  misc_feature (673)..(673): n is a, c, g, or t
  modified_base (697)..(697): a, c, t, g, unknown or other
  misc_feature (697)..(697): n is a, c, g, or t
tcagtacagatcgtcacgaccggtgctcgatttagtacacgtgattagggattggggagatcaatcatagtcggaaccacctactacaacccgtccctcaagagtcgagtcaccatatnagtagaccttcgccaaggaccagttctcccgtggagctgacgtcttcgtcggtacgcccggccggtaccggagtaccggtcttgggtagttactttacgttgtgaccggagtccggttaccttttcgtacggcgagggtccggtccgtcccgggcccccgtacaccctaaagttcctttacgttcgccgttcggcggggaccaacgggtacccgtgtaccgcctacgtccacggtcccttcccgaacgtaccgggtcctacggtttccccggtaccgttccccggtccggtccccgccgttccgcctaccggaacggtccgacccgttctccggggcggggacctacggtaccgggcccggtccgggtcggtcgtaccgggtcggttacggacggtaccgtacgtttaccccgacgtacgtggttaccttacggtcgtacggggtccggcgggttagggccgaacccgggcggttaccccntaacccggggtttaacncgccgtagcaggcgacgncctgctacgacncancgcgtgctcgtatacgtactgtntagccgtacgtactaggaccggtntaacgtgttacgtacaccgtcgacggaccgtcccgtcg

SEQ ID NO: 97713 - DNA, 903 bp, Homo sapiens
  misc_feature: GYAE6OF01BD6IS.35.23.C01.1.454.CMB.1.raw
  modified_base (844)..(844): a, c, t, g, unknown or other
  misc_feature (844)..(844): n is a, c, g, or t
  modified_base (848)..(848): a, c, t, g, unknown or other
  misc_feature (848)..(848): n is a, c, g, or t
  modified_base (857)..(857): a, c, t, g, unknown or other
  misc_feature (857)..(857): n is a, c, g, or t
  modified_base (863)..(863): a, c, t, g, unknown or other
  misc_feature (863)..(863): n is a, c, g, or t
  modified_base (867)..(870): a, c, t, g, unknown or other
  misc_feature (867)..(870): n is a, c, g, or t
  modified_base (875)..(877): a, c, t, g, unknown or other
  misc_feature (875)..(877): n is a, c, g, or t
  modified_base (879)..(879): a, c, t, g, unknown or other
  misc_feature (879)..(879): n is a, c, g, or t
  modified_base (881)..(881): a, c, t, g, unknown or other
  misc_feature (881)..(881): n is a, c, g, or t
  modified_base (883)..(884): a, c, t, g, unknown or other
  misc_feature (883)..(884): n is a, c, g, or t
  modified_base (886)..(886): a, c, t, g, unknown or other
  misc_feature (886)..(886): n is a, c, g, or t
  modified_base (888)..(889): a, c, t, g, unknown or other
  misc_feature (888)..(889): n is a, c, g, or t
  modified_base (891)..(892): a, c, t, g, unknown or other
  misc_feature (891)..(892): n is a, c, g, or t
  modified_base (896)..(896): a, c, t, g, unknown or other
  misc_feature (896)..(896): n is a, c, g, or t
  modified_base (899)..(899): a, c, t, g, unknown or other
  misc_feature (899)..(899): n is a, c, g, or t
  modified_base (901)..(902): a, c, t, g, unknown or other
  misc_feature (901)..(902): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtcgaccgccgcggacacggctgtgtattctgtgcgagacgtcgttctagcgagcggtcgtcggcccccgtctaccgtaaacgttaccttacgttttcggaacccgttccgggtacggggggtaccccgaaaccgggggttaacccccgtttcggggttaaccccgtaaacccggtttcccgttaccgaaaccggttacccccgtttaacccccgaaaacccgggtaaaccccggggggttaccccccttaaccggggttttccccccggggttttacccccccctttttacccccccccggggtccgggggtcccccccggttccccccggtttaccggggtaccccccgtttaaccccgggaaaccggggggtaccctacccccggttaacccccggggtttaccgggggttccggggggggaacccctaacccgggacccgggggtcccccggggttcccccgggttcggggggtaccctttaccgggtcccccgggtttaacggggggttaaaccctaaaccggggtttaaaccccctttaacccgttaccccggaaccggttacgttttaccggtaaccggtttaacgggtccgggtaaccggggggacccgggttaccgggtacgggaacccgggtaacgggaccggtaaccggttaagtacgggctaagtcgtatnacgngacacgtcncgcgcngcgnnnntgtannngngngnngngnncnnatangancnna

SEQ ID NO: 97714 - DNA, 130 bp, Homo sapiens
  misc_feature: GYAE6OF02HVGNY.35.23.C01.1.454.CMB.1.raw
  modified_base (130)..(130): a, c, t, g, unknown or other
  misc_feature (130)..(130): n is a, c, g, or t
tcagtacagatcgtcacgaccggtgctcgatttagtacacgtgattagggattgggcacagcggccctgggctgcctggtcaaggactacttccacgatctgtactgagcgggctggcaaggcgcatagn

SEQ ID NO: 97715 - DNA, 128 bp, Homo sapiens
  misc_feature: GYAE6OF02GU35V.35.23.C01.1.454.CMB.1.raw
tcagtacagatcgtcacgaccggtgctcgatttagtacacgtgattagggattgggcacagcggccctgggctgcatggtcaaggactacttccacgatctgtactgagcggctggcaaggcgcatag

SEQ ID NO: 97716 - DNA, 417 bp, Homo sapiens
  misc_feature: GYAE6OF02G9EPS.35.23.C01.1.454.CMB.1.raw
  modified_base (413)..(417): a, c, t, g, unknown or other
  misc_feature (413)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggctacttccacgatctgtactgagcgggctggcaaggcgcatagnnnnn

SEQ ID NO: 97717 - DNA, 415 bp, Homo sapiens
  misc_feature: GYAE6OF02H3RAN.35.23.C01.1.454.CMB.1.raw
  modified_base (409)..(415): a, c, t, g, unknown or other
  misc_feature (409)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcacgtctcagcttccaccaaggccccatcggtcttccccctggcgcccctgctccaggagcacctctgggggcacagcggcctgggctgcctggtcaaggacttccacgatctgtactgagcgggctggcaaggcgcatagnnnnnnn

SEQ ID NO: 97718 - DNA, 453 bp, Homo sapiens
  misc_feature: GYAE6OF02FS8T1.35.23.C01.1.454.CMB.1.raw
  modified_base (423)..(453): a, c, t, g, unknown or other
  misc_feature (423)..(453): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagactggagctctgtagaccgccgcggacacggctgtgtattactgtgcgagagcgttccttagcagcggctggccccgctaccaagtactactttgactccgtggggccagggaccctggtcaccgtctcagcttccaccaagggccccatccggtcttccccctggcgccctgcctccaggagcaccctctgggggcacagcggccctgggcctgcctggtcaaggactacttccacgatctgtactgagcgggctggcaaggcgcatagnnnnnnnnnnnnnnnnnnnnnnnnnnnnnnn

SEQ ID NO: 97719 - DNA, 416 bp, Homo sapiens
  misc_feature: GYAE6OF02IZB1J.35.23.C01.1.454.CMB.1.raw
  modified_base (412)..(416): a, c, t, g, unknown or other
  misc_feature (412)..(416): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtacctactttgacctcctggggccagggaccctggtcaccgtctcagcttccaccaagggcccatcggtcttcccctggcgccctgctccaggagcactctgggggcacagcggccctgggctgcctggtcaaggctacttccacgatctgtactgagcgggctggcaaggcgcatagnnnnn

SEQ ID NO: 97720 - DNA, 414 bp, Homo sapiens
  misc_feature: GYAE6OF02FNW3J.35.23.C01.1.454.CMB.1.raw
  modified_base (411)..(414): a, c, t, g, unknown or other
  misc_feature (411)..(414): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctctgggggcacagcggcctgggctgcctggtcaaggctacttccacgatctgtactgagcgggctggcaaggcgcatagnnnn

SEQ ID NO: 97721 - DNA, 418 bp, Homo sapiens
  misc_feature: GYAE6OF02G3B8L.35.23.C01.1.454.CMB.1.raw
  modified_base (413)..(418): a, c, t, g, unknown or other
  misc_feature (413)..(418): n is a, c, g, or t
tcagtacagatcgtcacgaccggtgctcgattagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnnn

SEQ ID NO: 97722 - DNA, 413 bp, Homo sapiens
  misc_feature: GYAE6OF02GBB2I.35.23.C01.1.454.CMB.1.raw
  modified_base (411)..(413): a, c, t, g, unknown or other
  misc_feature (411)..(413): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctctgggggcacagcggcctgggctgcctggtcaaggctacttccacgatctgtactgagcgggctggcaaggcgcatagnnn

SEQ ID NO: 97723 - DNA, 421 bp, Homo sapiens
  misc_feature: GYAE6OF02I5O0B.35.23.C01.1.454.CMB.1.raw
  modified_base (416)..(421): a, c, t, g, unknown or other
  misc_feature (416)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgcctccaggagcacctctgggggcacagcggccctgggctgcctggtcaagggactacttccacgatctgtactgagcgggctggcaaggcgcatagnnnnnn

SEQ ID NO: 97724 - DNA, 428 bp, Homo sapiens
  misc_feature: GYAE6OF02IBY9P.35.23.C01.1.454.CMB.1.raw
  modified_base (228)..(228): a, c, t, g, unknown or other
  misc_feature (228)..(228): n is a, c, g, or t
  modified_base (407)..(407): a, c, t, g, unknown or other
  misc_feature (407)..(407): n is a, c, g, or t
  modified_base (413)..(428): a, c, t, g, unknown or other
  misc_feature (413)..(428): n is a, c, g, or t
tcagtacagatcgtcacgaccggtgctcgatttagtacacgtgattagggagttggcgagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactacttgactcctggggccagggaccctggtcaccgtctcagcttccaccaagggcccatcggtcttccccccgtggcgccctgctccaggagcacctctggggcacagcggcctgggctgcctggtcaaggactacttccacgatctgtactgagcgggctggcaaggcncatagnnnnnnnnnnnnnnnn

SEQ ID NO: 97725 - DNA, 424 bp, Homo sapiens
  misc_feature: GYAE6OF02JHW70.35.23.C01.1.454.CMB.1.raw
  modified_base (411)..(411): a, c, t, g, unknown or other
  misc_feature (411)..(411): n is a, c, g, or t
  modified_base (413)..(424): a, c, t, g, unknown or other
  misc_feature (413)..(424): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctctgggggcacagcggcctggctgcctggtcaaggctacttccacgatctgtactgagcgggctggcaaggcgcataggngnnnnnnnnnnnn

SEQ ID NO: 97726 - DNA, 418 bp, Homo sapiens
  misc_feature: GYAE6OF02HM99D.35.23.C01.1.454.CMB.1.raw
  modified_base (227)..(227): a, c, t, g, unknown or other
  misc_feature (227)..(227): n is a, c, g, or t
  modified_base (414)..(418): a, c, t, g, unknown or other
  misc_feature (414)..(418): n is a, c, g, or t
tcagtacagatcgtcacgaccggtgctcgatttagtacacgtgattagggattggcgagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccaggaaccctggtcaccgtctcagcttccaccaagggcccatcggtcttccccctggcgcccctgctccaggagcacctctgggggcacagcggccctgggctgcctggtcaaggactacttccacgatctgtactgagcgggctggcaaggcgcatagnnnnn

SEQ ID NO: 97727 - DNA, 415 bp, Homo sapiens
  misc_feature: GYAE6OF02IP6OO.35.23.C01.1.454.CMB.1.raw
  modified_base (412)..(415): a, c, t, g, unknown or other
  misc_feature (412)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttcccctggcgccctgctccaggagcacctctgggggcacagcggccctgggctgcctggtcaaggactacttccacgatctgtactgagcgggctggcaaggcgcatagnnnn

SEQ ID NO: 97728 - DNA, 418 bp, Homo sapiens
  misc_feature: GYAE6OF02GFP0T.35.23.C01.1.454.CMB.1.raw
  modified_base (416)..(418): a, c, t, g, unknown or other
  misc_feature (416)..(418): n is a, c, g, or t
tcagtacagatcgtcacgaccggtgctcgattagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaaccctggtcaccgtctcagcttccaccaagggcccatcggtcttccccctggcgccctgctccaggagcacctctgggggcacagcggccctgggctgcctggtcaagggactacttccacgatctgtactgagcggggctggcaaggcgcatagnnn

SEQ ID NO: 97729 - DNA, 477 bp, Homo sapiens
  misc_feature: GYAE6OF02GCT7L.35.23.C01.1.454.CMB.1.raw
  modified_base (239)..(239): a, c, t, g, unknown or other
  misc_feature (239)..(239): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (435)..(439): a, c, t, g, unknown or other
  misc_feature (435)..(439): n is a, c, g, or t
  modified_base (441)..(442): a, c, t, g, unknown or other
  misc_feature (441)..(442): n is a, c, g, or t
  modified_base (446)..(449): a, c, t, g, unknown or other
  misc_feature (446)..(449): n is a, c, g, or t
  modified_base (451)..(477): a, c, t, g, unknown or other
  misc_feature (451)..(477): n is a, c, g, or t
tcagtacagatcgtcacgaccggtgctcgatttagtacacgtgattagggtagttggggagatcaatcataagtggaaccacctactacaacccggtccctcaagacgtcgagtcaccatatccagtagactcgtccaagaaccagttctccctggagctgagctctgtcgacccgccgcggaccacggcctagtgtattactgtgcgagagcgttccttagcagcggctgggccccgntccaagtactactttgactcctggggccagggaaccctggtcaccgtctcagcttccaccaagggcccatcggtcttccccctggccgcccctgcctcccaggagcacctcgtgggggcacacgacggccctgggctgccnggtcaaggctacttccacgagtcgngtactgtagcgggctggcaaggcgcatagnnnnngnncagnnnncnnnnnnnnnnnnnnnnnnnnnnnnnnn

SEQ ID NO: 97730 - DNA, 418 bp, Homo sapiens; identical to SEQ ID NO: 97600
  misc_feature: GYAE6OF02G9SJI.35.23.C01.1.454.CMB.1.raw
  modified_base (414)..(418): a, c, t, g, unknown or other
  misc_feature (414)..(418): n is a, c, g, or t

SEQ ID NO: 97731 - DNA, 420 bp, Homo sapiens
  misc_feature: GYAE6OF02I10ZS.35.23.C01.1.454.CMB.1.raw
  modified_base (227)..(227): a, c, t, g, unknown or other
  misc_feature (227)..(227): n is a, c, g, or t
  modified_base (414)..(420): a, c, t, g, unknown or other
  misc_feature (414)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaccctggtcaccgtctcagcttccaccaagggcccatcggtcttccccctggcgccctgctccaggagcacctctgggggcacagcggcccctgggctgcctggtcaaggactacttccacgatctgtactgagcgggctggcaaggcgcatagnnnnnnn

SEQ ID NO: 97732 - DNA, 454 bp, Homo sapiens
  misc_feature: GYAE6OF02HBEOA.35.23.C01.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
  modified_base (403)..(403): a, c, t, g, unknown or other
  misc_feature (403)..(403): n is a, c, g, or t
  modified_base (411)..(413): a, c, t, g, unknown or other
  misc_feature (411)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (421)..(454): a, c, t, g, unknown or other
  misc_feature (421)..(454): n is a, c, g, or t
tcagtacagatcgtcacgaccggtgctcgatttagtacacgtgattagggagttggggagatcaatcatagtggaaccacctactacaacccgtccctcaagagtcgagtccaccatatccagtagactcgtccaagaaccagttctccctggagctgagctctgtgaccgccgcggacacggctgtgtattacncgtgcgagagcgttccttagcagcgggctggccccntccaagtactactttgactcctggggccagggaaccctggtcaccgtntcagcttcacaaggcccatcggctccctggcgcctgctccnggagcacctctggggcactagcggcctgggctgcctggtcaaggctacttcacgatctgtactgagcgggctgggcaaggtcncatagctnnntnanctgnnnnnnnnnnnnnnnnnnnnnnnnnnnnnnnnnn

SEQ ID NO: 97733 - DNA, 419 bp, Homo sapiens
  misc_feature: GYAE6OF02F35AQ.35.23.C01.1.454.CMB.1.raw
  modified_base (326)..(326): a, c, t, g, unknown or other
  misc_feature (326)..(326): n is a, c, g, or t
  modified_base (389)..(389): a, c, t, g, unknown or other
  misc_feature (389)..(389): n is a, c, g, or t
  modified_base (410)..(419): a, c, t, g, unknown or other
  misc_feature (410)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttcccctggcgccctgctccaggngcacctctgggggcacagcggccctgggctgcctggtcaaggactactccacgatctgtctgngcggcgtgcgaggcgcatagnnnnnnnnnn

SEQ ID NO: 97734 - DNA, 418 bp, Homo sapiens
  misc_feature: GYAE6OF02GJP26.35.23.C01.1.454.CMB.1.raw
  modified_base (398)..(398): a, c, t, g, unknown or other
  misc_feature (398)..(398): n is a, c, g, or t
  modified_base (414)..(418): a, c, t, g, unknown or other
  misc_feature (414)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggntggcaaggcgcatagnnnnn

SEQ ID NO: 97735 - DNA, 417 bp, Homo sapiens
  misc_feature: GYAE6OF02IPW5W.35.23.C01.1.454.CMB.1.raw
  modified_base (414)..(417): a, c, t, g, unknown or other
  misc_feature (414)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttcccctggcgccctgctccaggacgcacctctgggggcacagcggccctgggctgcctggtcaaggactacttccacgatctgtactgagcgggctggcaaggcgcatagnnnn

SEQ ID NO: 97736 - DNA, 415 bp, Homo sapiens
  misc_feature: GYAE6OF02HN3EQ.35.23.C01.1.454.CMB.1.raw
  modified_base (227)..(227): a, c, t, g, unknown or other
  misc_feature (227)..(227): n is a, c, g, or t
  modified_base (412)..(415): a, c, t, g, unknown or other
  misc_feature (412)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaaccctggtcaccgtctcagcttccaccaagggccccatcggtcttccccctggcaccctcctccaagagcacctctggggcacagcggccctgggctgcctggtcaaggctacttcacgatctgtactgagcgggctggcaaggcgcatagnnnn

SEQ ID NO: 97737 - DNA, 407 bp, Homo sapiens
  misc_feature: GYAE6OF02IPL2W.35.23.C01.1.454.CMB.1.raw
  modified_base (315)..(315): a, c, t, g, unknown or other
  misc_feature (315)..(315): n is a, c, g, or t
  modified_base (399)..(407): a, c, t, g, unknown or other
  misc_feature (399)..(407): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctaccaagtctactttgactcctggggccagggaccctggtcacgtctcagcttccaccaggcccatcgtcttcccctgcgcctgctcngacgcacctctggggcacgagcggcctggctgccgtggtcaggctactcacgatctgtactgagcggctggcaggcgcagtcgnnnnnnnnn

SEQ ID NO: 97738 - DNA, 422 bp, Homo sapiens
  misc_feature: GYAE6OF02ILTEC.35.23.C01.1.454.CMB.1.raw
  modified_base (415)..(422): a, c, t, g, unknown or other
  misc_feature (415)..(422): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgacctccgtggggccagggaaccctggtcaccggtctcagcttccaccaagggcccatcggtcttcccctggcaccctcctccaagagcacctctggggcacagcggccctgggctgcctggtcaaggactactccacgatctgtactgagcgggctggcaaggcgcatagnnnnnnnn

SEQ ID NO: 97739 - DNA, 416 bp, Homo sapiens
  misc_feature: GYAE6OF02IL5G0.35.23.C01.1.454.CMB.1.raw
  modified_base (412)..(416): a, c, t, g, unknown or other
  misc_feature (412)..(416): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaccctggtcaccgtctcagcttccaccaagggcccatcggtcttcccctggcgccctgctccaggagcacctctgggggcacagcggcctgggctgcctggtcaaggactacttccacgatctgtactgagcgggctggcaaggcgcatagnnnnn

SEQ ID NO: 97740 - DNA, 422 bp, Homo sapiens
  misc_feature: GYAE6OF02JB9ZE.35.23.C01.1.454.CMB.1.raw
  modified_base (227)..(227): a, c, t, g, unknown or other
  misc_feature (227)..(227): n is a, c, g, or t
  modified_base (415)..(422): a, c, t, g, unknown or other
  misc_feature (415)..(422): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaaccctggtcaccgtctcagcttccaccaagggcccatcggtcttccccctggcgccctgctccaggagcacctcgtgggggcacagccggcctgggctgcctggtcaaggactacttccacgatctgtactgagcgggctggcaaggcgcatagnnnnnnnn

SEQ ID NO: 97741 - DNA, 419 bp, Homo sapiens
  misc_feature: GYAE6OF02GLGYW.35.23.C01.1.454.CMB.1.raw
  modified_base (414)..(419): a, c, t, g, unknown or other
  misc_feature (414)..(419): n is a, c, g, or t
tcagtacagatcgtcacgaccggtgctcgatttagtacacgtgattagggattggggagatcaatcatagtggaaccacctactacaacccgtccctaaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggccccatcggtcttccccctggcgccctgctccaggagcacctctgggggcacagcggccctgggctgcctggtcaaggactacttccacgatctgtactgagcgggctggcaaggcgcatagnnnnnn

SEQ ID NO: 97742 - DNA, 422 bp, Homo sapiens
  misc_feature: GYAE6OF02HGIGJ.35.23.C01.1.454.CMB.1.raw
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (398)..(398): a, c, t, g, unknown or other
  misc_feature (398)..(398): n is a, c, g, or t
  modified_base (403)..(422): a, c, t, g, unknown or other
  misc_feature (403)..(422): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactacttgactccgtggggccagggaccctggtcaccgtctcagcttccaccaaggcccatcggtcttcccctgcgccctgctccaggancacctcgnggggcacgagcggcctggctcgctgcagactactcagctctgtctgacgcgggctggacgacggcanatagnnnnnnnnnnnnnnnnnnnn

SEQ ID NO: 97743 - DNA, 423 bp, Homo sapiens
  misc_feature: GYAE6OF02ICE1H.35.23.C01.1.454.CMB.1.raw
  modified_base (419)..(423): a, c, t, g, unknown or other
  misc_feature (419)..(423): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagtactactttgactcctggggccagggaaccctggtcaccgtctcctcagcctccaccaagggcccatcggtcttccccctggccaccctcctccaagagcacctctgggggcacagcggccctgggctgcctggtcaaggactacttccacgatctgtactgagcgggctggcaaggcgcatagnnnnn

SEQ ID NO: 97744 - DNA, 496 bp, Homo sapiens
  misc_feature: GYAE6OF02FS7IO.35.23.C01.1.454.CMB.1.raw
  modified_base (343)..(343): a, c, t, g, unknown or other
  misc_feature (343)..(343): n is a, c, g, or t
  modified_base (447)..(449): a, c, t, g, unknown or other
  misc_feature (447)..(449): n is a, c, g, or t
  modified_base (451)..(452): a, c, t, g, unknown or other
  misc_feature (451)..(452): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (461)..(479): a, c, t, g, unknown or other
  misc_feature (461)..(479): n is a, c, g, or t
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (486)..(496): a, c, t, g, unknown or other
  misc_feature (486)..(496): n is a, c, g, or t
tcagtacagatcgtcacgaccggtgctcgatttagtacacgtgattaggggattggggagaatcgaatcataggtggaaccacctactacaacccgtccctcaagagtcgagtcaccattatcagtagactcgtccaagaaccagttctccctggagctgagctctgtgaccgccgcggacacggctgtgtattactgtgcgagagcgttcctagcagcggctggccccgctccaagtactacttttgactcctggggcccagggaaccctggtcaccgtctcagcttccaccaagggcccaatcggtccttccccctggccgcccctgcctcccaggacgcnccgtctgggggctacgacggccggcccgtgggctcgcctggtacaagggacctacgttccgacgtactctgtacgtgacgccgggctggcaaggcgcacgtagnnngnngngncgagnnnnnnnnnnnnnnnnnnngngnngnnnnnnnnnnn

SEQ ID NO: 97745 - DNA, 419 bp, Homo sapiens
  misc_feature: GYAE6OF02GBO8Y.35.23.C01.1.454.CMB.1.raw
  modified_base (414)..(419): a, c, t, g, unknown or other
  misc_feature (414)..(419): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctcgtgggggcacagcggccctgggctgcctggtcaaggactacttccacgatctgtactgagcgggctggcaaggcgcatagnnnnnn

SEQ ID NO: 97746 - DNA, 417 bp, Homo sapiens
  misc_feature: GYAE6OF02FT4F5.35.23.C01.1.454.CMB.1.raw
  modified_base (227)..(227): a, c, t, g, unknown or other
  misc_feature (227)..(227): n is a, c, g, or t
  modified_base (412)..(417): a, c, t, g, unknown or other
  misc_feature (412)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaccctggtcaccgtctcagcttccaccaagggcccatcggtcttcccctggcgccctgctccaggagcacctctgggggcacagcggccctgggctgcctggtcaaggctacttccacgatctgtactgagcgggctggcaagggcgcatagnnnnnn

SEQ ID NO: 97747 - DNA, 422 bp, Homo sapiens
  misc_feature: GYAE6OF02GV40X.35.23.C01.1.454.CMB.1.raw
  modified_base (416)..(422): a, c, t, g, unknown or other
  misc_feature (416)..(422): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggccccatcggtcttccccctggcgccctgctccaggagcacctctgggggcacagcggccctgggctgcctggtcaagggactacttccacgatctgtactgagcggggctggcaaggcgcatagnnnnnnn

SEQ ID NO: 97748 - DNA, 517 bp, Homo sapiens
  misc_feature: GYAE6OF02IC77G.35.23.C01.1.454.CMB.1.raw
  modified_base (226)..(226): a, c, t, g, unknown or other
  misc_feature (226)..(226): n is a, c, g, or t
  modified_base (315)..(315): a, c, t, g, unknown or other
  misc_feature (315)..(315): n is a, c, g, or t
  modified_base (483)..(483): a, c, t, g, unknown or other
  misc_feature (483)..(483): n is a, c, g, or t
  modified_base (485)..(489): a, c, t, g, unknown or other
  misc_feature (485)..(489): n is a, c, g, or t
  modified_base (491)..(517): a, c, t, g, unknown or other
  misc_feature (491)..(517): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcttagcagcggctggccccgntccaagtactactttgactccgtggggccagggaaccctggtcaccgtctcagcttccaccaagggcccatcggtccttccccctggcncccctgcctccgaggacgccaaccctcgtgggggccacgacggcggccccgttggggcctcggcccttgggtaccaaagggaccttaaccgtttcccaacggaattcctaggttaacctggaacgggccggggcttgggacgaaacggggccgtaccgaagttaaggngnnnnngnnnnnnnnnnnnnnnnnnnnnnnnnnn

SEQ ID NO: 97749 - DNA, 420 bp, Homo sapiens
  misc_feature: GYAE6OF02GZTZX.35.23.C01.1.454.CMB.1.raw
  modified_base (413)..(420): a, c, t, g, unknown or other
  misc_feature (413)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggcctgggctgcctggtcaaggactacttccacgatctgtactgagcgggctggcaaggcgcatagnnnnnnnn

SEQ ID NO: 97750 - DNA, 539 bp, Homo sapiens
  misc_feature: GYAE6OF02GT9ZY.35.23.C01.1.454.CMB.1.raw
  modified_base (227)..(227): a, c, t, g, unknown or other
  misc_feature (227)..(227): n is a, c, g, or t
  modified_base (484)..(484): a, c, t, g, unknown or other
  misc_feature (484)..(484): n is a, c, g, or t
  modified_base (486)..(490): a, c, t, g, unknown or other
  misc_feature (486)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(497): a, c, t, g, unknown or other
  misc_feature (496)..(497): n is a, c, g, or t
  modified_base (499)..(500): a, c, t, g, unknown or other
  misc_feature (499)..(500): n is a, c, g, or t
  modified_base (502)..(503): a, c, t, g, unknown or other
  misc_feature (502)..(503): n is a, c, g, or t
  modified_base (505)..(507): a, c, t, g, unknown or other
  misc_feature (505)..(507): n is a, c, g, or t
  modified_base (509)..(509): a, c, t, g, unknown or other
  misc_feature (509)..(509): n is a, c, g, or t
  modified_base (511)..(512): a, c, t, g, unknown or other
  misc_feature (511)..(512): n is a, c, g, or t
  modified_base (514)..(518): a, c, t, g, unknown or other
  misc_feature (514)..(518): n is a, c, g, or t
  modified_base (520)..(520): a, c, t, g, unknown or other
  misc_feature (520)..(520): n is a, c, g, or t
  modified_base (522)..(525): a, c, t, g, unknown or other
  misc_feature (522)..(525): n is a, c, g, or t
  modified_base (527)..(528): a, c, t, g, unknown or other
  misc_feature (527)..(528): n is a, c, g, or t
  modified_base (531)..(531): a, c, t, g, unknown or other
  misc_feature (531)..(531): n is a, c, g, or t
  modified_base (533)..(538): a, c, t, g, unknown or other
  misc_feature (533)..(538): n is a, c, g, or t
tcagtacagatcgtcacgaccggtgctcgatttagtacacgtgattagggagttggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcttagcagcggctggccccgntccaagtactactttgactccgtggggccagggaaccctggtcaccgtctcagcttccaccaagggcccatcggtcttccccctggccgccctgccgtccaggagccacctcgtgggggccacgaggccggcccgtcgggctcggcccttgggtcgaaacgggtacctaaccgtttcccgaacgattccgtacggttaccgtggaacggccggggcgttacgggaccgaaaggggccgacgtaacgttaagcgacgngnnnnngngngnngnngnngnnngngnngnnnnngngnnnngnngcncnnnnnnc

SEQ ID NO: 97751 - DNA, 417 bp, Homo sapiens
  misc_feature: GYAE6OF02FO5KJ.35.23.C01.1.454.CMB.1.raw
  modified_base (412)..(417): a, c, t, g, unknown or other
  misc_feature (412)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccaagggcccatcggtcttccccctggcgccctgctccaggagcacctctgggggcacagcggcctgggctgcctggtcaaggactactttcacgatctgtactgagcgggctggcaaggcgcatagnnnnnn

SEQ ID NO: 97752 - DNA, 415 bp, Homo sapiens
  misc_feature: GYAE6OF02GOIKJ.35.23.C01.1.454.CMB.1.raw
  modified_base (413)..(415): a, c, t, g, unknown or other
  misc_feature (413)..(415): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaccctggtcaccgtctcagcttccaccaagggcccatcggtcttccccctggcgccctgctccaggagcacctctgggggcacagcggcctgggctgcctggtcaaggactacttccacgatctgtactgagcgggctggcaaggcgcatagnnn

SEQ ID NO: 97753 - DNA, 433 bp, Homo sapiens
  misc_feature: GYAE6OF02IJPWH.35.23.C01.1.454.CMB.1.raw
  modified_base (415)..(415): a, c, t, g, unknown or other
  misc_feature (415)..(415): n is a, c, g, or t
  modified_base (420)..(433): a, c, t, g, unknown or other
  misc_feature (420)..(433): n is a, c, g, or t
tcagtacagatcgtcacgaccggtgctcgatttagtacacgtgattagggattggggagatcaatcatagtggaaccacctactacaacccgtcccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaacccctggtcaccgtctcagcttccaccaagggcccatcggtcttccccctggcgccctcgctccaggagcacctctggggggcaccagccggcctgggctgcctggtcaagggcctacttccacgatctgtactgagcgggctggcaaggcgnatagnnnnnnnnnnnnnn

SEQ ID NO: 97754 - DNA, 764 bp, Homo sapiens
  misc_feature: GYAE6OF02HNRZ9.35.23.C01.1.454.CMB.1.raw
  modified_base (250)..(250): a, c, t, g, unknown or other
  misc_feature (250)..(250): n is a, c, g, or t
  modified_base (356)..(356): a, c, t, g, unknown or other
  misc_feature (356)..(356): n is a, c, g, or t
  modified_base (500)..(500): a, c, t, g, unknown or other
  misc_feature (500)..(500): n is a, c, g, or t
tcagtacagatcgtcacgaccggtgctcgatttagtacacgtgattagggaggttggggagatcaatcatagtggaaccacctactacaacccgtcctcaagagtccgagtccacccatactccagtacgcctccgtcaacgaaccagttcctccctggagcctgagctctgtgacccgccgcggaccacggctgtacgtattaccgcgtgcgagacgcgttcctagccaggccggactcgggccccctntaccaagtacttactttggacctccgtggggcccaagggtaacccctggtaccaccggtctcagtccttccgaccgaaggccccaatccgggtccctttcccccgnggcccgtcccgttcggccctcccgagggacgcctacccgtcggtacgggggacctaccgagccggccccgttggggcctacgggccctaggggtaccaacgggtaccctacgttacccgacggtactaccgttaggttacccgnggaaccgggtcggccgttacgggtaccgtaaacggggtcccaccgtaagttaaggtcgccgttaaaggcttacggtaacggtcggtacgtacgtacgtacgtagtaacgtcggtacgtaccgtaccgtaccgtaccggttaaaccgttaccgggtacggtaccgtaccgtaccggtaccggtaccgtaccggtaccgtaccgtaccgtaccgttaccggtaccgtaccgtaccgtaccgttaccgtaccgtaccgtaccgtccg

SEQ ID NO: 97755 - DNA, 421 bp, Homo sapiens
  misc_feature: GYAE6OF02HG7ZR.35.23.C01.1.454.CMB.1.raw
  modified_base (227)..(227): a, c, t, g, unknown or other
  misc_feature (227)..(227): n is a, c, g, or t
  modified_base (407)..(407): a, c, t, g, unknown or other
  misc_feature (407)..(407): n is a, c, g, or t
  modified_base (412)..(421): a, c, t, g, unknown or other
  misc_feature (412)..(421): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtctactttgactccgtggggccagggaccctggtcaccgtctcagcttccaccaagggcccatcggtcttcccctggcgccctgctccaggagcacctctgggggcacgagcggccctgggctgcctggtcaaggactacttccacgatctgtactgagcgggctggcaagcgnatagnnnnnnnnnn

SEQ ID NO: 97756 - DNA, 418 bp, Homo sapiens
  misc_feature: GYAE6OF02G05RT.35.23.C01.1.454.CMB.1.raw
  modified_base (412)..(418): a, c, t, g, unknown or other
  misc_feature (412)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaccctggtcaccgtctcagcttccaccagggcccatcggtcttccccctggcgccctcctccaagagcacctctgggggcacagcggccctgggctgcctggtcaaggactacttccacgatctgtactgagcgggctggcaaggcgcatagnnnnnnn

SEQ ID NO: 97757 - DNA, 430 bp, Homo sapiens
  misc_feature: GYAE6OF02GBW11.35.23.C01.1.454.CMB.1.raw
  modified_base (227)..(227): a, c, t, g, unknown or other
  misc_feature (227)..(227): n is a, c, g, or t
  modified_base (419)..(430): a, c, t, g, unknown or other
  misc_feature (419)..(430): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccaggggaaccctggtcgccgtctcctcagcctccaccaagggcccatcggtcttccccctggcaccctcctccaagagcacctctgggggcacagcggccctgggctgcctggtcaaggactacttccacgatctgtactgagcggggctggcaaggcgcatagnnnnnnnnnnnn

SEQ ID NO: 97758 - DNA, 416 bp, Homo sapiens
  misc_feature: GYAE6OF02HN7T2.35.23.C01.1.454.CMB.1.raw
  modified_base (227)..(227): a, c, t, g, unknown or other
  misc_feature (227)..(227): n is a, c, g, or t
  modified_base (409)..(416): a, c, t, g, unknown or other
  misc_feature (409)..(416): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccagggaaccctggtcacgtctcagcttccaccaagggcccatcgtcttcccctgcgccctgctccaggagcacctctggggcacagcggcctgggctgcctgggtcaaggactacttccacgatctgtactgagcgggctggcaaggcgcatagnnnnnnnn

SEQ ID NO: 97759 - DNA, 408 bp, Homo sapiens
  misc_feature: GYAE6OF02GEOOA.35.23.C01.1.454.CMB.1.raw
  modified_base (397)..(397): a, c, t, g, unknown or other
  misc_feature (397)..(397): n is a, c, g, or t
  modified_base (403)..(408): a, c, t, g, unknown or other
  misc_feature (403)..(408): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgacctcctggggccagggaaccctggtcaccgtctcagcttccaccaagggcccatcggtctcccctggcaccctcctccaagagcacctctggggcacagcgcctggctgctggtagctactccacgatctgtactgagcgggctggcaaggcncatagnnnnnn

SEQ ID NO: 97760 - DNA, 523 bp, Homo sapiens
  misc_feature: GYAE6OF02GBMOS.35.23.C01.1.454.CMB.1.raw
  modified_base (229)..(229): a, c, t, g, unknown or other
  misc_feature (229)..(229): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (461)..(462): a, c, t, g, unknown or other
  misc_feature (461)..(462): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (521)..(522): a, c, t, g, unknown or other
  misc_feature (521)..(522): n is a, c, g, or t
tcagtacagatcgtcacgaccggtgctcgatttagtacacgtgattagggagttggggagatcaatcatagtggaaccacctactacaacccgtccctcaagagtcgagtcaccatatccagtagactcgtccaagaaccagttctccctggagctgagctctgtgaccgccgcggacacggctgtgtattactgtgcgagagtcgttccttagcagcggctggccccngtaccaagtacctactttgacttccgtggggccaagggaaccctggtcaccgtctcaggccttccaccaagggcccatccggtacttccccttggcgccctgcctccgaggacgcacctcgtggggcacgagcggcctggggctcgccgtggtaccgaggactacttccgacgtatcgtcgtaactggagcgggctggcaaggtcgnaacgtgctnatgntagncgantcgnngnagtnagcgngtacgcgagcgtacgagngcgacgtnancgcgngcgcnctctctctcnnc

SEQ ID NO: 97761 - DNA, 557 bp, Homo sapiens
  misc_feature: GYAE6OF02H1KXW.35.23.C01.1.454.CMB.1.raw
  modified_base (489)..(489): a, c, t, g, unknown or other
  misc_feature (489)..(489): n is a, c, g, or t
  modified_base (502)..(503): a, c, t, g, unknown or other
  misc_feature (502)..(503): n is a, c, g, or t
  modified_base (505)..(509): a, c, t, g, unknown or other
  misc_feature (505)..(509): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(550): a, c, t, g, unknown or other
  misc_feature (549)..(550): n is a, c, g, or t
  modified_base (556)..(556): a, c, t, g, unknown or other
  misc_feature (556)..(556): n is a, c, g, or t
tcagtacagatcgtcacgaccggtgctcgatttagtacacgtgattagggattgggggagatcaatcactagtggaaccacctactacaacccgtccctcgaagagtcggacgtcaccatatcaggtagactcgtccaagaaccagttcgtccctcggagtcctgagctctgtgaccgcgcggacaccggctcgtgtattactgtgcgagagcgttccttaggcagccggctggcccccgtgtccgaaggtaacttactttggaactccgtaggggcctagggtacctggtcaccgtctcacgacttaccaccaagggcccagtccggtaccttccccgtggccgtcccgttcgcctccgtacgacgctacccgtccgtgggggcacgagtcccggccttagggctgccgttggtcaacgggtactacgttccacgtactctacgtactcgacgcgggcgtcggacgtaagggccgcgtaacgttaggnacgctatagctanncnnnnntctcncnctcgngcgngacgngnnacngacangncngncnntctctnc

SEQ ID NO: 97762 - DNA, 418 bp, Homo sapiens
  misc_feature: GYAE6OF02GMPGZ.35.23.C01.1.454.CMB.1.raw
  modified_base (415)..(418): a, c, t, g, unknown or other
  misc_feature (415)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaagggcgcatagnnnn

SEQ ID NO: 97763 - DNA, 420 bp, Homo sapiens
  misc_feature: GYAE6OF02HVZC9.35.23.C01.1.454.CMB.1.raw
  modified_base (414)..(420): a, c, t, g, unknown or other
  misc_feature (414)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnnnn

SEQ ID NO: 97764 - DNA, 528 bp, Homo sapiens
  misc_feature: GYAE6OF02ILA54.35.23.C01.1.454.CMB.1.raw
  modified_base (503)..(503): a, c, t, g, unknown or other
  misc_feature (503)..(503): n is a, c, g, or t
  modified_base (507)..(528): a, c, t, g, unknown or other
  misc_feature (507)..(528): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagtcgttcttagcagcggctcggccccgctccaagtactactttgactcctggggccagggacctggtcaccgtctcagcttccaccgaaggcccagtcggtcctttccccctggcccgcccctcgccgtcccaggacgccaccgtcggtgggggccaaccgaggccgggcccgttggggcctcggtcccgtgggtaccgaaacgggtaccgttacctttacccgaaccggtaactttccttacggttacccgtagggacggtccggggacctggggaacctaaaggggcccgacgaagtacgngacnnnnnnnnnnnnnnnnnnnnnn

SEQ ID NO: 97765 - DNA, 410 bp, Homo sapiens
  misc_feature: GYAE6OF02FMKI9.35.23.C01.1.454.CMB.1.raw
  modified_base (406)..(410): a, c, t, g, unknown or other
  misc_feature (406)..(410): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtctccccctggcgccctgctccaggagcacctctggggcacagcgcctggctgcctggtcaggctacttccacgatctgtactgagcgggctggcaggcgcatagnnnnn

SEQ ID NO: 97766 - DNA, 416 bp, Homo sapiens
  misc_feature: GYAE6OF02GO31W.35.23.C01.1.454.CMB.1.raw
  modified_base (412)..(416): a, c, t, g, unknown or other
  misc_feature (412)..(416): n is a, c, g, or t
tcagtacagatcgtcacgaccggtgctcgatttagtacacgtgattagggattggcgagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccaggaaccctggtcaccgtctcagcttccaccagggcccatcggtcttccccctggcgccctgctccaggagcacctctgggggcacagcggccctgggctgcctggtcaaggctacttccacgatctgtactgagcgggctggcaaggcgcatagnnnnn

SEQ ID NO: 97767 - DNA, 422 bp, Homo sapiens
  misc_feature: GYAE6OF02HLVGP.35.23.C01.1.454.CMB.1.raw
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
  modified_base (410)..(410): a, c, t, g, unknown or other
  misc_feature (410)..(410): n is a, c, g, or t
  modified_base (415)..(422): a, c, t, g, unknown or other
  misc_feature (415)..(422): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaaagtactactttgactcctggggccagggaccctggtcaccgtctcagcttccacaagggcccatcggtcttccccctggcgccctgctccaggngcacctctggggcacagcggccctgggctgcctggtcaaggactacttccacgatctgtactgagcgggctggcaaagggcganatagnnnnnnnn

SEQ ID NO: 97768 - DNA, 519 bp, Homo sapiens
  misc_feature: GYAE6OF02F8894.35.23.C01.1.454.CMB.1.raw
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (445)..(446): a, c, t, g, unknown or other
  misc_feature (445)..(446): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (487)..(488): a, c, t, g, unknown or other
  misc_feature (487)..(488): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (509)..(510): a, c, t, g, unknown or other
  misc_feature (509)..(510): n is a, c, g, or t
  modified_base (512)..(513): a, c, t, g, unknown or other
  misc_feature (512)..(513): n is a, c, g, or t
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
tcagtacagatcgtcacgaccggtgctcgattttagtacacgtgattagggaggttggggagatcaatcatagtggaaccacctactacaacccgtcctcaagagtcgagtcaccatatcagtagactcgtccaagaaccagttctccctggagctgagctctgtgaccgccgcggacacggctgtgtattacgtgtgcgagagtcgttccttagcaggcggctcggcccgctaccaagtacctactttgactccgtggggaccagggaaccctggtcaccgtntcagcttcacaggccatcgtctccctgcncctgctcaggcgcacctgtggggcacgtagccggccgtcggctcgccgtcggccaaggtactacgttccaacgtctcgtacgtactaggtacggcggactcggaccgaaacgggtcgtaccgaagtacggtnnacgangttantgcaagctagctgntcgntacncgatgcagnntccagnaacncagtctgcctnncnncncnnc

SEQ ID NO: 97769 - DNA, 474 bp, Homo sapiens
  misc_feature: GYAE6OF02IOTLL.35.23.C01.1.454.CMB.1.raw
  modified_base (192)..(192): a, c, t, g, unknown or other
  misc_feature (192)..(192): n is a, c, g, or t
  modified_base (326)..(326): a, c, t, g, unknown or other
  misc_feature (326)..(326): n is a, c, g, or t
  modified_base (441)..(474): a, c, t, g, unknown or other
  misc_feature (441)..(474): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattacngtgcgagagcgttccttagcagcggctggccccgctaccaagtacctactttgactccgtggggccaggggaaccctggtccaccgtctcagcttccaccaagggcccagtcggtcttccccctggccgcctcnctccaggacgcacctctgggggccacacggcggcccgtgggcctggccgtggcgaacggtctacttccacgtatctgtactggtacgcgggcgtggcgaaaggcgcgatagcagnnnnnnnnnnnnnnnnnnnnnnnnnnnnnnnnnn

SEQ ID NO: 97770 - DNA, 426 bp, Homo sapiens
  misc_feature: GYAE6OF02H95N8.35.23.C01.1.454.CMB.1.raw
  modified_base (226)..(226): a, c, t, g, unknown or other
  misc_feature (226)..(226): n is a, c, g, or t
  modified_base (414)..(426): a, c, t, g, unknown or other
  misc_feature (414)..(426): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgntaccaagtactactttgactccgtggggccagggaaccctggtcaccgtctcagcttccaccaagggcccatcggtcttcccctgcgccctgctcagagcactctggggcacagccggcctggggctgacctggtcaaggactacgtccacgatctgtactgagcgggctggcaagggcgcaagtcgnnnnnnnnnnnnn

SEQ ID NO: 97771 - DNA, 538 bp, Homo sapiens
  misc_feature: GYAE6OF02JMK7W.35.23.C01.1.454.CMB.1.raw
  modified_base (184)..(184): a, c, t, g, unknown or other
  misc_feature (184)..(184): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (505)..(506): a, c, t, g, unknown or other
  misc_feature (505)..(506): n is a, c, g, or t
  modified_base (508)..(508): a, c, t, g, unknown or other
  misc_feature (508)..(508): n is a, c, g, or t
  modified_base (510)..(511): a, c, t, g, unknown or other
  misc_feature (510)..(511): n is a, c, g, or t
  modified_base (513)..(513): a, c, t, g, unknown or other
  misc_feature (513)..(513): n is a, c, g, or t
  modified_base (515)..(538): a, c, t, g, unknown or other
  misc_feature (515)..(538): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgngtattactggtgcgagagcgtttctagcagcggntcggccccgntccgaagtacttactttgacctccgtgggggccacggggtaaccccgtggtccaccgtctccagcttccaccaaggcccatcggtcttccccctggccgcccgtgcctccgacggacgcacctcgtcggggggcacgacgcggccctgggcctcggcccgtgggtccaaggggtacctacccgtttcccgaccggtacttcccgtacggtttacctgggacggtccgggggtcacggggtcccgaaaggggcccgtcgatttaaccggggncgcngnngngnngngnnnnnnnnnnnnnnnnnnnnnnnn

SEQ ID NO: 97772 - DNA, 423 bp, Homo sapiens
  misc_feature: GYAE6OF02G912D.35.23.C01.1.454.CMB.1.raw
  modified_base (413)..(423): a, c, t, g, unknown or other
  misc_feature (413)..(423): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcctcgctccaagtactactttgactcctggggccaggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnnnnnnnn

SEQ ID NO: 97773 - DNA, 420 bp, Homo sapiens
  misc_feature: GYAE6OF02F4MNH.35.23.C01.1.454.CMB.1.raw
  modified_base (415)..(420): a, c, t, g, unknown or other
  misc_feature (415)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctgggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnnn

SEQ ID NO: 97774 - DNA, 431 bp, Homo sapiens
  misc_feature: GYAE6OF02GRK6N.35.23.C01.1.454.CMB.1.raw
  modified_base (227)..(227): a, c, t, g, unknown or other
  misc_feature (227)..(227): n is a, c, g, or t
  modified_base (343)..(343): a, c, t, g, unknown or other
  misc_feature (343)..(343): n is a, c, g, or t
  modified_base (421)..(431): a, c, t, g, unknown or other
  misc_feature (421)..(431): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgacctccgtggggccagggaccctggtcaccgtctcagcttccaccaagggcccatcggtcttccccctggccgccctgcctccaggacgcacctccgagngcacagccggccctgggctcgcctggtacaggactactccacgatctgtactgacgcgggcgtggcgaggcgcatagnnnnnnnnnnn

SEQ ID NO: 97775 - DNA, 536 bp, Homo sapiens
  misc_feature: GYAE6OF02IXSTT.35.23.C01.1.454.CMB.1.raw
  modified_base (164)..(164): a, c, t, g, unknown or other
  misc_feature (164)..(164): n is a, c, g, or t
  modified_base (235)..(235): a, c, t, g, unknown or other
  misc_feature (235)..(235): n is a, c, g, or t
  modified_base (451)..(451): a, c, t, g, unknown or other
  misc_feature (451)..(451): n is a, c, g, or t
  modified_base (454)..(455): a, c, t, g, unknown or other
  misc_feature (454)..(455): n is a, c, g, or t
  modified_base (457)..(457): a, c, t, g, unknown or other
  misc_feature (457)..(457): n is a, c, g, or t
  modified_base (459)..(460): a, c, t, g, unknown or other
  misc_feature (459)..(460): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (474)..(475): a, c, t, g, unknown or other
  misc_feature (474)..(475): n is a, c, g, or t
  modified_base (478)..(479): a, c, t, g, unknown or other
  misc_feature (478)..(479): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (532)..(532): a, c, t, g, unknown or other
  misc_feature (532)..(532): n is a, c, g, or t
tcagtacagatcgtcacgaccggtgctcgattttagtacacgtgattagggaggttggggagatcaatcatagtggaaccacctactacaacccgtcctcaagagtcgagtccaccatatccagtagactcgtccaagaaccagttctccctggagctgagctntgtgaccgccgcggacacggctgtgtattacgtgtgcgagagcgttccttagccaggcggactggccccgntaccaagtaccttactttgaccttcgtggggaccaagggaccctggtacaccgtctcagccttcaccgaggcccatcggtccttccccgtggccgccgtcgcctccgaggacgcacctcgtggggcacgacgcggccgtggctcgccgtcggtacgaacggtctacgttccgacgtactcgtgtactggacgtcggcgtcggacgaaggtcacganagnngnanngnanctanctgatnnagnnacnacgtngtacagctgactcgccgatcgtacgcgtcacgtcacgtctacgtntcgg

SEQ ID NO: 97776 - DNA, 426 bp, Homo sapiens
  misc_feature: GYAE6OF02HF434.35.23.C01.1.454.CMB.1.raw
  modified_base (327)..(327): a, c, t, g, unknown or other
  misc_feature (327)..(327): n is a, c, g, or t
  modified_base (416)..(426): a, c, t, g, unknown or other
  misc_feature (416)..(426): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggctggccccgctccaagtactactttgactcctggggccagggaaccctggtcaccgtctcagcttccaccaagggcccatcggtcttcccctggcgccctgctccaggacncacctctgggggcacagcggccctgggctggcctggtcaaggactacttccacgatctgtactgagcgggctggcaaggcgcagtacgnnnnnnnnnnn

SEQ ID NO: 97777 - DNA, 506 bp, Homo sapiens
  misc_feature: GYAE6OF02H1TSQ.35.23.C01.1.454.CMB.1.raw
  modified_base (227)..(227): a, c, t, g, unknown or other
  misc_feature (227)..(227): n is a, c, g, or t
  modified_base (481)..(506): a, c, t, g, unknown or other
  misc_feature (481)..(506): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggccagggaccctggtcaccgtctcagcttccacgaaggcccatccggtccttccccctggccgcccctgcctccgaggacgccacccgtccgagcgccacgaggccggccctggggccttcggcccttgggtccaaagggtaccttaaccgttcccaacgtacttccgttacggtaacttcgggacgggtccggggcttcggggaccgaaagggccgacgaagtaggnnnnnnnnnnnnnnnnnnnnnnnnnn

SEQ ID NO: 97778 - DNA, 501 bp, Homo sapiens
  misc_feature: GYAE6OF02H4QZX.35.23.C01.1.454.CMB.1.raw
  modified_base (233)..(233): a, c, t, g, unknown or other
  misc_feature (233)..(233): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (431)..(432): a, c, t, g, unknown or other
  misc_feature (431)..(432): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (450)..(453): a, c, t, g, unknown or other
  misc_feature (450)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (480)..(481): a, c, t, g, unknown or other
  misc_feature (480)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
tcagtacagatcgtcacgaccggtgctcgattttagtacacgtgattagggagttggggagatcaatcatagtggaaccacctactacaacccgtcctcaagagtcgagtccaccatactcagtagactcgtcaagaaccagttctccctggagctgagctctgtgaccgccgcggacaccggctgtgtattactgtgcgagacgcgttccttagcaggcggctcggccccgntccaagtacttacgtttgactccgtggggccagggaaccctggtcaccgtctcagcttccacagggccatcgtcttcccnggcncctgctccnggacgccacctctggggcacgacgcggacctgggcctagccgtggtcgaacgctacttccacgatctgtactgagcggctggcgaaggtcgaccgagtacgatgnngacngtangatcgatcgnnnngngngcngcngngcgacgcncncgncnncncncncncncncncncntc

SEQ ID NO: 97779 - DNA, 428 bp, Homo sapiens
  misc_feature: GYAE6OF02GCUVJ.35.23.C01.1.454.CMB.1.raw
  modified_base (419)..(428): a, c, t, g, unknown or other
  misc_feature (419)..(428): n is a, c, g, or t
tcagtacagatcgtcacgaccggtgctcgatttagtacacgtgattagggattggggagatcaatcatagtggaaccatctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatccggttttccccctggccgcccctgcctccaggacgcacctctgggggcacagcggccctgggctgcctggtcaaggctacttccacgactctgtactgagcgggctggcaaggcgcatagnnnnnnnnnn

SEQ ID NO: 97780 - DNA, 417 bp, Homo sapiens
  misc_feature: GYAE6OF02F5LCD.35.23.C01.1.454.CMB.1.raw
  modified_base (389)..(389): a, c, t, g, unknown or other
  misc_feature (389)..(389): n is a, c, g, or t
  modified_base (413)..(417): a, c, t, g, unknown or other
  misc_feature (413)..(417): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatcttacngagcgggctggcaaggcgcatagnnnnn

SEQ ID NO: 97781 - DNA, 420 bp, Homo sapiens
  misc_feature: GYAE6OF02F8ZV7.35.23.C01.1.454.CMB.1.raw
  modified_base (415)..(420): a, c, t, g, unknown or other
  misc_feature (415)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactccgtggggccagggaaccctggtcaccgtctcagcttccaccaagggcccatcggtcttccccctggcgcccctgctccaggagcacctctgggggcacagcggccctgggctgcctggtcaaggctacttccacgatctgtactgagcgggctggcaaggcgcatagnnnnnn

SEQ ID NO: 97782 - DNA, 434 bp, Homo sapiens
  misc_feature: GYAE6OF02HYZSD.35.23.C01.1.454.CMB.1.raw
  modified_base (228)..(228): a, c, t, g, unknown or other
  misc_feature (228)..(228): n is a, c, g, or t
  modified_base (416)..(434): a, c, t, g, unknown or other
  misc_feature (416)..(434): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccccgntccaagtactactttgactcctggggccaggggaaccctggtcaccgtctcagcttccaccaagggcccatcggtctcccctggcgccctgctccaggagcacctctgggggcacagcggccctgggctgcctggtcaaggctacttccacgatctgtactgagcgggctggcgaaggcgcataggcnnnnnnnnnnnnnnnnnnn

SEQ ID NO: 97783 - DNA, 459 bp, Homo sapiens
  misc_feature: GYAE6OF02I8WNY.35.23.C01.1.454.CMB.1.raw
  modified_base (447)..(459): a, c, t, g, unknown or other
  misc_feature (447)..(459): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgtttccttagcagcggctgggccccgctccaagtactactttgacctccgtggggccagggaaccctggtcaccgtctcagcttccaccaacgggcccatcggtcttcccctggcgccctgctccaggagcacctctcggggggtcaccgagccggccccgtggggccttggccctgggtccaagggacctaccgtttccaccgtactctggtacctgacgcgggcgtggctaaggcgcatagnnnnnnnnnnnnn

SEQ ID NO: 97784 - DNA, 452 bp, Homo sapiens
  misc_feature: GYAE6OF02IH7CM.35.23.C01.1.454.CMB.1.raw
  modified_base (442)..(452): a, c, t, g, unknown or other
  misc_feature (442)..(452): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcttagcagcggctcggccccgctccaagtactactttgactcctggggccacgggaaccctggtcaccgtctcagcttccacaaggcccatcggtccttcccctggccgccctgctccaggacgcacctcgtcgggggcacgacggcggcccgtggggctcggcctcgggtcaaacgggaccttacgttccacgtatcttgtactggacggcgggcgtgggacaagggcgcagtagnnnnnnnnnnn

SEQ ID NO: 97785 - DNA, 518 bp, Homo sapiens
  misc_feature: GYAE6OF02HAXUV.35.23.C01.1.454.CMB.1.raw
  modified_base (228)..(228): a, c, t, g, unknown or other
  misc_feature (228)..(228): n is a, c, g, or t
  modified_base (453)..(454): a, c, t, g, unknown or other
  misc_feature (453)..(454): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (476)..(477): a, c, t, g, unknown or other
  misc_feature (476)..(477): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (498)..(499): a, c, t, g, unknown or other
  misc_feature (498)..(499): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (512)..(513): a, c, t, g, unknown or other
  misc_feature (512)..(513): n is a, c, g, or t
  modified_base (515)..(517): a, c, t, g, unknown or other
  misc_feature (515)..(517): n is a, c, g, or t
tcagtacagatcgtcacgaccggtgctcgatttagtacacgtgattagggattggggagagtcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggaccaggggaaccctggtcaccgtctcagcttccaccaaggcccatcggtcttcccctggccgccctcgcctcgacggacgccaccgtcgtgggggcacgacggccggcccgtgggcctggcctcgggtcaacggtactacttccgacgatcgtgtaccgtggacggcgggtctcggacgaacggcgctaagtagcganngntcngctancgancatgncgnntgtcnctcncngtcncngcgnncncngngctcgcnncnnnc

SEQ ID NO: 97786 - DNA, 559 bp, Homo sapiens
  misc_feature: GYAE6OF02HKX8Z.35.23.C01.1.454.CMB.1.raw
  modified_base (140)..(140): a, c, t, g, unknown or other
  misc_feature (140)..(140): n is a, c, g, or t
  modified_base (228)..(228): a, c, t, g, unknown or other
  misc_feature (228)..(228): n is a, c, g, or t
  modified_base (351)..(351): a, c, t, g, unknown or other
  misc_feature (351)..(351): n is a, c, g, or t
  modified_base (509)..(509): a, c, t, g, unknown or other
  misc_feature (509)..(509): n is a, c, g, or t
  modified_base (515)..(516): a, c, t, g, unknown or other
  misc_feature (515)..(516): n is a, c, g, or t
  modified_base (520)..(523): a, c, t, g, unknown or other
  misc_feature (520)..(523): n is a, c, g, or t
  modified_base (526)..(529): a, c, t, g, unknown or other
  misc_feature (526)..(529): n is a, c, g, or t
  modified_base (531)..(532): a, c, t, g, unknown or other
  misc_feature (531)..(532): n is a, c, g, or t
  modified_base (534)..(535): a, c, t, g, unknown or other
  misc_feature (534)..(535): n is a, c, g, or t
  modified_base (537)..(539): a, c, t, g, unknown or other
  misc_feature (537)..(539): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (546)..(549): a, c, t, g, unknown or other
  misc_feature (546)..(549): n is a, c, g, or t
  modified_base (551)..(559): a, c, t, g, unknown or other
  misc_feature (551)..(559): n is a, c, g, or t
tcagtacagatcgtcacgaccggtgctcgatttagtacacgtgattaagggattgggggagatcaatcatagtggaaccacctactacaacccgtccctcaagagtcgagtcaccatatcagtagctcgtccaagaaccngttctccctggagctgagctctgtgaccgccgcggacacggctgtgtattctgtgcgagagcgtttcctagcagcggctcggccccgntaccaagtacttacttgacctccgtggggccagggtaccgtggtcacgtctcctcgacgcctccaccgaacgggccagtccggtaccttcccccgtggccgtcccctgccgtccgacggtacnccgacccttcggacgtacggcaacgacggtccggcccgtacggggctcggtccgtgggtttaccgaaacggtacttaccgtcctaacggacttcgttcggtacgttacggacggtccgggtcgtcgggtacggaaccgggaccgtagaacgttaacgngcgacnngtgnnnnatnnnngnngnngnnncncgngnnnnannnnnnnnn

SEQ ID NO: 97787 - DNA, 436 bp, Homo sapiens
  misc_feature: GYAE6OF02F59Y0.35.23.C01.1.454.CMB.1.raw
  modified_base (228)..(228): a, c, t, g, unknown or other
  misc_feature (228)..(228): n is a, c, g, or t
  modified_base (427)..(436): a, c, t, g, unknown or other
  misc_feature (427)..(436): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggccagggaaccctggtcaccgtctcagcttccaccagggcccatcggtcttccccctggccgccctgcctccaggagccacctcgtgggggccacgaggccggcccgtcggggctgcctggtcaaggactacttccacgatctgtactgagcgggctggcaaggcgcagtagnnnnnnnnnn

SEQ ID NO: 97788 - DNA, 420 bp, Homo sapiens
  misc_feature: GYAE6OF02FGN8U.35.23.C01.1.454.CMB.1.raw
  modified_base (414)..(420): a, c, t, g, unknown or other
  misc_feature (414)..(420): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggccccatcggtcttccccctggccgccctgctccaggagcacctctgggggcacagcggccctgggctgcctggtcaaggctacttccacgatctgtactgagcgggctggcaggcgcatagnnnnnnn

SEQ ID NO: 97789 - DNA, 513 bp, Homo sapiens
  misc_feature: GYAE6OF02F3IJO.35.23.C01.1.454.CMB.1.raw
  modified_base (325)..(325): a, c, t, g, unknown or other
  misc_feature (325)..(325): n is a, c, g, or t
  modified_base (473)..(473): a, c, t, g, unknown or other
  misc_feature (473)..(473): n is a, c, g, or t
  modified_base (477)..(513): a, c, t, g, unknown or other
  misc_feature (477)..(513): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgctccaagtactacttgactccgtggggccacgggaccctggtccaccgtctcagcttccaccagggcccatcggtcttccccctggccgcccctgccnccgaggcgccaccctcggtcgggggcacgacggccggcccctggggctcgccgtggtccaaacgggtaccttacttcccgacgtacttcgtacgttaccttgggacggtccggggtcgtagggaccgaacgggtccgacgacgttagnacgnnnnnnnnnnnnnnnnnnnnnnnnnnnnnnnnnnnnn

SEQ ID NO: 97790 - DNA, 412 bp, Homo sapiens
  misc_feature: GYAE6OF02GD63H.35.23.C01.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (409)..(412): a, c, t, g, unknown or other
  misc_feature (409)..(412): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctgganccaggaccctggtcaccgtctcagcttccaccaagggcccatcggtcttccccctggcgccctgctccaggatcacctctggggcacagcggccctgggctgcctggtcaaggctactccacgatctgtactgagcgggctggcaaggcgcatagnnnn

SEQ ID NO: 97791 - DNA, 453 bp, Homo sapiens
  misc_feature: GYAE6OF02HO4NA.35.23.C01.1.454.CMB.1.raw
  modified_base (438)..(453): a, c, t, g, unknown or other
  misc_feature (438)..(453): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccccgctccaagtactactttgactccgtggggccagggaaccctggtcaccgtctcagcttccaccaagggcccatcggtccttccccctggccgcccctgcctccgaggacgccacctcgtcggggggccacgagccgggccctggggcctcggcctggtacaacggactacttccacgatctgtactgagcgggctggcgaaggcgacatagnnnnnnnnnnnnnnnn

SEQ ID NO: 97792 - DNA, 486 bp, Homo sapiens
  misc_feature: GYAE6OF02HTF7P.35.23.C01.1.454.CMB.1.raw
  modified_base (230)..(230): a, c, t, g, unknown or other
  misc_feature (230)..(230): n is a, c, g, or t
  modified_base (461)..(461): a, c, t, g, unknown or other
  misc_feature (461)..(461): n is a, c, g, or t
  modified_base (463)..(486): a, c, t, g, unknown or other
  misc_feature (463)..(486): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgtttccttagcagcggctgggcccccntccaagtcttacttgactccgtggggccagggaccctggtcaccgtctcagcttccaccgaacgggcccatcggtccttcccccgtggccgcccctgcctccgaggacgccacctcggtcgggggcctaacgacggccggccccgtgggccttcgccgtggtcgaacggtacttaccgttccacgtactctgtactggacgcgggactcgggacgaaggcgacgtagtagngnnnnnnnnnnnnnnnnnnnnnnnn

SEQ ID NO: 97793 - DNA, 700 bp, Homo sapiens
  misc_feature: GYAE6OF02ILKKI.35.23.C01.1.454.CMB.1.raw
  modified_base (396)..(396): a, c, t, g, unknown or other
  misc_feature (396)..(396): n is a, c, g, or t
  modified_base (574)..(574): a, c, t, g, unknown or other
  misc_feature (574)..(574): n is a, c, g, or t
  modified_base (582)..(582): a, c, t, g, unknown or other
  misc_feature (582)..(582): n is a, c, g, or t
tcagtacagatcgtcacgaccggtgctcgatttagtacacgtgattaggaggttcgggagatcaatcatagtggaaccacctactacaacccgtcctcaacgtagtaccgagttacaccgatactcgacgtacgacgtccgtccaaaggaaccggagtttcgtcccgttgggagcctggacacttaccaggtgaccgccggacggtaaacacggtcttggtgtactttacgtgcggacggagtacgtcgttaccttagcacgcggctacggccccgctacgaaattcctactttcggacttccgtaggggacccaaggggaacccttggtaccgaccggtactacgaacggccttaccgaacccgaagggtcccaacgttcggtacctttccccgnggttaccgccccgtcgaccgtaccacggaacgcgacccgttagtcgggacggacacggaccggtcccgttggccgttagcccggtaggacgtaaacggtccgtaactttcccgaacgtctcgtacgtaccgacgaacggtcggccgtacggtacgacggttcccgacgacgttaccgngtaccgtngcctacgtcgacgacacgacgtccgacgcgtcaaccgtgaacgtacgacgtctcgacgacgtacgacgtacgtcgcgacgtacgtacgacgtacgacgacgacgtacgacgcgagtcg

SEQ ID NO: 97794 - DNA, 121 bp, Homo sapiens
  misc_feature: GYAE6OF02G5JIQ.35.23.C01.1.454.CMB.1.raw
  modified_base (113)..(121): a, c, t, g, unknown or other
  misc_feature (113)..(121): n is a, c, g, or t
tcagtacagatcgtcacgaccggtgctcgatttagtacacgtgattagggattgggggagatcaatcatagtggaaccacctactacaacccgtccctcaagagtcgagtccnnnnnnnnn

SEQ ID NO: 97795 - DNA, 544 bp, Homo sapiens
  misc_feature: GYAE6OF02II1ES.35.23.C01.1.454.CMB.1.raw
  modified_base (287)..(287): a, c, t, g, unknown or other
  misc_feature (287)..(287): n is a, c, g, or t
  modified_base (503)..(505): a, c, t, g, unknown or other
  misc_feature (503)..(505): n is a, c, g, or t
  modified_base (507)..(508): a, c, t, g, unknown or other
  misc_feature (507)..(508): n is a, c, g, or t
  modified_base (510)..(513): a, c, t, g, unknown or other
  misc_feature (510)..(513): n is a, c, g, or t
  modified_base (515)..(517): a, c, t, g, unknown or other
  misc_feature (515)..(517): n is a, c, g, or t
  modified_base (519)..(544): a, c, t, g, unknown or other
  misc_feature (519)..(544): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaaagaaccagttctccctggagctgagctctgtgaccgccgcggacacggctgtgtattactgtgcgagagtcgtttccttagcaggcggctggcccccgcttccaagtactactttgacctccgtggggccagggaccctggtccaccgtctcngcttccaccaagggcccatcggtccttccccgtggccgccccgtgcctcccgaggcgccaccgttcggtcggggggccacgacggccggccccgtgggcgtcgccgtcggtacgaaacgggtaccttaccgttccaacggtaactcttacggtaacctcgggacggtccgggggtctacggggtcgaaacggggtcgaccgtaattaaggcgtagnnncnngnnnngnnngnnnnnnnnnnnnnnnnnnnnnnnnnn

SEQ ID NO: 97796 - DNA, 470 bp, Homo sapiens
  misc_feature: GYAE6OF02GA96X.35.23.C01.1.454.CMB.1.raw
  modified_base (321)..(321): a, c, t, g, unknown or other
  misc_feature (321)..(321): n is a, c, g, or t
  modified_base (432)..(432): a, c, t, g, unknown or other
  misc_feature (432)..(432): n is a, c, g, or t
  modified_base (434)..(435): a, c, t, g, unknown or other
  misc_feature (434)..(435): n is a, c, g, or t
  modified_base (438)..(470): a, c, t, g, unknown or other
  misc_feature (438)..(470): n is a, c, g, or t
tcagtacagatcgtcacgaccggtgctcgatttagtacacgtgattaagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctcccaagtacctactttgactccgtggggccagggaaccctggtcaccggtctcctcacgcctccaccaagggcccatccggtcttcccccnggccgcccctggcctccaggacgccaccctcgagagcaacgagccggccctggggcctgcctggtcaaggctactcacgatctagtactgagcggctggacaggcgcatgncnncgnnnnnnnnnnnnnnnnnnnnnnnnnnnnnnnnn

SEQ ID NO: 97797 - DNA, 456 bp, Homo sapiens
  misc_feature: GYAE6OF02IU1R8.35.23.C01.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (421)..(456): a, c, t, g, unknown or other
  misc_feature (421)..(456): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagngcgttccttagcagcggntggccccgntccaagtactacttgactccngggggccagggaaccctggtcaccgtctcagcttccacaacgggcccatcggtcttcccccgtgggccnccctgctccnggtagccacctcgnggggcacngtcggcccctggctgcctggtcaggactcttccagntctgtactgacgcgggtctggacaggcncgatagnnnnnnnnnnnnnnnnnnnnnnnnnnnnnnnnnnnn

SEQ ID NO: 97798 - DNA, 475 bp, Homo sapiens
  misc_feature: GYAE6OF02GPUOM.35.23.C01.1.454.CMB.1.raw
  modified_base (227)..(227): a, c, t, g, unknown or other
  misc_feature (227)..(227): n is a, c, g, or t
  modified_base (279)..(279): a, c, t, g, unknown or other
  misc_feature (279)..(279): n is a, c, g, or t
  modified_base (441)..(441): a, c, t, g, unknown or other
  misc_feature (441)..(441): n is a, c, g, or t
  modified_base (448)..(475): a, c, t, g, unknown or other
  misc_feature (448)..(475): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggccagggaaccctggtcaccgtctcngcttccaccgaaggcccatcggtccttccccctggccgcccctgcctccgaggacgcacctcgtgggggcacgacgccggccgtcggggcctgccgtgggtccgaacggtactaccgttccacggtatccttgtacctggacgcggggctcggcgaagggcncagtagnnnnnnnnnnnnnnnnnnnnnnnnnnnn

SEQ ID NO: 97799 - DNA, 629 bp, Homo sapiens
  misc_feature: GYAE6OF02IOH7W.35.23.C01.1.454.CMB.1.raw
  modified_base (205)..(205): a, c, t, g, unknown or other
  misc_feature (205)..(205): n is a, c, g, or t
  modified_base (355)..(355): a, c, t, g, unknown or other
  misc_feature (355)..(355): n is a, c, g, or t
  modified_base (542)..(542): a, c, t, g, unknown or other
  misc_feature (542)..(542): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (604)..(605): a, c, t, g, unknown or other
  misc_feature (604)..(605): n is a, c, g, or t
tcagtacagatcgtcacgaccggtgctcgattttagtacacgtgattaagggattagggggagatcaatcatagtggaaccacctactacaacccgtccctcaagagtcgagtcaccatatcagtagactcgtccaagaaccagttctccctggacgctgagctctgtgaccgccgcggacacggctgtgtattactgtgcgagngtcgttccttagcaggcggctcggccccgctccaagttacttactttcgacttccggtggggccaacggggaacccttggtaccaccgttctccgtccacgcctaccgaaccgaacgggccctaacgtccgggttaccctttccccccgnggggtcccgtcccttcgccctccgaacggacgacctaccgttaccggagacgtaccaacggaccggccggtcccgtagggccgtacgccgttggtacgaacgggtaccttaccgttaccgacgtatccgtacgttacgtggacggtcgggtacgtcgggacggaacgggccgacgtaacgtaggacnctacgcagtntncgcngtntactncacangtctntctacgtacgacgacgacgagcgacgannactagtcgtcgtatatagcgcgtc

SEQ ID NO: 97800 - DNA, 496 bp, Homo sapiens
  misc_feature: GYAE6OF02FLPCB.35.23.C01.1.454.CMB.1.raw
  modified_base (475)..(496): a, c, t, g, unknown or other
  misc_feature (475)..(496): n is a, c, g, or t
tcagtacagatcgtcacgaccggtgctcgatttagtacacgtgattagggattggggagatcaatcatagtggaaccacctactacaacccgtcccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgacctccgtggggccacgggaaccctggtcaccgtctcagccttccaccaacgggcccatcggtccttcccccgtggtccgcccctgcctccgacggacgccaccctcgtcgggggccacgaggccggcccgtgggccgtcgccgtgggtccaagggtaccttaccgttaccacgtacttctacggttacctggtacggcggggtcgtcgggacgaacgggcgacagtacgnnnnnnnnnnnnnnnnnnnnnn

SEQ ID NO: 97801 - DNA, 451 bp, Homo sapiens
  misc_feature: GYAE6OF02HGK35.35.23.C01.1.454.CMB.1.raw
  modified_base (227)..(227): a, c, t, g, unknown or other
  misc_feature (227)..(227): n is a, c, g, or t
  modified_base (440)..(451): a, c, t, g, unknown or other
  misc_feature (440)..(451): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactccgtggggccagggaaccctggtcaccgtctcagcttccaccaaggcccatcggtcttcccctggccgccctgcctccaggacgccacctcgtcgggggcacgaggccggcccgtggggccttggcccttgggtaccaagggtactacttccacgacttcctgtacctgaggcgggctggcaaggcgcatacgnnnnnnnnnnnn

SEQ ID NO: 97802 - DNA, 418 bp, Homo sapiens
  misc_feature: GYAE6OF02FJL49.35.23.C01.1.454.CMB.1.raw
  modified_base (413)..(418): a, c, t, g, unknown or other
  misc_feature (413)..(418): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggctacttccacgatctgtactgagcgggctggcaaggcgcatagnnnnnn

SEQ ID NO: 97803 - DNA, 492 bp, Homo sapiens
  misc_feature: GYAE6OF02JZ2JL.35.23.C01.1.454.CMB.1.raw
  modified_base (160)..(160): a, c, t, g, unknown or other
  misc_feature (160)..(160): n is a, c, g, or t
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (360)..(360): a, c, t, g, unknown or other
  misc_feature (360)..(360): n is a, c, g, or t
  modified_base (466)..(492): a, c, t, g, unknown or other
  misc_feature (466)..(492): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctntgtgaccgccgcggacacggctgtgtattacngtgcgagagcgttccttagccagcggctcgggcccccntaccaagtacctactttgactccgtggggccagggaaccctggtcaccgtctcagtcttccgaccacggcccagtcggtcttccccctggccgcccctgacctcccgagcgccacctcgtcggggcacgngccggccttgggacctcggcctacgggtccaacgggtactaccgttccaacgattaccgtcggtaacttgggacggtcggcgtcggactaacgggcgacaagtcgnnnnnnnnnnnnnnnnnnnnnnnnnnn

SEQ ID NO: 97804 - DNA, 514 bp, Homo sapiens
  misc_feature: GYAE6OF02HNK0T.35.23.C01.1.454.CMB.1.raw
  modified_base (228)..(228): a, c, t, g, unknown or other
  misc_feature (228)..(228): n is a, c, g, or t
  modified_base (425)..(425): a, c, t, g, unknown or other
  misc_feature (425)..(425): n is a, c, g, or t
  modified_base (475)..(477): a, c, t, g, unknown or other
  misc_feature (475)..(477): n is a, c, g, or t
  modified_base (480)..(514): a, c, t, g, unknown or other
  misc_feature (480)..(514): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccccgntccaagtactactttgactccgtgggggccaagggtaccctggtcaccgtctcagtcttccaccgaacggccacgtccggtcccttccccgtcggccgtccctcgcctccgaggcgccaccgttcggcgggggccaccgaggcccggtccgtcgggcgtcgcccgttggtcgaacggtaccttaccttccgaacgtnttccgtagtacgtggacggcgggcgtcgggacgtacgggcgcgtagtagnnngcnnnnnnnnnnnnnnnnnnnnnnnnnnnnnnnnnnn

SEQ ID NO: 97805 - DNA, 610 bp, Homo sapiens
  misc_feature: GYAE6OF02FUO0E.35.23.C01.1.454.CMB.1.raw
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
  modified_base (540)..(540): a, c, t, g, unknown or other
  misc_feature (540)..(540): n is a, c, g, or t
  modified_base (549)..(549): a, c, t, g, unknown or other
  misc_feature (549)..(549): n is a, c, g, or t
  modified_base (551)..(554): a, c, t, g, unknown or other
  misc_feature (551)..(554): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
tcagtacagatcgtcacgaccggtgctcgatttagtacacgtgattagggattggggagatcaaatcatagtggaaccgacctactacaaacccgtccctcaagagtcgagtcaccatatctagtagactcgtccaagaaccagttctccctggagctgagctcagtgaccgccgcggacacggctgtcgtattactgtgcgagagcgttccttagcagcggctggccccgcgtccaagtactactttgacctccgtggggccagggaaccctggtaccaccgtctcagtcttccaaccaagggcccaagtccggtccttcccccgtggaccgccctcgcctcccgaggacgtcctaccgtcgtacgggggaccacgtacggtccggccccgtcggggctcggcccgtggtaccgaaacgggtaccgttaccgttacccgaacgtaacgtccgttacgttaccttcggacggtccggggtacgttacgggaccgaaacggggtcccggtacgtaacgtacggancgaacgngtgaaccgnttagctgcncnnnntgtgtgtctcncngnctagacgtacgctactacgtcgcgtgcgcgcncnctctntc

SEQ ID NO: 97806 - DNA, 441 bp, Homo sapiens
  misc_feature: GYAE6OF02F1M82.35.23.C01.1.454.CMB.1.raw
  modified_base (431)..(441): a, c, t, g, unknown or other
  misc_feature (431)..(441): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggcccccgctccaagtactactttgactcctggggccagggaaccctggtcaccgtctcagcttccaccaagggcccatcggtccttccccctggccgccctgctccaggacgcacctcgtgggggcaccagcggccccgtgggcctgcccgtggtccaaggacctacttccacgatctgtactgacgcgggtctggcaaggcgcagtagnnnnnnnnnnn

SEQ ID NO: 97807 - DNA, 515 bp, Homo sapiens
  misc_feature: GYAE6OF02H6FNR.35.23.C01.1.454.CMB.1.raw
  modified_base (476)..(476): a, c, t, g, unknown or other
  misc_feature (476)..(476): n is a, c, g, or t
  modified_base (479)..(515): a, c, t, g, unknown or other
  misc_feature (479)..(515): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttctccctggagctgagctctgtcgaccgccgcggacacggctgtgtattactgtgcgagagtcgttcctagcagcggctggcctcgctccaagtactactttgactccgtgggccagggaccctggtcaccgtctcagccttccaccgaacgggcccagtccggtccttccccccgtggccgtcccctgcctccgaggacgccgacccgtcggtcgggggccacgacggccggcccgtgggcctcggtccgtggtacgaacggaccttaccttcccgaacgtactcgttacgtacgtggacggccgggtcgtcggacgaacgggcgacagtagnagnnnnnnnnnnnnnnnnnnnnnnnnnnnnnnnnnnnnn

SEQ ID NO: 97808 - DNA, 485 bp, Homo sapiens
  misc_feature: GYAE6OF02GVLWC.35.23.C01.1.454.CMB.1.raw
  modified_base (464)..(465): a, c, t, g, unknown or other
  misc_feature (464)..(465): n is a, c, g, or t
  modified_base (467)..(485): a, c, t, g, unknown or other
  misc_feature (467)..(485): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggcccccgctccaagtaccttactttgacctccgtggggccacgggaccctggtcaccgtctcacgcttccaccaacgggcccatccggtccttccccctcggccgcccctcgcctccacggacgccaccgtccgtcgggggcaccgacgccggcccgtgggcctcgccgtggtccgaaggacctactccgacgtactcgtagtacgtgacggcgggcgtcggacgaacgggtcgacgagtagnngnnnnnnnnnnnnnnnnnnn

SEQ ID NO: 97809 - DNA, 594 bp, Homo sapiens
  misc_feature: GYAE6OF02HWO0B.35.23.C01.1.454.CMB.1.raw
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (369)..(369): a, c, t, g, unknown or other
  misc_feature (369)..(369): n is a, c, g, or t
  modified_base (416)..(416): a, c, t, g, unknown or other
  misc_feature (416)..(416): n is a, c, g, or t
  modified_base (527)..(527): a, c, t, g, unknown or other
  misc_feature (527)..(527): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (540)..(542): a, c, t, g, unknown or other
  misc_feature (540)..(542): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagtacagatcgtcacgaccggtgctcgatttagtacacgtgattaagggattggggagatcaatcatagtggaaccacctactacaacccgtccctcaagagtcgagtcaccatatcagtagactcgccaagaaccagttctccctggagctgagctctgtcgaccgccgccggaacacggctgtagtattactgtgcgagagtcgtttccttagcaggccggctcggcccccgctaccaagtacttacgtttgactccgngggaccagggaaccctggtaccnccgttctcctcacgcctaccaccgaacggccccagttccggtccctttacccccgtggcccgtccctgcctccgacgggaccncctacccgtccggaacgacgaccgtacgaacgggtcccggtacccgngggggtacctcggtccgtcggtaacgaacggtacttacctaccgacgtacgtcgtttacgcgttggacggcgggtcgtgggacgaaacgggcgtacacgtatcgatagctncgttacnntnacnnncaganagtantgntgtcncgcgcgcgacncgananagngngcgacncncnag

SEQ ID NO: 97810 - DNA, 529 bp, Homo sapiens
  misc_feature: GYAE6OF02GGUYL.35.23.C01.1.454.CMB.1.raw
  modified_base (349)..(349): a, c, t, g, unknown or other
  misc_feature (349)..(349): n is a, c, g, or t
  modified_base (497)..(498): a, c, t, g, unknown or other
  misc_feature (497)..(498): n is a, c, g, or t
  modified_base (501)..(529): a, c, t, g, unknown or other
  misc_feature (501)..(529): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcagagcgtttcctagcagcggctcggccccgctccaagtacctactttgacctccgtggggccaggggaaccctggtcaccgtctcagtccttccaccgaacggccctagtccggtcccttcccccgtgggcccgccctcgcctccgaggacnccaccgtcggtcgggggccacgacggccggcccgtcggggcctcggtcccgtcgggtaccgaaacggtaccctaccgtttccgaacgtagttctacgttacgtcggacggtccggggcgttcgggacgaacgggccgacgaagtacgnngcnnnnnnnnnnnnnnnnnnnnnnnnnnnnn

SEQ ID NO: 97811 - DNA, 619 bp, Homo sapiens
  misc_feature: GYAE6OF02I7I3T.35.23.C01.1.454.CMB.1.raw
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (545)..(545): a, c, t, g, unknown or other
  misc_feature (545)..(545): n is a, c, g, or t
  modified_base (566)..(566): a, c, t, g, unknown or other
  misc_feature (566)..(566): n is a, c, g, or t
  modified_base (614)..(614): a, c, t, g, unknown or other
  misc_feature (614)..(614): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcaggcgcgtcggccccgctccaaagttacctactttgaccttccgtggggccaacgggaccctggtccaccgtctcgagccttccaccgacgggccacgtcggtcctttcccccgtggccgccctcgtcctccgaggtacgcctacctccggtcggggctacgacggccggtccgtcgggcctcgccgtcggtacgaacggtaccttaccgttccgaacgtacttcgttcgtaaccgttcggaacggtccggggtacgtacggggaccgttaaacggggcccgataaccggtagcgacgcgacnctgacgngacncgcgcgacgtacgtcgcgngcgcgtcgcgcgacgcgtcgngtcgtacgcgtcgtcgtacgtacgtagtcgtcggtacgcgtcgtcggngtacg

SEQ ID NO: 97812 - DNA, 697 bp, Homo sapiens
  misc_feature: GYAE6OF02HM3LL.35.23.C01.1.454.CMB.1.raw
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (661)..(662): a, c, t, g, unknown or other
  misc_feature (661)..(662): n is a, c, g, or t
  modified_base (664)..(673): a, c, t, g, unknown or other
  misc_feature (664)..(673): n is a, c, g, or t
  modified_base (675)..(697): a, c, t, g, unknown or other
  misc_feature (675)..(697): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttcctagcagcggcgtccggccctctaccaagttaccttacgtttcgacctccggtcggggaccgaaaccgggtaacccgttggtaccccgtaccggttcctacgaccgttacccttaccccgaaaccggaaccgggcccctaacggttcccggtttcccccctttcccccggtcgggcccccgttccccgttcggtccccttaccggaacggaccgacccctaccggttccgggggtcggggaccaaccggacgggtccccgggtcccgggtcggggccttaccggtcccgggttacgggtaacccggtaaaccgggttaccctttaacccgttacccggaaccgttacgtttacccggttacggttaccggtcgggaaccgggggtcccgggtaccggttacgggaacccggaaacgggggtcccaaacggttaaggtacggcngngngngngngnngnnnnnnnnnngnnnnnnnnnnnnnnnnnnnnnnn

SEQ ID NO: 97813 - DNA, 446 bp, Homo sapiens
  misc_feature: GYAE6OF02FPIV6.35.23.C01.1.454.CMB.1.raw
  modified_base (426)..(426): a, c, t, g, unknown or other
  misc_feature (426)..(426): n is a, c, g, or t
  modified_base (428)..(446): a, c, t, g, unknown or other
  misc_feature (428)..(446): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgtttccttagcagcggctggccccgctccaacgtactactttgactcctcgggggccagggaacccgtcggtcaccgtctcagcttccaccagggcccatcggtctcccctcggcgccctgctccacggacgcacctcgtgggggcacacgcggccctggctgcctggtcaaggactactccacgatctgtactgacgcgggcgtggcaaggcgcgaactagngnnnnnnnnnnnnnnnnnnn

SEQ ID NO: 97814 - DNA, 658 bp, Homo sapiens
  misc_feature: GYAE6OF02J2TYI.35.23.C01.1.454.CMB.1.raw
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
  modified_base (477)..(477): a, c, t, g, unknown or other
  misc_feature (477)..(477): n is a, c, g, or t
  modified_base (543)..(543): a, c, t, g, unknown or other
  misc_feature (543)..(543): n is a, c, g, or t
  modified_base (557)..(557): a, c, t, g, unknown or other
  misc_feature (557)..(557): n is a, c, g, or t
tcagtacagatcgtcacgaccggtgctcgatttagtacacgtgattagggattggggaggatcaatcatagtggaaccacctactacaacccgtccctcaagagtcgagtcaccatatcagtagactcgtccaagaaccagttctccctggagctgagctctgtgaccgccgcggacacggctgtgtatactgtgcgagngtcgttcctagcaggccgcgttccggcccgtactcaacgttacttacgttcgacctcggtcgggaccctaacggacccgtggttccaccgtcgtaccacgtccttaccgaaccgaacggccccttacgttcccggttccccttccccgaggcccgttacccncggttaccaccggtacggccaccggttacccgtcgggtcgggaccacggaccggtccggccggtcggacggtccgtccggttggaaccgtaaccgtacctaccggtacctacgtnttaccgttacgacgttcgggtaggccgggtacggtaccgaggacgggtaccgacgtaacgtgcgtntcaacgtgcgtaancgcgcttgcctcgtcgacacgtcgtcgtacgtcgacgcgacgtcgcgacgcgtcgcgcgtcgtacgtcgtcgtacgtacgtcgtccgtaccgtacgtctcg

SEQ ID NO: 97815 - DNA, 442 bp, Homo sapiens
  misc_feature: GYAE6OF02GHLFE.35.23.C01.1.454.CMB.1.raw
  modified_base (228)..(228): a, c, t, g, unknown or other
  misc_feature (228)..(228): n is a, c, g, or t
  modified_base (419)..(419): a, c, t, g, unknown or other
  misc_feature (419)..(419): n is a, c, g, or t
  modified_base (423)..(425): a, c, t, g, unknown or other
  misc_feature (423)..(425): n is a, c, g, or t
  modified_base (427)..(442): a, c, t, g, unknown or other
  misc_feature (427)..(442): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctgggccccgntccaagtacctactttgaccttccgtggggccagggaaccctggtcaccgtctcagcttcaccaaggcccatcggtcttccccctggccgccctgcctccacggagccacctcgtgggggcacgagccggcctggggctgccgtggtccaaggctacttccacgatctgtctgagcgggctggcaaggcgnatgnnngnnnnnnnnnnnnnnnn

SEQ ID NO: 97816 - DNA, 946 bp, Homo sapiens
  misc_feature: GYAE6OF02G84Z7.35.23.C01.1.454.CMB.1.raw
tcagtacagatcgtcacgaccggtgctcgatttagtacacgtgattagggagttggggacgatcaatcatagtggaaccacctacctacaacccgtccctcaagagtcgagtcaccatatcagtagactcgtcctaagaaccagttctccctggacgctggagcctctcgtacgaccgccggtcggacacggctgtgtattactggtgcgagagtcgttccgttagcagcggcgtcggccccgactaccaagtaccttacgtttacgaccttaccggtcgggggacctaacgggggaaccccttacgggttaccgtaacccggttcctaccgtaacggttacccctttaccccgaaaccccggtaaaccgggggtacccccctaaacggtttaccccggggtttaccccgtttttccccccccggttagggggtaccccggtcccccgtttaccgggtaaccccggttaaccccgaaaacgggtaacccggaccccgtaaacccggtttcccggggttacggggggggaacccttaaaacccgggaaaccggggtaacccgggtacccccgggtttcgggggtacccgttaaccggggtacccgtttacggggtaacccggtaaaaaccggggtttaaccccttttaaaccccgttttaaccccgaaacccggtttaaccgtttacccggggtttaaacgggtaaacccggttaccgggtaaacgggggttcccgggggacccgttaaacgggggtacccggtaaaccggggttaacccgaaccgtttaaaccgtaggaccgggtactagacgtagagtacgtacgacgtacagtacgagtacgcggtatagagtacgtacgtacgtacgtagacgtcgtacgacgtacgtacgtaccgacgtacgtacgtacgtaccgtaccgacgaccgtacgtacgtagtacg

SEQ ID NO: 97817 - DNA, 652 bp, Homo sapiens
  misc_feature: GYAE6OF02JZG15.35.23.C01.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
  modified_base (618)..(624): a, c, t, g, unknown or other
  misc_feature (618)..(624): n is a, c, g, or t
  modified_base (626)..(652): a, c, t, g, unknown or other
  misc_feature (626)..(652): n is a, c, g, or t
tcagtacagatcgtcacgaccggtgctcgatttagtacacgtgattagggagttgggagatcaatcatagtggaaccacctactacaacccgtccctcaagagtcgagtcaccatatcagtagactcgtccaagaaccagttctccctggacgctggagctctgtgacccgccgcggaccacgggctggtgtattacctgtggacgagagtccttctagcagcggtcncgggcccccnctccgaaagtacctactttgacctccgtagggggccccaaggggtaccccgtacggtccgaccggttcctacgacgtcttacccgacccgaacggggtccccagttccgggttaccttcccccccgttgggccccgtacccctcggtaccttcccgacggtacggcctaccccgtcgtcggggggaccaccggacggcccgggcccgtcgggaccgtcggacccgttcgggtaccgtaaacgggaccgtttaaccgttcccggaacgtaaccgttccgttaacggttaccggtaccgggtaaccggggtcccgggacgttaccggggaccggaaaccggggaccgtacccgaagttcgganacgtnagtcancgttaagnnnnnnngnnnnnnnnnnnnnnnnnnnnnnnnnnn

SEQ ID NO: 97818 - DNA, 517 bp, Homo sapiens
  misc_feature: GYAE6OF02G5DO2.35.23.C01.1.454.CMB.1.raw
  modified_base (228)..(228): a, c, t, g, unknown or other
  misc_feature (228)..(228): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (480)..(481): a, c, t, g, unknown or other
  misc_feature (480)..(481): n is a, c, g, or t
  modified_base (485)..(517): a, c, t, g, unknown or other
  misc_feature (485)..(517): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctcggccccgntccaagtactactttgactccgtggggccagggaccctggtcaccgtctcagcttccacaagggcccatcggtcttcccctggccgccctgcctccgaggacgcacctcgtcgggggccacgaggccggcctcggggctcggcctgggtaaccgaaacggtaccttaccttccgaacgacttccgttacgttacgtcgggtagggtccgggacgtcggaccgaacgggtcgacgtagtaggnagctnacgtnngtcnnnnnnnnnnnnnnnnnnnnnnnnnnnnnnnnn

SEQ ID NO: 97819 - DNA, 553 bp, Homo sapiens
  misc_feature: GYAE6OF02JWV60.35.23.C01.1.454.CMB.1.raw
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
  modified_base (462)..(462): a, c, t, g, unknown or other
  misc_feature (462)..(462): n is a, c, g, or t
  modified_base (522)..(553): a, c, t, g, unknown or other
  misc_feature (522)..(553): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaagaaccagttctccctggagctgagctctgtgacccgccggcggacacggctgtgtattactgtgcgagagtccgtttcttagcagcggctcggccccgctaccaagtaccttactttgacctccgtcggggaccacggtacccgtggtccaccgtcncacgtccttcccgaaccgtaccgggccctacgttccggttcccctttccccccgtgggtcccnccccgtcgaccgtcccgacggacgccgcccgtcgggtcggggaccacgacggcccgccggtcggccgttcggcccgtggtacgaacggtaccttaccgtccgaaccgtnttcgtcggtaactcgggtcggtcgggccggtagggaccggaacgggccgtagtagtacgnnnnnnnnnnnnnnnnnnnnnnnnnnnnnnnn

SEQ ID NO: 97820 - DNA, 581 bp, Homo sapiens
  misc_feature: GYAE6OF02H8U05.35.23.C01.1.454.CMB.1.raw
  modified_base (145)..(145): a, c, t, g, unknown or other
  misc_feature (145)..(145): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (546)..(548): a, c, t, g, unknown or other
  misc_feature (546)..(548): n is a, c, g, or t
  modified_base (550)..(556): a, c, t, g, unknown or other
  misc_feature (550)..(556): n is a, c, g, or t
  modified_base (558)..(581): a, c, t, g, unknown or other
  misc_feature (558)..(581): n is a, c, g, or t
tcagtacagatcgtcacgaccggtgctcgatttagtacacgtgattagggattggggagatcaatcatagtggaaccacctactacaacccgtccctcaagagtcgagtcaccatatcagtagactcgtccaaagaaccagttcnccctggagctgagctctgtgaccgccgcggacacggctgtgtattactgtgcgagagcgttcttagcagcggctcggcccccgctccaagtactactttgacttccgtggggccaggggaaccccgttggtacctacccgtctccagccttcccaaccgaagggcccctagtccggttcccttccccgtcggcccgtcccctcgcctccgaggacgccaccgttcgtcgggggccaaccgacggcccggcccgtggggcctcgggccgtttcgggtaccgtaacgggtaacccttaccgtttcccgacggtaactaccgtttacgtaaccgttacgggacggggtcccggggtacgttcgggacccgaaacgggtcggactagttacggctagntcntcgnnngnnnnnnncnnnnnnnnnnnnnnnnnnnnnnnn

SEQ ID NO: 97821 - DNA, 525 bp, Homo sapiens
  misc_feature: GYAE6OF02FI5ZO.35.23.C01.1.454.CMB.1.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (491)..(492): a, c, t, g, unknown or other
  misc_feature (491)..(492): n is a, c, g, or t
  modified_base (495)..(497): a, c, t, g, unknown or other
  misc_feature (495)..(497): n is a, c, g, or t
tcagtacagatcgtcacgaccggtgctcgatttagtacacgtgattagggtagttggggagatcaatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgntccaagtactactttgactcctggggccaggaccctgtcaccgtctcagcttccaccaggccatcgtctcccctgcgccngctcagcgcacctcgtgggcacacgcgccgtggctcgccgtggtcaacggtctacttccgaacgtactctacgtactcgacgccggggtctacgggaccgaaagggtccgaccgtagtaacggcngacgactganacgancgtagctagaactgaancgngtacntcgcagcaggcngtacnncgnnnacagtacgtctagtagtacgtactatcg

SEQ ID NO: 97822 - DNA, 512 bp, Homo sapiens
  misc_feature: GYAE6OF02IBB3A.35.23.C01.1.454.CMB.1.raw
  modified_base (473)..(512): a, c, t, g, unknown or other
  misc_feature (473)..(512): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagtttctccctggagctgagctctgtgaccgccgcggacacggctgtgtattactgtgcgagagcgtttccttaggcagcggctgggcccccgctccaaagttactacttttgactccgtggggccagggaaccctggtccaccggtctcagcttccacaacgggcccatcggtccttcccctcggccgcccgtgcctccgtaggacgcctaccgttccgtcggggggcacgtacggccggccgtggggctcgcctgggtaccaagggacttaacctccacgtactctgtacgtgacggcggggtcgtaggacgaacgggcgactaagtagacnnnnnnnnnnnnnnnnnnnnnnnnnnnnnnnnnnnnnnnn

SEQ ID NO: 97823 - DNA, 474 bp, Homo sapiens
  misc_feature: GYAE6OF02GV9VF.35.23.C01.1.454.CMB.1.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (443)..(474): a, c, t, g, unknown or other
  misc_feature (443)..(474): n is a, c, g, or t
tcagtacagatcgtcacgaccggtgctcgatttagtacacgtgattagggattgggggagatcaatcatagtggaaccacctactacaacccgtccctcaagagtcgagtcaccatatcagtagactcgtccaagaaccagttctccctggagctgagctctgtcgacccgccgcggacaccgggtctgtgtattacgtgtgcgagacgcgttccttagcagcgntcggccccntccaagtactacttgactccgtgggccacggacctgcnccgtctcngcttccacgaggccagtcgtccttacccgcgcgccctgcctcgaggcncncctgngggcacgngccgccgtggcctgcgtcgtacgaaggtcctacctcgacgtatcgtgtactgacggtcggngtacgacgacggtcgcgaagttgagncgancganctagnnnnnnnnnnnnnnnnnnnnnnnnnnnnnnnn

SEQ ID NO: 97824 - DNA, 442 bp, Homo sapiens
  misc_feature: GYAE6OF01CQ307.12.58.F03.1.454.CMB.1.raw
  modified_base (437)..(442): a, c, t, g, unknown or other
  misc_feature (437)..(442): n is a, c, g, or t
tcagatacgacgtacacgaccggtgctcgatttagtctgatcgagaagggaaaggggctggagtgggtggccaatatacagtcaggtggaggtacgatacattatctcgactctgtgaagggccggttcaccatctccagagacaacgccaagaattcactgtatctgcaaatgaacagcctgagagtcgaagacacgggtatttattattgtgtgcgagatctggatttccttcgaaatgaagtgtggttcgatgtgtttgatctttggggccaagggacaattgtcaccgtctcttcagcctccaccaagggcccatcggtcttccccctggcgccctgctccaggagcacctccgagagcacagcggccctgggctgcctggtcaaggactacttcctacgtcgtatctgagcgggctgggcaaggcgcatagnnnnnn

SEQ ID NO: 97825 - DNA, 468 bp, Homo sapiens
  misc_feature: GYAE6OF01B3NB8.12.58.F03.1.454.CMB.1.raw
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
  modified_base (436)..(436): a, c, t, g, unknown or other
  misc_feature (436)..(436): n is a, c, g, or t
  modified_base (439)..(468): a, c, t, g, unknown or other
  misc_feature (439)..(468): n is a, c, g, or t
tcagatacgacgtacacgaccggtgctcgatttagtctgatcgagaagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttatattgtgtgcgagatctggatttcctcgaaatgaagtgtggttcgatgtgtttgatcttttggggccaagggacaattgtcaccgtctcttcagcctccacaagggcccatcggtcttcccctggcnccctgctcccaggagcacctcgagagcacagcggcccngggctgcctggtcaaggactacttcctaacgtcgtatctgagcgggctggtcaaggcgacagtagnacnnnnnnnnnnnnnnnnnnnnnnnnnnnnnn

SEQ ID NO: 97826 - DNA, 459 bp, Homo sapiens
  misc_feature: GYAE6OF01BOWJC.12.58.F03.1.454.CMB.1.raw
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (444)..(459): a, c, t, g, unknown or other
  misc_feature (444)..(459): n is a, c, g, or t
tcagatacgacgtacacgaccggtgctcgatttagtctgatcgagaagggaaagggctggagtgggtggccaatatacagtcaggtggaggtacgatacattatctcgactctgtgaagggccggttcaccatctccagagacaacgccaagaattcactgtatctgcaaatgaacagcctgagagtcgaagacacgggtatttattattgtgtgcgagatctggattttccttcgaaaatgaagtgtggttcgatgtgtttgatctttggggccaaggggacaaattgtcaccgtctcttcagcctccaccaaagggcccatcggtcttccccctggcgccctgctccaggagcacctccgagagcacagcggcccctgggctgccctggtcaaggactacttcctaacgtcgtaatctgancgggctggcaaggcncatagnnnnnnnnnnnnnnnn

SEQ ID NO: 97827 - DNA, 539 bp, Homo sapiens
  misc_feature: GYAE6OF01C3WAJ.4.60.F05.1.454.CMB.1.raw
  modified_base (154)..(154): a, c, t, g, unknown or other
  misc_feature (154)..(154): n is a, c, g, or t
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (183)..(184): a, c, t, g, unknown or other
  misc_feature (183)..(184): n is a, c, g, or t
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggngtgttctaggtcgctattaagngtcntgnngtgcagctgntgncngggngctgcngctggggtcctgagctctctgtgcagcctntggattcactttagcacaatgccctgagttggccgcaggcnccgagggagggngnggngtggtcgcgngcatgagtgtagtaggtaagtagtaagttaagtacgagtacgtacgacgacgtacgtcgtggtggacgggaccgaccgtaccactactctacgacgacgactactacctactacgtacctacctactactctacgactaagtacgaacagacgtagagacgacgacggacgacgacgtactactacgtcgacgacgaacgtaaggtaacgggtagggtacgtacgtagtacg

SEQ ID NO: 97828 - DNA, 512 bp, Homo sapiens
  misc_feature: GYAE6OF01C5Q3G.4.60.F05.1.454.CMB.1.raw
  modified_base (179)..(179): a, c, t, g, unknown or other
  misc_feature (179)..(179): n is a, c, g, or t
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtgtttctaggtggctatttaaaggngtccagtgtgaggtgcagctgctggagtctgggggaggcttggtacagcctggggggtccctgagactctcctgtgcagcctctggattcacgtttagcaccaatgccctgngttgggtccgccaggctccgagggaaggggctgggagtgggcgcgaggcatcagtgtagtgaaatgatttaagacagactagcagactntgtgaggggcactcaccatctcaganacatcananacactntatntanacatananananagagacgacgacgacgacgacgtactactactcgacgacgaacgtaacgtaaggtagggacgtacgtagtag

SEQ ID NO: 97829 - DNA, 519 bp, Homo sapiens
  misc_feature: GYAE6OF01C769F.4.60.F05.1.454.CMB.1.raw
  modified_base (478)..(478): a, c, t, g, unknown or other
  misc_feature (478)..(478): n is a, c, g, or t
  modified_base (502)..(502): a, c, t, g, unknown or other
  misc_feature (502)..(502): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgcgttttctaggtggctattttaaaaggtgtccagtgtgaggtgcagctgctggagtctgggggagcttggtacagcctggggggtccctgagactctcctgtgcagcctctggattcacgtttagcaccaatgccctgagttgggtccgccaggctccagggaaggggctggagtgggtcgcagggcatcagtggtagtggaaatgatttaagacagactacgcagactctgtgaggggccgacgtcaccatctcagagacaattccatgaacaccctagtactctgacaatagaacagactgagagacgagaccgacgcgtanactactgacgacgaagagtaaggnggggaacacgtagtacg

SEQ ID NO: 97830 - DNA, 677 bp, Homo sapiens
  misc_feature: GYAE6OF01DCE48.4.60.F05.1.454.CMB.1.raw
tcagagcactgtagcacgaccggtgctcgatttagtacgtcatcagggaaaggggctctgagagaggagcccagcccctggagtatttcgaggttgtttctagtttggtgatcgaggactagaacagagagaactcaccagtggtagttggctgagtcgtggttctttttcgttggtggtactttaaagtttttaaaaggtcgtacctaaggttggtaggtaggtcgcgagtcgtgcgtagggagttcgggtgggggacgtcgtttggtaacgacggtccgggtcggggggtccctggacgtactcctccgtggtcgcgacgtcccttcgtggtacttccgttaacgtttacgaccaacctaagtcgccccgtgtacggtttcggtcccgccgaggcctaccggaaggggaacgggcgtagggaggtgggtcgacgacggcagtcgaggtggtaagtaggtaaatagtaatttaagacgagtaactacgcacgacttcgtggtaggacggggaccgtacgtaccaacctactaccgtaccgagacgaactaactaccatacgaacctacctgtactctagaacaaagtacgaacagacgtagagacgaccgacggacgacggtacgtatacgtacgtacgacgaacgaaagaagtaagggacgggaactacgtaacg

SEQ ID NO: 97831 - DNA, 624 bp, Homo sapiens
  misc_feature: GYAE6OF01DT5ED.4.60.F05.1.454.CMB.1.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtgttctaggtcggctaatttaaaggtgtcagtgtgaggtgcagctgctggagtcgtggggaggcttggtacagccgtgggggtccctgagctctcctgtgcagcctgtggattccagtttancacatcgctgtcggtcggccgcgacggcncgagggaggtcgnggngtggtcgcgngngagtgagtaggtagtagtaagtagtaagttaagacgagacgtacgacgagtacgtcgtggtacggacgggaccgtacgtaccgtacctactaccgtaccgaacgaacgtaactaactaccgtaacgtacgtaaccgtaaccgtacgtacgtacgtacgtaactaacgtaacgtaacgtaacgtacgtacggacgacggaccggaacggaccggaccggtaccgtacgtacgtacgtacgacggaacggaaacggtaacggtaacgggtacgggtaaccgtacgtagtacg

SEQ ID NO: 97832 - DNA, 581 bp, Homo sapiens
  misc_feature: GYAE6OF01DZXMX.4.60.F05.1.454.CMB.1.raw
  modified_base (480)..(480): a, c, t, g, unknown or other
  misc_feature (480)..(480): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcgtttctagtggctaatttaaaggtgtcagtgtgaggtgcagctgctggagtcgtgggggagcttggtacagccgtgggggtccctgagactctcctgtgcagccctgtggtacttctaccgttttagccaaccaatcgcccctggtacggttcgggtcccgccgaggcctccgaggggaagggctgggagttgggcgcgaggcatcgagtggtagtaggaatggtaactttaaggacagactacgcagacttcgtgtggacgggcctacgtaccacatcctaccgagacgactaaacgttccaatacgaacctacctgttaacncttagaaccaagtagaactagactaggacgacgccgaacgacgacggaccgtactactacgtcgcgaacgaaagacgtaagggaggggactacgcgttagg

SEQ ID NO: 97833 - DNA, 537 bp, Homo sapiens
  misc_feature: GYAE6OF01BAFME.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgcttttctagtggctattttaaaaggtgtccagtgtgaggtgcagctgctggagtctgggggaggcttggtacagcctggggggtccctgagactctcctgtgcagcctctggattcacgtttagcaccaatgccctgagttgggtccgcaggctccgagggaaggggctgggagtgggtcgcaggcatcaggtggtagtggaaatgaattttaagacagactacgcagactctgtgagggccgactcgaccatctccagagacaacttccatacgaacctaccctagtactctagaccaaatgaaacagactgagacgaccgaggacacggaccgtatactacgtgacgacgaaagagtaaggagggggactaccgtagtacg

SEQ ID NO: 97834 - DNA, 705 bp, Homo sapiens
  misc_feature: GYAE6OF01EDH55.4.60.F05.1.454.CMB.1.raw
  modified_base (273)..(273): a, c, t, g, unknown or other
  misc_feature (273)..(273): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtgtttctaggtcggctaatttaaaaggtgtcagtgtgagtgcagctgctggagtcgtggggagcttggacagcctgggggtccctgagctctctgtgcagcctctggattcacgtttancacatcgccgtgtagtcggccgcgagctacggagggacgggcgtggngtgggtcgacgngacgtagtacgtaggtaggtaggtaggtaagtagttaagtttaacgtaacgtaacgtaacgtacgacgtaacgtacgtacggttcggtacgggtacgggtacccggtaaccgtaccgtaacctacgtaccgtaccgtacgtaaccgtaacctaaccttaacctaacgtaaccgtaacctaccgttacgttactacgtaacgtaacgtaaacgtaacgtaacgtaacgtaacgtacgaacggaacggaaccggaacggtaaaccggtaaccggtaaccgtaaccgtaaccgttaaccggtaccggtaacggtaaacggtaaacggtaaacgggtaacggggtaaccgggtaaccggtaaccgtaacggttacgg

SEQ ID NO: 97835 - DNA, 620 bp, Homo sapiens
  misc_feature: GYAE6OF01A660Z.4.60.F05.1.454.CMB.1.raw
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtgtttctaggtggctaattttaaaaggtgtcagtgtgagtgcagctgctggagtctgggggaggcttggacaggcctggggggtccctgagactctcctgtgcagcctctggattcacgtttagcaccaatgccctgngttggccgccaggctcgagggaagggctggagtggcgcncggngagtcgaggtaggtaggtggtaaagtagtaagtttaaagtaacgaacgtaacgtaacgtacgaacgtacgtacgtaggtacgggtacggggtacccggtaccgtaccgtaacccgtaacgtacctaccgaacgaacgaacgtaactaccacgtacgtaaccgtaccgtacgtactactacgaactaaacgtaacgtaacgtaacgaacgtacgacgacgacgacggacgacggacgtactactacgtcgacgagaagtaagtaaggtagggacgtacgtagtcg

SEQ ID NO: 97836 - DNA, 703 bp, Homo sapiens
  misc_feature: GYAE6OF01CD00O.4.60.F05.1.454.CMB.1.raw
  modified_base (179)..(179): a, c, t, g, unknown or other
  misc_feature (179)..(179): n is a, c, g, or t
  modified_base (252)..(252): a, c, t, g, unknown or other
  misc_feature (252)..(252): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtgttctaggtcgctatttaaaggntcagtgtgagtgcagctgctggagtctggggaggcttggacagcctgggggtccctggagctctcctgtgacncgctgtgtacttctacgttacgctaccagtcgtccgtggtacggttcggtccgccgtacggccgtaccggaggggtaacgggtcgtagggtacgggtcgggtcggacggacggtacgtacgtacgtaggtaggtaggtaaggtaaagttagttaagtttaaacgtaacgtaacgtaacgtaaccgtacgtaacgtacgtacgtacggtacgggtacgggtaccggtaccgtaccgtacctacgtaccgtaccgtaacgtaacgtaacgtaacgtaccgtaacgtacgtaaccgtaaccgttacgttacgtacgtacgtaacgtaacgtaacgtaacgtaacgtacgtacgacgacggtaccggaacggaccgtaccgtaccgtacgtacgtacgtacggacggtaacggtaaacggtaacggtaacgggtacgggtacgtacgtacgtacg

SEQ ID NO: 97837 - DNA, 503 bp, Homo sapiens
  misc_feature: GYAE6OF01BXPYK.4.60.F05.1.454.CMB.1.raw
  modified_base (153)..(153): a, c, t, g, unknown or other
  misc_feature (153)..(153): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (255)..(256): a, c, t, g, unknown or other
  misc_feature (255)..(256): n is a, c, g, or t
  modified_base (265)..(265): a, c, t, g, unknown or other
  misc_feature (265)..(265): n is a, c, g, or t
  modified_base (271)..(272): a, c, t, g, unknown or other
  misc_feature (271)..(272): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (300)..(301): a, c, t, g, unknown or other
  misc_feature (300)..(301): n is a, c, g, or t
  modified_base (303)..(303): a, c, t, g, unknown or other
  misc_feature (303)..(303): n is a, c, g, or t
tcagagcactgtagcacgaccggtgctcgatttagtacgtcatcagggaaaggggctctgagagaggagcccagccctgggattttcaggtgttttcatttggtgatcaggactgaacagagagaactcaccatggagtttgggctgagcggngtgttctaaggcggcatttaaaggntcagtgngagtcagctgctgagtntgggagcttggacagcctggggcctgancncnctgtgcagcntgattcagttnnacatgcagngtcgcnngtcacgaggaggtgngngngngngngcnngngtgtagtagagtagtagtagagagacgtacgacagacgtgtgcgacggacgtacacacactactacgacgacgacgtactacgtagacgacgtacgtactatactacgacgaatacgaacacgacgagagagacgacgacgacgacgtacgtacgtagacgacgacgaagaacgtacggtacggaacgtactagtgtacg

SEQ ID NO: 97838 - DNA, 517 bp, Homo sapiens
  misc_feature: GYAE6OF01CU73I.4.60.F05.1.454.CMB.1.raw
  modified_base (437)..(437): a, c, t, g, unknown or other
  misc_feature (437)..(437): n is a, c, g, or t
  modified_base (513)..(513): a, c, t, g, unknown or other
  misc_feature (513)..(513): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggcttttcttgtggctattttaaaaggtgtccagtgtgaggtgcagctgctggagtctgggggaggcttggtacagcctggggggtccctgagactctcctgtgcagcctctggattcacgtttagcaccaatgccctgagttgggtccgccaggctccagggaaggggctggagtgggtcgcaggcatcagtggtagtggaaatgattttaagacagactacgcagactctgtgaggggccgactcacatctcagagacaatccatcgaacaccctgtatctanacaatagaacagactagagagcgaggacgacggccgtactactactgcgacgaaagagtaaggtaggggactacgntacg

SEQ ID NO: 97839 - DNA, 538 bp, Homo sapiens
  misc_feature: GYAE6OF01AR400.4.60.F05.1.454.CMB.1.raw
  modified_base (442)..(442): a, c, t, g, unknown or other
  misc_feature (442)..(442): n is a, c, g, or t
  modified_base (531)..(531): a, c, t, g, unknown or other
  misc_feature (531)..(531): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacaggcctggggggtccctgagactctcctgtgcagcctctggattcacgtttagcaccaatgcccctgagttgggtccgccaggctccgagggaaggggctgggagtgggtcgcgaggcatcagtggtagtggaaatgattttaagacagactacgcagactcgtgtggaggggccgacgtcaccatctccagagacaattccatcgaaccacctntactctagacaatacgaacagactagagagaccgagacgacggaccgtatactacgtcgacgacgaaagacgtaaggaggggactacgngttacgg

SEQ ID NO: 97840 - DNA, 577 bp, Homo sapiens
  misc_feature: GYAE6OF01ACS0D.4.60.F05.1.454.CMB.1.raw
  modified_base (183)..(183): a, c, t, g, unknown or other
  misc_feature (183)..(183): n is a, c, g, or t
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcgtttctaggtcggctattttaaaaggngtcagtgtgaggtgcatctgctggagtntgggggagcttgggtacagccgtggggggtccctgagactctccgtgtgcagcctctggattcacgtttagcaccaatcgccctgnggttcgggtccgccaggcctccgaggggaagggcgtggagtgggcgcgaggcatcgagtggtagtggaatgtatttaagacagacacgcagactctggtgaggccgactcacctactcgaccgagaacgactaacttcaagtacgaaacccaccgtagtactacgtacgaactaacgtacgtaacgaacgacgtagacgacgacggacggacgacgtaccgtacgtacgtacgtcgacgaacgaacgtaacggtaacgggtagggtacgtacgtagtacg

SEQ ID NO: 97841 - DNA, 658 bp, Homo sapiens
  misc_feature: GYAE6OF01DLCAY.4.60.F05.1.454.CMB.1.raw
tcagagcactgtagcacgaccggtgctcgatttagtacgtcatcagggaaaggggctctgagagaggagcccagccctgggattttcaggttgttttcatttggtgatcaggactgaacagagagaactcaccatggagtttgggctgagcgtggtcgttttctaggtcggctaagttttaaaaggtgtccagtgtgaggtgcagctgcgtggagtcgtgggggaggcgttggtaccgaggtccgtcggggggttcccctggacgtacttcctccgttggtcgcgcgccctcgtggtattctaacggtttacaccaacccaagtcgccctggtacggttcggtccgccgacggcctccggaagggacgggcgtggaggtgggcgcgaggcagtcgtaggtggtagtaggaattagtaagtttaaagaccgtaagactacgaccgagtacgtcgtggtaggaccgggccgtaccgtaccacctacgtccgtacgaacgacgaacctacttaccgtaagtaccaaccgtaccctagtactcgtacgaacaagtacgtaacgaacgtacgtagacgacggaccgtagaccgacgtaccgtactaccgttaacgcgtacgaagaaacgtaacggtaggtacggggtaactaccgtagttacg

SEQ ID NO: 97842 - DNA, 529 bp, Homo sapiens
  misc_feature: GYAE6OF01BCWOI.4.60.F05.1.454.CMB.1.raw
  modified_base (524)..(524): a, c, t, g, unknown or other
  misc_feature (524)..(524): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctggggggaggcttggtacaggccgtgggggggtcccctggagactctcctgtgcaggcctctggattcacgtttagcaccaatgcccctgagttgggtccgccaggctccgagggaaggggctgggagtgggtcgcagggcatcagtggtagtggaaatgatttaagacagactacgcagactctgtgagggccgactcaccatctccagagacaattccatcgaacaccctgtactctgacaaatgaacagactagagagcgaggacacggccgtatactactgcgacgaaagataaggagggggactaccgngtacg

SEQ ID NO: 97843 - DNA, 559 bp, Homo sapiens
  misc_feature: GYAE6OF01BSOVS.4.60.F05.1.454.CMB.1.raw
  modified_base (381)..(381): a, c, t, g, unknown or other
  misc_feature (381)..(381): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgcgttttctagtggctattttaaaaggtgtccagtgtgaggtgcagctgctggagtctgggggagcttggtacagccgtggggggtccctgagactctcctgtgcagcctctggattcacgtttagcaccaatgccctgagtgggtccgccaggctccgagggaaggggctgggaggtgggtcgcgaggcatcgagtggtagtggaatgtatttaagacagactacgnacgactcgtgtggacgggccgacgtcacatcctccagagactaacttccatacgaacctaccctgtactctagacaaatagaacagactagacgagaccgaaggaccgaccggaccgtactacgtacgtcgaccgaacgaaacgtaggtaacgggtagggggaacctacgagttacgg

SEQ ID NO: 97844 - DNA, 567 bp, Homo sapiens
  misc_feature: GYAE6OF01EQTX8.4.60.F05.1.454.CMB.1.raw
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (470)..(470): a, c, t, g, unknown or other
  misc_feature (470)..(470): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttctgtggctaattttaaaaggtgtccagtgtgaggtgcagctgctggagtcgtgggggagcttggtacagccgtggggggtccctgagactctcctgngcngcctctggattcacgtttagcaccaatgccctgagttgggtccgccaggctccgagggaaggggctggagtgggtcgcaggcatcagtggtagtgaaatgattttaagacagactacgcagactcgtgtggaggggccgactcaccgatcctccagagactaacttccatagaaccaccctagtactcttagacaaacgtagaaacanacgtagacggacgaccggaacggaccgaaccgggtacccgtaagtacctacgtcgacgaccgaaagtaacgtaggtagggggactaccgagttacgg

SEQ ID NO: 97845 - DNA, 755 bp, Homo sapiens
  misc_feature: GYAE6OF01DFA58.4.60.F05.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtgtttctaggtggctatttaaaggngtcagtgtgagtgcagctgctggagtcgtgggggagcttggtacnggcctgggggtccctgagctctcctgtgcagccctctggatttcacggtttanccacaaacttggcccctgtcggtttcgggtcccgccgtacgggccacccggaggggaaccgggggtctagggggtggtcgggtcgacgacggacagtacgtaggtaggtaagtaaggtaagttacggttaaagtttaagaacgtaacggtacgtacgacgtacgtacgttacgtagggtacggtaccgggtaccctaccgtaccgtacccttaccgtaccgtaaccggaaacgtaaccgtaacttaaccgttaccgaaacgtaacccgtaacccgttacccgttacgttacttaccgtaacgtaacgtaaacgtaaccgaaacgtacggtaacgtacgggacgaaccgggtaacccggacgggtaaacccggtaccggtaacccgttaacgttaacccgtaacggtccgaaaccgggtaaacggtaaacggtaacgggttaaacggggtaaccgggtaacctaccggttagttacgg

SEQ ID NO: 97846 - DNA, 559 bp, Homo sapiens
  misc_feature: GYAE6OF01EK6XS.4.60.F05.1.454.CMB.1.raw
  modified_base (553)..(553): a, c, t, g, unknown or other
  misc_feature (553)..(553): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtgtttctaggtcggctaatttaaaggtgtcagtgtgaggtgcagctgctggagtcgtgggggagcttggtacagcctggggggtccctgagactctcctgtgcagcctctggattcagtttagcaccaatcgccctgagttggtccgccaggcctccgagggaagggcctggaggtggtcgcaggcagtcaggtgagtggaaatgtatttaaggacagtaccgtagcagactcgtgtggagggccgaactcacatcctcagagacaacttaccatacgaacctacctacgttaactcgtgtaccaaagtcgtaacacgacgtagagacgaccggaacgaccgaaccggcgtaacgtacacgtgacgaagaacgtaaggtaaggtacgggggacctacgngttacg

SEQ ID NO: 97847 - DNA, 529 bp, Homo sapiens
  misc_feature: GYAE6OF01CO9BX.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctatttaaaaggtgtccagtgtgaggtgcagctgctggagtctgggggaggcttggtacagcctggggggtccctggagactctcctgtgcagcctctggattcacgtttagcaccaatgccctgagttgggtccgccaggctccagggaaggggctggagtgggtcgcaggcatcagtggtagtggaaatgattttaagactagactacgcagactctgtgaggggccgactcaccatctccagagacaattaccatacgaacaccctgtatctgacaaatgaacagactagagagccgaggaccgacggaccgtatactactgacgacgaaagagtaaggtgggggactacgtgttacgg

SEQ ID NO: 97848 - DNA, 568 bp, Homo sapiens
  misc_feature: GYAE6OF01D4PXX.4.60.F05.1.454.CMB.1.raw
  modified_base (425)..(425): a, c, t, g, unknown or other
  misc_feature (425)..(425): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctggagtcgtgggggagcttggtacagccgtggggggtcctgagactctcctgtgcagcctctggattcacgtttagcaccaatgccctgagttgggtccgccacggctccgaggggaagggcgtggaggtgggtcgcgagggcagtcaggtggtaggtaggaaatgtaattttaagacaagactacgcagtactcgtgtggagggccgactcaccatcnccgagacgacaacttccatacgaaccaccctgtatctagacaaactagaacagactagacgacgaccgaacggaccgacggaccgtaacgtactacgtcggacgacgaaaagagtaaagggtaggggaactaccgagttacgg

SEQ ID NO: 97849 - DNA, 600 bp, Homo sapiens
  misc_feature: GYAE6OF01C5BIX.4.60.F05.1.454.CMB.1.raw
  modified_base (483)..(483): a, c, t, g, unknown or other
  misc_feature (483)..(483): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggctattttaaaggtgtccagtgtgaggtgcagctgctggagtcgtgggggagcttggtacagccgtggggggtccctggagactctcctgtgcagcctctggattcacgtttagcaccaatgcccctgagttcgggtccgccgacggctcccgaaggggaacggggctgggagtgggtcgcagggccatcaggtggtaagtggaaatgtaattttaaggactagactacggcagtactcgtgtaggacggggccgacgtccaaccgatcctaccaagagacctaattacccgatacgaaccacctacgtatacgtnaaccaaatagaacagactagacgaggaccgaacggaccgaacggccgtaactaaccgtactcggaccgtaccggaaaagtacggtaaagggtcgggggaaactaccgtaagttacgg

SEQ ID NO: 97850 - DNA, 565 bp, Homo sapiens
  misc_feature: GYAE6OF01BNHNY.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacaggccgtggggggtccctggagactctcctgtgcagcctctggattcacgtttagcaccaatcgccctgagttgggtccgccaggctccgagggaagggctggagtgggtcgcgaggcatcgagtggtagtaggaaatgtaatttaagactagactacgcagactctgtggacggggccgactccaccactcctaccgaagacgactaacttccaatacgaaccaccctagtactctagactaaatacgaacagactagagacgaccgacggacgaccggaccgtactactacgtcgacgacgaaagtacgtaagggacggggaactacgagttacg

SEQ ID NO: 97851 - DNA, 540 bp, Homo sapiens
  misc_feature: GYAE6OF01B23MD.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctggagtcgtgggggagcttggtacagccgtggggggtccctgagactctcctgtgcagcctctggattcacgtttagcaccaatgccctgacgttggtccgcaggctccgagggagggctggagtgggtcgcgaggcatcgagtggtagtagaatgaatttaagacagactagcagactcgtgtgacgggccactcaccgatccaccagacgactaatccaatacgaactaccctagtactctagactaaatagaacagactagagacgcgacgacacggacgtacgtacagtcgacgaacgaaagtagtaacgggaggggacctagagttacgg

SEQ ID NO: 97852 - DNA, 774 bp, Homo sapiens
  misc_feature: GYAE6OF01CLR16.4.60.F05.1.454.CMB.1.raw
  modified_base (162)..(162): a, c, t, g, unknown or other
  misc_feature (162)..(162): n is a, c, g, or t
tcagagcactgtagcacgaccggtgctcgatttagtacgtcatcagggaaagggggctctgagagaggagcccagccctgggattttcaggttgttttcatttggtgatcaggactgaacagagagaactcaccatggagtttggctgagctggtctttttnttgtggtcttaagtttttaaaaggtgtccagtgtgaggtgcagctgcgtggagtgtgggggagcgttgggacacggtcccggtgggggggttcccctgggaacgtacttccgttcctggttcgaccgacggcccttcgtcgggtaattccgtaaggttttaacgacctaaacccaaattcggaccccgttcggtaaggttttccggggtcccgcccgtaacgggccgttacccggaagggggtaaaaggggggccgtaaggggtacggttgggggtaccggccgaaggggacccgtaaattccggaaagggttagggttaaagggttaacgggaaaaaagttggttaaaaacgttttaaaggaacgtaaacggaaaccgttaacggaacgtaacgaacgttccggtggttacgggaacgggggtacccaaccgttaccaaccgtaacgtcctaccgaagaacgaactaacgttacatacgaaacctaccctagtactacgtaacaacaaagtaacgaaaccaagtacgagaagacgacggaacggacgacgtaccgtaatacgactcgacgaacgaaacgaagtaacgggaaggggaactaccgtagttagg

SEQ ID NO: 97853 - DNA, 568 bp, Homo sapiens
  misc_feature: GYAE6OF01BYOMO.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtctttttctgtggctaattttaaaaggtgtccagtgtgaggtgcagctgctggagtcgtgggggaggcttgggtacaggccgtgggggggtcccctggacgactctcctgtgcagcctctggattcacgtttagcaccaatgcccctgagttgggtccgccaggctccgagggaaggggctgggagtgggtcgcgaggcagtcgagtggtacgtggaaatgattttaagacagactacgcagactcgtggtgacgggccgacgtcaccactcacgagagaactaacttccatacgaaccacctagtactctagactaatagaacagactagacgacgacgacggacgacggaccgtaactacctacgtcgacgaaccgaaagtagtaagggtaggggaactaccgagttacgg

SEQ ID NO: 97854 - DNA, 583 bp, Homo sapiens
  misc_feature: GYAE6OF01DE5Q7.4.60.F05.1.454.CMB.1.raw
  modified_base (378)..(378): a, c, t, g, unknown or other
  misc_feature (378)..(378): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatgggagtttgggctgagcgtggtcttttctgtggctattttaaaaggtgtccagtgtgaggtgcagctgctggagtcgtgggggagcgttggtacagccgtggggggtccctggagactctcctgtgcagcctctggattcacgtttagcaccaatgccctgagttcgggtccgcgaggctccgagggagggctggagtgggcgcgaggcatcaggtggtagtaggtaaatgtaattttaaganacgtactacgcagtactcgtgtaggagggcccgactccgacactcctacagacgactacttaccatacgaacctacccgtagtactctagtacaaacgtgaacacgtactaggacgacggtaccgacggaccgacggtaccgtaactacctacgtcggacgaacggaaacgtagtaacgggtaggggtaacctacgtagttacgg

SEQ ID NO: 97855 - DNA, 692 bp, Homo sapiens
  misc_feature: GYAE6OF01DRFL2.4.60.F05.1.454.CMB.1.raw
  modified_base (349)..(349): a, c, t, g, unknown or other
  misc_feature (349)..(349): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtgtttctaggtcggctaatttaaaaggtgtcagtgtgaggtgcagctgctgggagtcgtgggggagcgttgggtaccaggccgtggggggtccctgacgtctctcctgtcgcagccctctggtaattctaccgtttagaccaccaattcggcccctgaggtttgggtccgccgcggctccggaggggaaggggntggggtgggtcgggtcgacgaggtctagtacggtaggttaggtaaggtaaggtaaagttaggtttaaacgtttaaaggaacgtaacgtaacgtacgacgtacgtacgtcggtggtacgggaccgggtacccgtacctaccgtaacctactaccgtaacgaacgtaacgtaactaacttacctactaaccgaacctaccgttagtacgtacgtacgtaacgtaacgtaacgtaacgaacgtacgtacgacgacggaccggacggaccggaccgtaccgtacgtactacgtacgacgaacggaaacggtaacggtaacgggtaacgggtaacggtacgtcgtacg

SEQ ID NO: 97856 - DNA, 649 bp, Homo sapiens
  misc_feature: GYAE6OF01AMG1T.4.60.F05.1.454.CMB.1.raw
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (551)..(551): a, c, t, g, unknown or other
  misc_feature (551)..(551): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtgtttctaggcgctatttaaagntcngtgtgngtgcngctgctggagtgtggggagnttggcagccgtgggggtccctgagctctcctgtncgngtccctntggattcacgtttacgcaccaatcgcctgtggttcggccgccngccnccggagggagggcgtggnggtgggcgacgagggcacgtcgtaggtggtaaggtagggtaaattgtaacgttttaacgacgaaggtacctacggacagtaccgttcgtacggtggaccggggacctaccttacgaccctaacgtcctacccgaaggaacctaactaaccttacctaacgttaaccgaacccgtacccccgttagtaaccttcttaaccggaaccttaaaggtaactaaacgacgtaacncggacgaacggaccccggaggaaaccgaccgggtacctacgtacgtcgtacggaccgaagaaggtaacgtaggggtaccgggtactaccgtgttacgg

SEQ ID NO: 97857 - DNA, 635 bp, Homo sapiens
  misc_feature: GYAE6OF01CIXHF.4.60.F05.1.454.CMB.1.raw
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtcgtgtttctaggcggctatttaaaggngtcagtgngaggtgcagctgctggagtcgtggggcggcgtgtagngccgtggggtccgtgagctctcctgtggcgcgcgtcgtgtcgttcgtacgttacgacacacgtcgtccgtgtggttcggtccgcgcgcgcggaggaggngtggtgtggtcgngacgcgacgtcgtgtaggtaggtaggtaagtagttaagttaagtaacgtaacgtacgtaacgacgtaacgtacgtcgtacggtacggtacgggaccggtaccgtaccgtacctacgtaccgtaccgaacgacgtaacgtacgttacgtacgtacgtaacctaccgtacgtacgtacgtacgtaactaacgtacgtaacgacgtacgagacgacgacggacgaccgaccgtacgtacgtacgtacgtcgacgtaacggaaggtaacggtaacgggtaacgggtaacgtacgtagtacg

SEQ ID NO: 97858 - DNA, 793 bp, Homo sapiens
  misc_feature: GYAE6OF01ECJ44.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggtagtttgggctgagcttggtctttttcgttgtgtacttaagttttaaaggtgtcctagtgtgaggtgcagctgcgtggagtcggtggggagtcgttaggtacaggtcccggtcgggggtccctaggacgtacctctcgtgtcgcgacgtcctcgtggtattcgtacgttacgacctaaccatccgccgtaggtcggttcggccgaccgacggtccgtacggaaggggtacgggtcggtagggtacggtcggggtccgacggtacggcgtacgtcggtaggttagggttaacggtaagggtaaagttaggtttaaacgttttaaacggaccgtaaacggtaaccgtaaccggacgttaacggtaccgttacggttacgggttacgggaccggggtaacctacccgttaccgaacctaccgtaccgtaacccgtaaggaaccgtaacctaaaccgttacgtaacgtaacccgtaaacccgtaccgttagtaccttacgacgtaaactaacgtaacgaacgtaacggtacgtacggaaccggaccggtaccggaacggtaccgaaccggttaccgtaacgttaaccgaacgtacggaaccgggaaaggtaaacggtagggtaacggggtaaccggtaacgttaacccgaggtttaccgg

SEQ ID NO: 97859 - DNA, 563 bp, Homo sapiens
  misc_feature: GYAE6OF01D18DL.4.60.F05.1.454.CMB.1.raw
  modified_base (380)..(380): a, c, t, g, unknown or other
  misc_feature (380)..(380): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacagccgtggggggtccctgagactctcctgtgcagcctctggacttctacgtttagcaccaatcgccctgacgttgggtccgcacggcgtccgaggggaagggcgtggagtgggtcgcgaggcatcgagtggtagtaggaaatgtatttaacganagactacgcagactcgtgtggagggccgacgtacacctatccaccagacgactaacttccatacgaacctacctagtatctacgacaagtacgaacagactagagacgacgacggacgaccggtaccgtactacgtacgtcgacgacgaaaggtacgtaaggtaggggactaccgtgttacgg

SEQ ID NO: 97860 - DNA, 534 bp, Homo sapiens
  misc_feature: GYAE6OF01BC9GN.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttgggtacagcctgggggggtccctgagactctcctgtgcagcctctggattcacgtttagcaccaatgccctgagttgggtccgccaggctccgagggaaggggctggagtgggtcgcaggcatcagtggtagtggaaatgaattttaagacagactacgcagactctgtgaggggcgactcaccatctccagagacaacttccatcgaacaccctgtactctgacaaatacgaacagactagagacgcggagacacggaccgtactactactgccgacgaaagacgtaacggagggggactaccgattacgg

SEQ ID NO: 97861 - DNA, 651 bp, Homo sapiens
  misc_feature: GYAE6OF01A0FS1.4.60.F05.1.454.CMB.1.raw
  modified_base (166)..(166): a, c, t, g, unknown or other
  misc_feature (166)..(166): n is a, c, g, or t
  modified_base (179)..(179): a, c, t, g, unknown or other
  misc_feature (179)..(179): n is a, c, g, or t
  modified_base (251)..(251): a, c, t, g, unknown or other
  misc_feature (251)..(251): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcgtttctaggngctatttaaaggngtcagtgtgagtgcagctgctggagtcgtgggggaggcttggtacagccgtggggggtccctgagctctccngtgcacgcctactggattacgtacgtttagccacctaaatcggccccttggacggttcggggtccgccgaggcctccgaggggaacggggcgtgggagtgggtcgcgaggctagtcgaggtcggtagtggaagtgtaagttttaagactacgtactacgcgaacgtctcgtagtggacggggccgacttaccgaccctaatccgtaccgacggaacgtaacctaacttaccaagttacgaccgttaacccgtggttaactcgtacgtaacaaacgtacgaaacctagacgtagaacggtacgaccggaggaaccggaccggtaccgttaaacgttacgtaacgtcgaaccggacggtaaaacgtaacggtaacgggtaggggtacctaccgtagttacgg

SEQ ID NO: 97862 - DNA, 756 bp, Homo sapiens
  misc_feature: GYAE6OF01B4O8Q.4.60.F05.1.454.CMB.1.raw
  modified_base (154)..(154): a, c, t, g, unknown or other
  misc_feature (154)..(154): n is a, c, g, or t
  modified_base (180)..(180): a, c, t, g, unknown or other
  misc_feature (180)..(180): n is a, c, g, or t
  modified_base (404)..(404): a, c, t, g, unknown or other
  misc_feature (404)..(404): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggngtgttctaggtcggctatttaaaggngtcagtgtgaggtgcagctgctggagtcgtggggcgcttggacagtccgtgggggtccctgacgctctccgtgtaggcacgtccctgtacggtattctaacgtttacggcctaaccaaagtcggtaccccgttggaacgggttttccgggtacccgaccgtacgggccgttaccccggagggggaaaccggggtccgttggggtacgggttgggtccggaacgngggtccaagtccgtaggtagggttaagtaggggtaaaatttggtaaccgttttaaaggaacacggtaaccgttaaccgagtaaacgtaccgtttcgttacgggttaaggtccgggggtacccacggttacccgaaccctacgttacccgtacccgtaaggaacggtaaccttaaaccggttacccaacgtaccggtaaaccttaccccggttagttaaccgtacttaacggacctaaagttaaccgaaacgtaccgtagtacgggaacgacgtaccgaacgacggaccggtacgtactcgaacgtggacgtaacggaagtacggtaggtaggggaaccttacgtgttaccgg

SEQ ID NO: 97863 - DNA, 701 bp, Homo sapiens
  misc_feature: GYAE6OF01CX93J.4.60.F05.1.454.CMB.1.raw
  modified_base (691)..(691): a, c, t, g, unknown or other
  misc_feature (691)..(691): n is a, c, g, or t
tcagagcactgtagcacgaccggtgctcgatttagtacgtcatcagggaaagggggctctgagagaggagcccagccctgggattttcaggttgttttcatttggtgatcaggactgaacagagagaactcaccatggagtttgggctgagcggtgtcgtttctaggtcggctaagtttaaaggtgtccagtgtgaggtgcagctgctggcgtcgtgggggagcttgggtacaggccgtggggggtccctggacgactcctccgtgtcgcacggccctcgtcggtattaccgtacggttttaacgaccacccaaagttcgtccccgttggtacggtttcggggtccccgccgacggccgtcccgaagggggaacggggtctggggaggttgggcggacgagggactatacgtaggtgggtaaggtaaggtaaacgttagtaaagttttaacgaacgtacgtaacgtaccgcgtaagaacctcgttggtacgggaacggggcccacgtcccaacacttccgaacccaggaactaactacttaccaaacgacgaaccctacctagttactcgtacgaacaaagtacgaaccgagaagttacggagacggacggacggaaccgtaccggacgttactaacggcttacggacggaaacgaaaggtacggtaaagggaccggggtaactaaccggngtttaaccgg

SEQ ID NO: 97864 - DNA, 569 bp, Homo sapiens
  misc_feature: GYAE6OF01BN4L4.4.60.F05.1.454.CMB.1.raw
  modified_base (562)..(562): a, c, t, g, unknown or other
  misc_feature (562)..(562): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacagccgtggggggtccctgagactctcctgtgcagcctctggattcacgtttagcaccaatcgccctgagttcgggtccgccgaggcctccgaggggaaggggcgtgggaggtgggtcgcgaggcagtcagtggtagtggaatgtaatttaagacagactacgcagactcgtgtggacgggccgacgtccaccactcctccagacgacaacttccatacgaaccaccctgtactctagacaaatacgaacagtacgagacgacggaccggaggaccgaccggaccgtactacgtacgtcgacggacgaaagtagtaagggtacgggggactaaccgngttacgg

SEQ ID NO: 97865 - DNA, 627 bp, Homo sapiens
  misc_feature: GYAE6OF01BMO17.4.60.F05.1.454.CMB.1.raw
  modified_base (263)..(263): a, c, t, g, unknown or other
  misc_feature (263)..(263): n is a, c, g, or t
  modified_base (326)..(326): a, c, t, g, unknown or other
  misc_feature (326)..(326): n is a, c, g, or t
  modified_base (421)..(421): a, c, t, g, unknown or other
  misc_feature (421)..(421): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgcgtggagtcgtgggggagtcttggtacaggccgtggggggtccctggagactctcctgngcagcctcgtggtacttctacgtttacgaccaaccaatcgccctggacggtttcggggtcccnccgaggccgtaccggaaggggaacgggcgtagggaggtcgggtcgcgaggcatcgaggtggtagtaggaacttgtaatttaagacagtactacgnacgactcgtggtaggacgggccgacgtccacgtactaccgtacgagaacgaactaactaccacgtacgaacctacccgtagttactacgtagaactaaagtacgaaacgagtaacgtaggacgacggaccgaacggaccgacgtaccgtaactacgtacgtcgacgacgaaagtacggtaacggacggggtacctacgtagtacgg

SEQ ID NO: 97866 - DNA, 909 bp, Homo sapiens
  misc_feature: GYAE6OF01B6OOO.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcacatggagtttgggctgagctggtctttttcttgtggtcttattttaaaaggtgtccagtgtgaggtgcagctgcgtggaggtcggtgggggaggtcgttgggtacgacggtcccggttcggggggtccctggacgtaccttctccgtgtcgcacgtccttcgtggtacttcgtacgtttacgaccaaccaagtccggccccgttggtacgggtttcggggtcccgaccgtacgggtccgtacccggaagggggtaacgggggtccggtagggggtacgggttcggggtaccggaccggaacgggtaccgtaacggttaccggtaagggtttacggggttaaagggttaaacggggtaaaagtttaggtttaaaacgtttttaaaacgggaaccgtaaacgggtaaacccgttaaccggaaccggtaacgttaccgttacggttacggggttacggggaaccggggtacccgtaaccgtacccgtaaacccgtaccgttacccgtaaccgaaacggtaacgtaaaccttaaccgttaaccgtaacgtaacccgtaacccttaccccgttagttaacccgttacgtaacgaaacgtaaactaacggtaaaccgaacgtaacgtacggaacggtaccggaacccgggaacggtaacccggtaaccgggtacccgtaaaccgttaaccggtaaccggtaccggaacccggtaaacggtaaaacgggtaacgggttaaacgggggtaaccggggtaaacccttaaaccggtggtttaaccggg

SEQ ID NO: 97867 - DNA, 642 bp, Homo sapiens
  misc_feature: GYAE6OF01CK2DX.4.60.F05.1.454.CMB.1.raw
tcagagcactgtagcacgaccggtgctcgatttagtacgtcatcagggaaagggggctctgagagaggagcccagccctgggattttcaggttgttttcatttggtgatcaggactgaacagagagaactcaccatggagtttggctgagcgtgtcttttctgtggctattttaaaggtgtcagtgtgaggtgcagctgctggagtcgtggggaggcttggtacaggccgtgggggtccctgagactctcctgtgcagcctctggattcacgtttagcaccaatcgccctgacgttcgggtcccgccaggcctaccgagggaaggggctgggaggtgggtcgcgaggcagtcgagtggtagtggaaatgtaagttttaagacgagtactacgacagtactcgtaggtacggacggggcccgacgtaccgaccctactacctccaagacgaactaacttaccaacgtacgaaccctacccgtagttactacgttacgaactaaacgtacgaaacacgtaacgtacggaagaccggtaccggaaggaaccgaccggaccgttaaacgtacccttaacggtcggaccgaacggaaaaggtaacggttaacgggtacgggggtaacctaacccgtaaggtttacgg

SEQ ID NO: 97868 - DNA, 611 bp, Homo sapiens
  misc_feature: GYAE6OF01CVVRU.4.60.F05.1.454.CMB.1.raw
  modified_base (184)..(184): a, c, t, g, unknown or other
  misc_feature (184)..(184): n is a, c, g, or t
  modified_base (355)..(355): a, c, t, g, unknown or other
  misc_feature (355)..(355): n is a, c, g, or t
  modified_base (442)..(442): a, c, t, g, unknown or other
  misc_feature (442)..(442): n is a, c, g, or t
  modified_base (483)..(483): a, c, t, g, unknown or other
  misc_feature (483)..(483): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
tcagagcactgtagcacgaccggtgctcgatttagtacgtcatcagggaaaggggctctgagagaggagcccagccctgggtattttcaggttgttttcatttggtgatcaggactgaacagagagaactcaccatggagtttggctgagcgtgtcgtttctaggtggactaagttttaaaggngtcagtgtgaggtgcagctgcgtggacgtcggtgggggagtccgttgggtacaggccggtcggggggtcccctaggtaagaccttcctccgtgtgactacgcccttcgtcggtaattccggtattttaacgctaacccgaatccgccgtggtacggttcgggtcccgccgnggccgtccgaaggggaagggcctgggaggtggcgcgaaggcaagttcgagtgtaagtaggaaatgtaagtttaagactagtacacgngaagtctcgtgtcggaaggccgtacgcacctatcgcaaganacctatcatagaacctcgatacnctacgaactaagaanaacgacgacgtagacgacgacgacgacgtacgacgtacgtactacgtcgacgaacgaacgtaacggtacggtaggtacgtacgtagtacg

SEQ ID NO: 97869 - DNA, 572 bp, Homo sapiens
  misc_feature: GYAE6OF01EJVXM.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttctgtggctatttaaaaggtgtcagtgtgagtgcagctgctggagtcgtggggggagcgttagggtacaggccgtggggggtcccctggacgactctcctgtgcagcctctggtattctacgtttagcaccaatcgccctgagttgggtccgccgaggctcggagggaagggcgtggagtgggtcgcgaggcatcaggtggtagtggtaaatgtaagttttaagacagactacgacgagactctgtggaggggtccgactcgaccatcactagacgactacttacagtacgaaccacctagtactctacgacaaagtagtaacacgactgacgagccgaacggacgaccggtacgtacttaacgacgtcgacgacggaaagtaagtaacgggtaggggaactaccgagttacg

SEQ ID NO: 97870 - DNA, 609 bp, Homo sapiens
  misc_feature: GYAE6OF01CD2EI.4.60.F05.1.454.CMB.1.raw
  modified_base (393)..(393): a, c, t, g, unknown or other
  misc_feature (393)..(393): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctgctggagtcgtgggggagcgttggtacagccggtggggggtcctgagactctctgtgcagcctctggattcacgtttagcaccaatcgccctggagttcggtccgccgacgctaccgaggggaacgggctgggaggtgggcgcgaggcagtcgagtggtagtaggaatgtatttaagacagactacgnacgactcgtgtaggacgggccgacttacaccatcctacgaagagaccaacttccaacgtacgaacctaccctagttaactctacgaactaaagtcgaaacagtaactaggacgacggacggacggtacgaccggtaccgtaactacttacgtacggaccggaacgtaaaggaacggttaaacggggtagggggtaaccctaacggacgtttacggg

SEQ ID NO: 97871 - DNA, 609 bp, Homo sapiens
  misc_feature: GYAE6OF01C3QL9.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctggagtcgtgggggagcgttggtacagccgtggggggtccctggacgactctcctgtcgcagcctctggattcacgttttagcaccaatgcccctgaggttgggtccgccgaggcctccgaaggggagggggctgggaggtgggtcgcgaggcagtcaggtggtagtaggaaatgtaattttaaggacagactacgcagactcgtgtggacggggcccgactcaccatcctacaacgagaactaacttccaactacgaacctaccctagttattactacgactaaaactacgaaacgacgaacgtagaggacgaccggaaggaccaaccgggaccgtaactactacggtacgaccgaacggaaacggtaagtaaacgggtgggggaacctaccgtagtttacgg

SEQ ID NO: 97872 - DNA, 575 bp, Homo sapiens
  misc_feature: GYAE6OF01BVFOR.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacagcctggggggtccctgagactctcctgtgcagcctctggattcacgtttagcaccaatcgccctgagttgggtccgccaggctccgagggaaggggctggagtgggtcgcaggcagtcagtggtagtggaaatgatttaagacagactacgcagactcgtgtggaggggcccgactcgaccatctaccagacgacgaattccatacgaacctaccctgtactctgacaaatacgaacacgaacgtagacgacggaccggaggaccgaccggtacccgtaacttaccgtacgtcgaccggaccgaaacggtaagtaaacgggtaggggggaacctaaccgtagttacgg

SEQ ID NO: 97873 - DNA, 728 bp, Homo sapiens
  misc_feature: GYAE6OF01BZPB2.4.60.F05.1.454.CMB.1.raw
tcagagcactgtagcacgaccggtgctcgatttagtacgtcatcagggaaagggggctctgagagaggagcccagccctgggattttcaggggtgttttcatttggtgatcaggactgaacagagagaactcaccatggagtttgggctgagcgtggtcttttcgtagtggctaatttaaaggtgtcagtgtgaggtgcagctgcgtggaggtcgtgggggaggtcgttcggtacagtccggtcgggggggtccctaggacgtacctctccgtgtcgcacgccctcgtggtattcgtacgtttacgccaacctaatcgcccgttaggtacggttcgggtccgccgacggccgtccggaagggggacgggtcgtagggacggtcgggtcgcgaggcctagtcgtaggtagggtaggtacggtaaagtagttaagtttaagacgtagtaactacggctacgacttcgtaggtacgggacgggtacccgtacgtacgaaccctacgtacctaccgaaaggtactaaccgtaacgttaccacgtaaccgaacctacccgttataccgtactacgtaagtaaacgtacgaaaccgaagtacgtaacgggtagaaccggaccggtaacggacccgaacggggtaacccttaacgtaacccggttacggtacggaccggaaacgggtaaagggaacgtaacggggtaacccggggtaacttacggtagttacggg

SEQ ID NO: 97874 - DNA, 803 bp, Homo sapiens
  misc_feature: GYAE6OF01B5Z8S.4.60.F05.1.454.CMB.1.raw
tcagagcactgtagcacgaccggtgctcgatttagtacgtcatcagggaaagggggctctgagagaggagcccagcccctgggattttcaggttgttttcatttggtgatcaggactgaacagagagaactcaccatggagtttggctgagcgtgtcttttctgtggcttatttaaagtgtcagtgtgaggtgcagctgcgtggagtcgtgggggagtcgttggtacgacggtccggtcggggggttccctggacgtaccttccgtccgtggtcgccgtacgtcccttgtagggtactttccgtaacggttttaacgacctaacctaagtccgtccccgtaggtacggtttcggggtccccgaccgacgggtcccgtacccgggaagggggaacggggtcgtacggggaggtcggggtacgccgagggtacctagtaccgaggttagggtaggtaaggaaagttggttaaagttttaaagaacctaacggtaccttaacggactaacgacgttaccggtaggtcgggaacggggacccgtaaccgtccgtaaccgaagttcccgaacccgaaggtaaccgtaaccgtaaccgttaacccgtaactaccggaaacccctacccgtttagttaaccttccgttaacggaaacctaaacggtaccgtaaaacgtacgtaacgttaggaaccggtaccggacccgggaaaggtacccggaaccggttaccggtaaacttaccgtaacggtcgaaccggtaacggaaacggtaggtaacggggacgggtaacctaacgaggtttacgg

SEQ ID NO: 97875 - DNA, 852 bp, Homo sapiens
  misc_feature: GYAE6OF01A0JZ6.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttctgtggcttaatttaaaggtgtccagtgtgaggtgcagctgcgtggagtcggtgggggagtcgttggacgaggtccggtcggggggtccctggacgtacctcgttccgtggtcgcgacgtccgtcgtaggtactttccgtaacggtttaacgacctaaccctaagttccggtccccgttagggtaccgggtttccgggggtccccggacccggtacgggtccgtaccggggaacggggggtaacggggtccggttaggggtacgggttcgggggtccgacggaacgggtccgtaacgttaccggtaagggtaggggttaacggttaagggtaaaagtttaggtttaaacggttttaaacggaacgtaacgggtaaacccgtaaccggtaccgaaacggttaccgttacggttcggggtaacggggtaaccgggggtaccccgtaaccgtaccctaacccgtacttacccgtaccgaacgtaaccgtaaccttaacgttacccgaacgtaaccgaaccctaccgttagtaccttacgtaacgtaactaaacgtaacgaacgtaacgtacgtagacggacggaaccggacggaacccgaccggtaaccgtaacgtaccgtacgtacggaacccgtaaggtaaaacggtaacggtaacgggggtaaggggtaaccctaacggttacggttacgg

SEQ ID NO: 97876 - DNA, 856 bp, Homo sapiens
  misc_feature: GYAE6OF01DV179.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggtcttattttaaaaggtgtccagtgtgaggtgcagctgcgtggagtcgtgggggaggtcgttgggtacgacggtccggtcggggggtcccctggacgtaccttccgtccgtgtcgcacgtcccttcgtaggtactttccgtaacggttttacgaccgaacctaacgttccggtaccccgttagggtacgggtttccggggtcccggtacccggacgggtccgtaccgggaagggggaacggggtcggtaggggtacggttggggtccggacggacgggtcctaacgtacgtaggttagggtaaggtaaggtaaagttagtaaagttttaaagaacgtaacgtaccgtaacgtacgtacgtaacgttcgtagggtacgggaccggggacctaccgtaccaaccgtactcccgtaccgaaggaacgtaacctaacgttacccgtaagtaccggaaccctacccgttagttacttaccggtaacgaaaccttaaagaccggtaaacgtaacggtaacgtaggtaaccgggacggaaaccccgggtaacggtaaaccccggtaaccgggtaacccgttaaaccgttaaccggtaaccccggttaacgggaacccgggtaaaacggtaaaacggtaaacgggtttaaccgggggaaaccggggttaaccctaaacggttacggttttaaccggg

SEQ ID NO: 97877 - DNA, 795 bp, Homo sapiens
  misc_feature: GYAE6OF01CITEZ.4.60.F05.1.454.CMB.1.raw
tcagagcactgtagcacgaccggtgctcgatttagtacgtcatcagggaaagggggctctgagagaggagcccagccctgggattttcaggttgttttcatttggtgatcaggactgaacagagagaactcaccagtggtagtttggctgagtctggtctttttcttgtggtacttaattttaaaaggtgtccagtgtgaggtgcagctgcgtggaggtcggtgggggagtcgttaggtacgacggtccggttcggggggtccctggacgtaccgttccgtccgtgtcgacctacgtcccgttcgtggtacttaccgtaacgtttacgacctaacctaagtccgtccgtggtacggttcgggtccgaccgacggtccgtacggaaggggtaacgggtcgtagggtacggtcgggtcgacgtacggctacgtacgtaggtggtaaggtaaggtaaagttagttaaagtttaaacgaacgtaacgtacgtaacggacgtaacgtaccgttcggttacgggtacgggtaaccggggacccgtaaccgtacccgtaaccctaacgttacccgtaaccgtaaacggtaaccggtaaccctaaacttacccgtaaacgtaaccgtaaaccctacccgttaacgttacttaccgtaacgtaacgtaaacgttaacgaaacgtacgtaacgtacggacggaaccggtaccggaacggaccgtaccggtaccgttaacgtaaccgtacgtacggacggaaacggaaaggtacggtaagggtacgggtaacctacggtgttacgg

SEQ ID NO: 97878 - DNA, 889 bp, Homo sapiens
  misc_feature: GYAE6OF01ASQ5O.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcttttctgtggcttattttaaaaggtgtccagtgtgaggtgcagctgcgtggagtcggtgggggagtcgttcgggtacgacggtccggttcgggggggtcccctggacgtaccttccgttccgtggtcgtcctacgtcccgttcgtgggtactttaccgtaacggttttacacctaaccctaacgttccggtaccccgttgggttaacgggtttccgggggtccccgtacccggtaccggggtaccccgttacccggggaacggggggtaaacgggggtccggttagggggtaacggggttccgggggtaccggtccggaaacggggtcgtacggttaccggtagggttagggttaagggtaagggttaaagttacggtttaaagttttaaacggaacgtaacgtaccgtaccggaccgtaagtaccgttcggtagggtacgggaccgggggtaccctaaccgtcccgtaacctaccgttaccgtaccgaacgtaacgaaccttaaccgttaaccgacgtaacccgtaaccctaaccccgtagttacctacgtaacgaacgttaaacgtaaccgtaaagaccgtaacgtacggtaaccggacggtaacccggggaacggtaacccgaacccgggttacgttaaaccgttaccgtacggtaccggaccggaaaacggtaaacggtaagggttaaacggggtacggggttaaccctaacgggtagtttaaccggg

SEQ ID NO: 97879 - DNA, 800 bp, Homo sapiens
  misc_feature: GYAE6OF01C9U43.4.60.F05.1.454.CMB.1.raw
tcagagcactgtagcacgaccggtgctcgatttagtacgtcatcagggaaagggggctctgagagaggagcccagccctgggtattttcaggttgttttctatttggtgatcaggactgaacagagagaactcaccatggagtttggctgagcgtgtcttttctgtggcttaatttaaaggtgtcagtgtgaggtgcagctgcgtggagtcggtggggagcgttgggtaacgcggtccgtcggggggtccctgacgtctccgtcctgtcgcacgtccctgtacggtattccgtaacggtttacacctacaacgtcgtaccccgtggtacggttcggggtcccgtaccgaacgggtcccgaccgggaagggggaacgggtccggtaggggtacggttcggggtaccgccggaagggtccaagtacgtaggtagggttaaggttaaggaaagttagtaaacggttttaaagacgttaacgaacgtaccggacgtaacgtaccgttcgggttacggttacggggaccgggacccgtacctaaccgtaaccccgtagtttaccccaaccggaaacggtaaacctaaccttaaaccgttaccggtaaacttacccgtaaacccgttccccgttaaactccggtaactacgtaaacgtaaacgtacgtaaaacgacgttacggtaacggaacgacccggacggaacccgggtaccgaaccggtaccgttaaacgaccctttacggcggaaacggaaccggtaaaggtacggtaaacggggtacccgggtactaaacgtggtttacg

SEQ ID NO: 97880 - DNA, 916 bp, Homo sapiens
  misc_feature: GYAE6OF01B2ST0.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctggagtcgtgggggagtcttggtacaggtccggtggggggtcccctggacgactcgtcctgtcgcacgcctcgtggactttcacgtttagccaacctaatcggtcccctggtacggttcggggtccccgccgacgggtccgtcccgggaagggggtaacgggggtccgtagggggtacggtcgggggttcccggacgtacggggacctacggttaccggtaagggttaggggttaagggtaaggggtaaaaacgtttggtttaaaacgttttttaaaacgggaacctaaacgggtaaacccgtaacgggaaccgtaaacgggtacccgtttacggttacgggttcggggtaaccggggggtcccccggttaaccgtaccccgtaacccgtaaccgttacccgttacccggaaggtaaacccggtaaccttaaacctttacccggtaacgtaaccgtaaccccgtacccgtttaacggtaccttaccgttacggaaccgttaaaacgtaccggaaaaccgtacgtaaacccggtagggtaaccggaaccgggacccgggtaaaccgggaaccccgtaaaccggggtacccgtttaaccgttaaacccgttaaccggtccgggtaacccgggaaacgtaaaaccggggtaacgggttaaaaccgggggttaccgggggggtaaacccttaaacccggtacggttttaaccggg

SEQ ID NO: 97881 - DNA, 663 bp, Homo sapiens
  misc_feature: GYAE6OF01AOSJ7.4.60.F05.1.454.CMB.1.raw
tcagagcactgtagcacgaccggtgctcgatttagtacgtcatcagggaaagggggcgtctgagagaggagcccagccctgggattttcaggtgttttctatttggtgatcaggactgaacagagagaactcaccatggagtttgggctgagctggcttttcttgtggctattttaaaaggtgtccagtgtgaggtgcagctgcgtggagtcgtgggggagcgttggtacaggcccgtggggggtcccctggacgacctctccgtgtgcagcctctggattcacgtttagcaccaatcgcccctgaggtcgggtccgccgaggcctacgagggagggctggagtgggtcgcagggcagtcaggttggtagtaggaaatgtaatttaagacaagtacctacggactagacttcgtggtacggtacggggacccgtacgtaccaaccgtactccgtaccgacggaacgactaaatttacccgaactacgtaaacccgtacccgtaagttaacgtacgttacgaactaaacgtacgtaaaacgacgtaaccgtagaacggacggtacgaacggaaccggaacggtacccgtaacgtaaccctaacgtcgaccgtaacggaaaagtacggtaaacgggtacgggggtaacctaaccgtacgttacgg

SEQ ID NO: 97882 - DNA, 859 bp, Homo sapiens
  misc_feature: GYAE6OF01D9JCQ.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcttttctgtggctattttaaaggtgtccagtgtgaggtgcagctgctggagtcgtgggggaggtcttggtacaggccgtggggggtccctgacgacctcgtcctggtcgcgacgtcccgtcgttacgggtaactttccgtaaccggtttttaaggccgtaaccctaaacgttccggtacccccgttggtaacgggtttcgggggtcccccgtacccggacggggtacctacccgggtaaggggggaagggggtcctggggaagggttcggggtccggacgaagggcctagttaccgaggttaggtaggtagggtaaaagttgtaaagttttaaacggaaccgtagtaaccgtagaccgaagtaccttcgtagggtacgggacggggtaccccgacgtcccgtaacgaccttccgtaacccgtaaggaaccggtaacctaaacctttcccgtaaccgtaacgtaaaccccgtaacccgttacgtttaaaccgtccgttacgtaaacccgttaaaacgttacgaaaaccgtacgtaaaccgttagggaaccggtacggtaaacccgggaaccggtaacccgaaccggggttaaccccggtaaattaacccggtaacggttccggaaccggggtaaagtaaaacgtaaacggggttaaaggggggtacccggggttaaacccgttaacgtaacgggttttaacggg

SEQ ID NO: 97883 - DNA, 690 bp, Homo sapiens
  misc_feature: GYAE6OF01A7FNR.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtctttttctgtggctattttaaaaggtgtccagtgtgaggtgcagctgctggaggtcgtgggggaggcttggtacgagtccgtggggggtaccctgacggctctcctgtgcacgcctctggtattcacgtttagcaccaatcgcccgtgtaggttacgggtccgccgacggccgtccgagggggaacggggcgtgggacggttcggggtcgccgagggccagtaccgaggttgggtagtaggaaagtgtaacgttttaagactaaggacttaacggcgtaacgacgttcgtgggttagggacggggtaccgtactaccacctactccgtacccgaagacgaacctaacttaccagtacgaaccctacccttagtaccttactcgaactaaacgtacgaaaccacgtaactggaaccggacggaccgggaacggacccgaccgggtacccgttaactaaccttaccggtcggacccggaaggtaaacggtaacggtaaacggggtaccggggtaacgttaaccgtaggtttaacgg

SEQ ID NO: 97884 - DNA, 745 bp, Homo sapiens
  misc_feature: GYAE6OF01EZSFH.4.60.F05.1.454.CMB.1.raw
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcacatggagtttgggctgagcgtgtcgttttctaggtcggactaatttaaaggtgtcagtgtgagtgcagctgctggagtcgtggggagcttggtacagccgtggggtcctgagctctctgncacgctcgtgatctacgtttagcaccagtcgcctgtagtcggtaccncgaggtccgccggaggggaacgggtcgtagggacggtgggtacgcgtacgggctacgtcgaggttggtaggtaggtaaatgttaagtttaaagaccgtaagtaaccgtacgacgtaagtaccgtgtacgggtggacgggtacccggtaactaccgtaacccgtatacctacgaacgaacgtaactaactaccgtaacgttaaccaacctaccccggtttataccttacgtaacgtaaccgtaaatacgggtaaaacgtacgtacgtaacggtaacgaaccggtaacccgggaaacgggtaaacccgtaaaccgggttaaccccggttaaacgtaacccggttaacggttaacccgggaaccgggtaaaaccgtaaaacggggttaaaagggttaaccggggtaaaccggggggttaaacccttaaaccggttaagggtttaacccgg

SEQ ID NO: 97885 - DNA, 721 bp, Homo sapiens
  misc_feature: GYAE6OF01BBUSA.4.60.F05.1.454.CMB.1.raw
  modified_base (266)..(266): a, c, t, g, unknown or other
  misc_feature (266)..(266): n is a, c, g, or t
tcagagcactgtagcacgaccggtgctcgatttagtacgtcatcagggaaagggggctctgagagaggagcccagccctgggtatttttcaggtgttttcatttggtgatcaggactgaacagagagaactcaccatggtagtttgggctgagcgtggtctttttcttgtggcttaattttaaaaggtgtccagtgtgaggtgcagctgctggagtcgtgggggagtcgttggtacgaggccggtcgggggtcctgagactctccngtcgcagtccctctggtattctacggtttaagccaaccaagtcgccccgttgacgggttccgggtccgccgaggcctaccggaggggtaacggggcgtaggggtacgggtcgggtacgcgaggctaacgtcgaggtgggttaagtacgggtaaaagtcggtaattttaaacggacgtaacgtaaccgtaacgacgtagaccttacgtaggtagggtacgggtacccgtacgtacgacctactacctaccgtaacgaacgaactaacttaaccacgtacgaacccgtaccctaggtaacttactacgtaactaaacgtaacgtaaccgtaagtaaccgttagaacggtacggaccggaacgggaccgaccgggtaccgttaaccgtacttaaccggtcgtaaccggaacggtaaaacggtaaggtaacgggtagggggaacctacgtggttaacgg

SEQ ID NO: 97886 - DNA, 908 bp, Homo sapiens
  misc_feature: GYAE6OF01DSM87.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgcgtggagtcggtggggggagtcgttgggtacacggtccggtcgggggggtcccctggacgtacctcctccgtggtcgcgacgccctcgtggtactttaccgtaacgttttacggacctaacctaagtccgccccgtaggtacgggtttcggggtcccggacccgacggtcccgtaccgggaacgggggtaacgggggtccggtagggtacgggttcggggtccggacgtacgggaccgtaagttaccgtaagggtttagggtaaggttaagggtaaaagtttaggttaaagtttttaaacgaaccgttaacggtaaaccttaaccggaaccgtaacggtaacccgtttcggttagggtacgggacccgggggtaacccgtaacccgttaccgtaaccccgtaaccgttaccccggtaaccgtaaacggtaaaccggtaaacccttaaaccgtttaacccctaaacggttaacccgtaaaaccccgttaaccccgttaacgttaaacccgttaccgttaacgtaaaccgtaaaacggttaaccgtaaaccgtaaccggtaaccggtaacggaacgggtaaccggacccgggtaaacgggacccggtaaccggtacccggttaacgtaacccgtacggtcgggtaccgggaacggggtaacggggacgtacgggacgggttcggtacggttcgggttttaccggg

SEQ ID NO: 97887 - DNA, 574 bp, Homo sapiens
  misc_feature: GYAE6OF01EZCNM.4.60.F05.1.454.CMB.1.raw
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttctagtggctaattttaaaaggtgtccagtgtgaggtgcagctgctggagtcgtgggggagcttggtacaggccgtggggggtccctgagactctcctgtgcagcctctggtattcacggtttancaaccaatgcccctgaggttgggtccgccgaggctccgagggaagggtcgnggagtgggtcgcgaggcancgagtggtagtggaaatgaacttttaagacaagactacgacanactcgtgtgacgggccgataccgaccagtcaccgagacgactaattcatagaacctacctgtactctagaacaatagaaacagactacggagacgaccgaggacgaccggtacggtataactacgtcgaccgaagaaagtaacgtaaagggaggggtaaccttaacgagttacgg

SEQ ID NO: 97888 - DNA, 705 bp, Homo sapiens
  misc_feature: GYAE6OF01AKAD2.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttggctgagctggtctttttcttgtggtctattttaaaaggtgtcagtgtgaggtgcagctgctggagtcgttgggggaggtcttggtacagccgtgggggtcctgagacttctcctgtgcagtcctcgtgggtacttctacggttttacgccaacctaatcgaccccgttgtacggttggggtcccgtccgacggtcctccggaggggtaaggggtccgtagggtaggtcgggtcgcgagggcatcgaggtcggtaggtaggaaacgttgtaagttttaagacgagtaaccgtacgacgtagtacttcgtggtacgggacggggcccgaaccgttccaaccctaacgtccttacccgaaggaaccgtaaccctaattaccctaagtaaccggtaaccctaacccgttacgttaaccttccgtaacgtaaccgtaaacgtacgtaaaccgaacgtacgtaaggacggaaccggaccggtaacggaccgtaccggtacccgtaagttacctacgtacggacgacgtaaacggtacggtaacgggtacgggtactacgtgtttaccg

SEQ ID NO: 97889 - DNA, 579 bp, Homo sapiens
  misc_feature: GYAE6OF01D57T4.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttctgtggcttaattttaaaaggtgtccagtgtgaggtgcagctgctggagtcgtgggggagcttggtacagccgtggggggtccctgagactctcctgtgcagcctctggattctacgtttagcaccaatcgccctgtaggttggccgcacggctcggaggggaagggcgtgggtaggtgggtcgcgaggcatcgaggtggtagtaggtaatgtaatttaagacagactagcagtactgtgtggacgggccactcactactctaccagacgaactactccatacaacctcctgtaactcgtacgaactaaactagaacacggaactaggagacgaccggaacggaccgaccggtcgtaacgtaactacgtagacggaacgaaaggtacgtaaaggggacggggtaactacgtgttacgg

SEQ ID NO: 97890 - DNA, 777 bp, Homo sapiens
  misc_feature: GYAE6OF01C46LT.4.60.F05.1.454.CMB.1.raw
tcagagcactgtagcacgaccggtgctcgatttagtacgtcatcagggaaaggggctctgagagaggagcccagccctgggtattttcaggttgttttcatttggtgatcgaggactgaacagagagaactcaccagtggtagttggctgagtctggtcttttcgtggtggtacttaagtttaaaaggtgtcctagtgtggaggtgcagctgcgtggagtcggtgggggagtcgttagggtacgacggtcccggtcggggggtaccctggacgtaccttccgtccgtggtcgcgacgccgttcgtggtacttcgtaacgtttacgaccaaccgtaacgttcgtacccgtggtacgggttccgggtcccgacccgacggtccgtaccggaggggtaacgggccgtgggacggtcgggtacgcgaggcgtaagtcgaggtggtaaggtaggtaaagtagtaaagtttaacgaacgtaagtaccgtacgacgacgtacgtcggtaggtacgggacgggtaccgaccgtaccgaaccgtacttaccgtaccgtaagaaccgtaacctaacgttacccgaacgtaaccgtaaccgtaccccgttagtacctacgtaactaacgtaacgtaacgtaaacacggtaacgtaggaacggaaccgggtaccggaacggaacccggacggtaacccgttaacgaaccttaaccggtacggaacccggaaggaaaacggttaacgggtaaacggggtacggggttaacctaaccggtagtttaccggg

SEQ ID NO: 97891 - DNA, 883 bp, Homo sapiens
  misc_feature: GYAE6OF01A2HME.4.60.F05.1.454.CMB.1.raw
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (317)..(317): a, c, t, g, unknown or other
  misc_feature (317)..(317): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcttttctgtggcttaatttaaaggtntcagtgtgngtncagctgcgtggaggtcgtggggagtcgttggtacgacggtccggtcggggggtccctggacgtaccttccgttccgtggtcggacctacggtccttcgtcggttacttcgttaaccggtttacncctaaacccgtaatccgtaccccgttaggttacgggtttccccggggtcccgtacccggtaacgggtccccgttaaccggggaacgggggaaccggggggttccgttggggtacggggtttcggggtcccgaccggttaacgggcgtaacgttaccggggtaggtttacggggttaaggtaaagggttaagtttacggtttaaacgtttaaacgaacgtaacgtaccggtaacggtacgtaccgtaacgttcggtaggtacgggaccgggtacccgtacgttaccaccgtatacccgtcgaaacgacctaacgtaaccctttacgaccgtaaccgtaacccgtaccgttaagttactaaccgtacgaaaccctaaagtaaccggtaaaccgaccgttaacggacgaaacgggtaccgaaccgggtaaaccgtaacccggggaccgttaaaccccgttaagttaaccccggtaacttcccgggggaaaacgtaaacggggttaaaacggttaaaccgggggtaaccgggggttaaacggtaacccttaaacgttcggtttaaacggg

SEQ ID NO: 97892 - DNA, 684 bp, Homo sapiens
  misc_feature: GYAE6OF01D51GI.4.60.F05.1.454.CMB.1.raw
  modified_base (440)..(440): a, c, t, g, unknown or other
  misc_feature (440)..(440): n is a, c, g, or t
  modified_base (674)..(674): a, c, t, g, unknown or other
  misc_feature (674)..(674): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcgttgtggacttaagttttaaaaggtgttaccagttgtggaaggtgcagctgcgtggagtcggtggggacgcttggtacaggccgtgggggtccctgagacctctcgtgtgcacgtcctctgtattctacgtttagacaccgtaatcgcccgtgtacgttcgggtccgccgacggtcgacggtacggggacggtcgtgggtaggtcgggtagcgacggacgtactcgtaggtaggtaggtaggtaaagttcgtaatttaaacgagtacgtacgtaccgngtaacgtcgtacgtgtacggaccggggtcctaaccgttcaaccgtactacgtaacccgtagacgtactaacgttaccagtaacgaacctccgtaagtactcgtaacgtactaaacgtctaacgagtaccgtaggacgtacggaacgtaacggaccgtaaccggtaccggttactaacccgttacgtacggaccgaaggtaaaacggtacggtaaacgggtaggggaacctacgngttaaccggg

SEQ ID NO: 97893 - DNA, 914 bp, Homo sapiens
  misc_feature: GYAE6OF01D2FEF.4.60.F05.1.454.CMB.1.raw
tcagagcactgtagcacgaccggtgctcgatttagtacgtcatcaggggaaagggggctctgagagaggagcccagccctgggtattttcaggtgttttcatttggtgatcaggactgaacagagagaactcaccatggtagttgggctgagcgtggtctttttcttgtggtcttaagttttaaaggtgtccgagtgtgaggtgcagctgctggaggtcgtggggagcgttggtacgacgccggttcgggggtccctggacgactcctccgtgtcgctacgcctcttaggtacttccgtacgttttacgaccaaccgtaactcggtaccccgtggttaccgggttccgggtcccgtaccgtacggccgttcccggaagggggtaacggggtcggtaggggacgggttcgggtaccggcgtaacgggtcctagttaccggaggtttagggggtaagtaagggtaaacgtttaggttaacttttaaaacggacgtaacgtaaccggtaacgacgtaaacggtacgtaccggttaggttccggggtaacggggtccccggtaaaccgtccgtaacccgtacgttaccgtaacccgaaggttaacccgtaaccgtaactttacccgaacgtttaacccggtaaaccctacccgtttaaccggtactttaacccggtaacgtaaaccgtaaacgtttaccgaaaacccgtaaggtaacccgttaacggaacgggtaaccccgggaacccgggtaaacggggacccgtaaccgggggttaaaccccgttaacgttaacccgggttaaaccgtaccggggttaaacccggtaaaccggggtaaaaaccggtttaaaacggggtaaacccgggggggttaaacggggtaaacccgttaacggttaccggttttaaaccgggg

SEQ ID NO: 97894 - DNA, 915 bp, Homo sapiens
  misc_feature: GYAE6OF01ETTM5.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggtagtttgggctgagctggtctttttcttgtggtcttaattttaaaaggtgtccagtgtgaggtgcagctgctggagtcgtgggggagtcgttggtacgaggccgtcgggggtccctggacgtacctctccgtgtcgcgacgcctcgtggacttccgtaacgtttacgaccaacctaagttcgccccgtaggtacggtttcggggtcccgacccgtacgggtccgtacccggaagggggtaacggggtcgtaggggtagggttcgggggtccgaccgaacgggtacctacgtaccggtaagggttagggtaagggttaagggtaaaagttacggtttaaacgtttttaaaacggaaccgtaacggtaaacccgtaaccggtaaccgtaacggttaacccgttcggttacgggtaacggggtaacccgggggtaccccgttaaccgtaaccccgtaaaccccgttaaccgttacccgttaacccgaacgggtaaacccgtaaacccgttaaaccgtttaccccgtaaagtaacccggtaaaacccctaaccccggtttagttaacttaccggtaaccgtaaacctaaaacgttaacggaaaaccgtaacggtaacgtaaggaaaccggtaccggaacccgggaaacgggtaaacccggtaaaccgggttacccgtaaacgttaacccgttaccgtacggaacccggtaaacggaaaacgggttaaccgggtaaagggggtaaccggggtaaacccgttaaccggtaacgtttaacccggg

SEQ ID NO: 97895 - DNA, 909 bp, Homo sapiens
  misc_feature: GYAE6OF01DL9IP.4.60.F05.1.454.CMB.1.raw
tcagagcactgtagcacgaccggtgctcgatttagtacgtcatcagggaaagggggctctgagagaggagcccagccctgggattttcaggttgttttcatttggtgatcaggactgaacagagagaactcaccatggagtttgggctgagcgtgtcttttctgtggacttaatttaaaggtgtccagtgtgaggtgcagctgctgggagttcggtgggggtaaggtcgtttagggtaaccgacggcccggttcggggggtcccctaggacggtaccttccgtcccgttgtcgccgtacgcccttcgttcgggtacttttccgtaaccggttttaacggaccgtaaccctaaacttccggtacccccgttagggttaacgggttttccgggggttaccccggacccggtaaccggggtcccgttaccccgggaaaggggggaaacgggggtcggttacgggagggttcggggtacggccgaacggctacgtacgagttaggggtaagtaagggtaaagtagtttaaagttttaaagacgtaaacggtaccgttaaaccggactaacggtacctacggttggtacgggtacggggaccccgtaaccgtacccgtaaccccgtaacttacccgtacccgtaaaggacctaaaccgtaaccgttaacccgtaacgtaaccgaaacccgttaaccccgttaacgttaaccttaccgtaagtaacccgtaaaaacgttaacggtaaaccgaaagtaaccgttaacggacgggtaacggaaccccgggtaaacgggaaacccgacccgggtaacccggtttaaacgttaaccgtaacccgttaccgggaaccgtaaaccggtaaaggtaacggttaaacgggtacgggggtaaaccctcggtaacgtttaccggg

SEQ ID NO: 97896 - DNA, 855 bp, Homo sapiens
  misc_feature: GYAE6OF01BAW15.4.60.F05.1.454.CMB.1.raw
  modified_base (195)..(195): a, c, t, g, unknown or other
  misc_feature (195)..(195): n is a, c, g, or t
  modified_base (760)..(760): a, c, t, g, unknown or other
  misc_feature (760)..(760): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccagtggtagtttggctgagcgtgtcttttctgtgacttaatttaaagtgtcagtgtgaggtgngagctgcgtggagtcggtcggggagtcgttaggacgaggtccggtcgggggtccctagtacggtcttccgttccgtgtcgcacgtcctacgtgtacttacgtacgtttcgacaccgtagttcgtccgtggtacggttccgggtccgccgacggtccgtacggtaacggggacgggtcggtacgggtaggtcgggtacggcgacggtacgacgttacggtaaggttggttaagggtaagttaaagttaaggtaacgtttaaagaacgtaacgtaaccgtacggtacgtaacgtaccgttacggttaggacgggtacccgggtaacgtaccgtccgaaaccctacgtacctaaccgaaacggttaactaacccgttaccgttaaccgaacggttttaacccgaaccctaccggttttaaccgtaaccggtactaaaccgtaaaccgttaaagtaaaccggaaccgtaacggtttaacgggtaaacggttaccggaaaccgggtaacccgtaaaccggggtaccccgaaacccgggttaaacgttaacccttaacccgggtaaacccnccgggttaaacccggaaaacgggttaaaaccggttaaacggggtaaccggggtttaaacccgggtaactttaaacccggtgtttttaaccccggg

SEQ ID NO: 97897 - DNA, 811 bp, Homo sapiens
  misc_feature: GYAE6OF01A19R4.4.60.F05.1.454.CMB.1.raw
tcagagcactgtagcacgaccggtgctcgatttagtacgtcatcagggaaagggggctctgagagaggagccccagccctgggtattttcaggttgttttcatttggtgatcaggactgaacagagagaactcaccatggagtttgggctgagcgtgtcttttctggtgtacttatttaaaggtgtccagtgtgaggtgcagctgcgtggagtcggtgggggagtcgttggtacacggtcccggttcggggggtccctggacggcctctccgtgtcgcgcgtcctcgtggtaacttctacgtttacgaccacctaatccggtcccgtggtacggttccggggtccgaccggtacggccgtaccgggaagggggaacggggtcgtggggtaggtcggggtccggaccgagggtctacgtacggtaggtagggtagtaacggtaaagttagtaagtttaaacgacgtaacgtaactaccggctaaacggtaccgtacggtacggtacggggtaaccgggggtcccgtaaacccgtacccaacccggttaaccttaccccggacccgtaaaaggtaacccggttaaaccccttaaacgttaacccgtaaccttaaaccggtaaaccccctaaccgtttaacgggttaaccttacggtaacgtaaaaccgtaacgtaacgtaaaacggacggtaaccgaagacggaacggaccgggaaacgtaccgaaccggttaaccgtatacccgtaacgccggaagtaaccgaaaagggttaacggtaacgggggtaccgggtaaactacgtcggttaacgg

SEQ ID NO: 97898 - DNA, 758 bp, Homo sapiens
  misc_feature: GYAE6OF01D5RJY.4.60.F05.1.454.CMB.1.raw
  modified_base (510)..(510): a, c, t, g, unknown or other
  misc_feature (510)..(510): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggtagttggctgagctggtctttttctggtggtacttaagttttaaaggtgtaccagtgtggtaggtgcagtctgcgtgggtacggtcggtggggggagtcgttggtaccgacggtccgggtcggggggtccctggacgactcgtccgtggtcgcacgtcctcgtacggttattaccgtacgtttacgacctaacctaacgtcgacccgttggttacgggttccggggtcccgaccggacggtacccgtaccggggaagggggaacggggtcgtagggtacgggtcgggtaccgcggaacggctacgtacggtacggtagggttaggtaaggtaacgttagtttaaagtttaacgacgtacgtaaccgacggtanacgtactgtacggtggacggcacncgactntcacaagactaactacgtaccacgtacgaacctacgttactacgttacaacgtaacaacgtaacggtaactaacggtacgtaggacggtaccggaacgggaaccggacccggtaacgggtacccgttaaacgttaccgtaacggtcggaaacggaacggttaaaacggtaacgggttaaacggggtaacggggaacccttacggtacggtttaaccgg

SEQ ID NO: 97899 - DNA, 744 bp, Homo sapiens
  misc_feature: GYAE6OF01BLG75.4.60.F05.1.454.CMB.1.raw
  modified_base (295)..(295): a, c, t, g, unknown or other
  misc_feature (295)..(295): n is a, c, g, or t
tcagagcactgtagcacgaccggtgctcgatttagtacgtcatcaggggaaagggggctctgagagaggagcccagccctgggattttcagggttgttttctatttggtgatcaggactgaacagagagaactcaccagtggtagtttgggctgagcgtggtcttttcttggtggtacttaagttttaaaaggtgtccgtagtgtggaggtgcagtctcgcgtggacgtcggtgggggcgtcgttggtacgacggtccgggttcgggggtcctagacgcctcgtccgtggtcgcncgtcctcgtaggtacttcgtacggttacacacctatcgtccgtaggtacggttcgggcccgccggacggtccgtaccgggaggggagggtcgtgggtagggtcgggtcgcgacgcgtaggtacgaggtgggtaaggtaggtaattagtaacgttaagacgtacggtaactaccgagtacgtacgttcggtagggtagggaccgggtaccctaccgtaccctaaccgtactacccgacgaacggtacgtaacctaccgtaacgaacgttaaccgtaacccgtacccgtacgtacctacgtaacgaaaccgtaaagtaacgtaacggtaaccgacggtaaggaccgaccggaacgaccggtaaccgacgggtaccgtacgtaacgtcgtaccggacgtaaacggaaacggtacgggtaacgggtaaccggggaccttaaccggtgttacgg

SEQ ID NO: 97900 - DNA, 797 bp, Homo sapiens
  misc_feature: GYAE6OF01CMM3Z.4.60.F05.1.454.CMB.1.raw
  modified_base (217)..(217): a, c, t, g, unknown or other
  misc_feature (217)..(217): n is a, c, g, or t
tcagagcactgtagcacgaccggtgctcgatttagtacgtcatcagggaaagggggctctgagagaggagcccagccctgggattttcaggtgttttcagtttggtgatcaggactgaacagagagaactcaccagtggtagttggctgagctggtcttttcgtgtgtacttaagtttaaaggtcgtccgagtgtaggaggtgcgagtctcgctggngtcggtgggggacgtcgttacggtacacggtccggttcgggggtccctggacggtaccttccgtccgtagtcgcgacgtcctcgtgtacttacgtacgttacgacctacagtcgtccgtaggtcggttccggccgacgcggtaccgtacgggaaggggtagggcgtagggtcgggttacggccgtgacgggacacgttcggtaggttacggtaaaggttagggtaaaacgttggtttaaacgtttaaacggaacgtaaacggtacccgtacgaacgtacgttacgtacggttagggtacgggacccggggtaaccctaaccggtacccgtaaccgttaccgtacctacccggtaaagtaaacctaaccgttaaaccgttaccgaacgtaaccgtaaaccccgttaccgttaacgtaaccgttaagaacctaaaccgtaaggttaaacccgaacgtaaacgtacccggtaagggtacccgaacggaccggtaccggaacccggttccgtaaacgtctaacgggtacgtacggacaaacgggtaacgtaagggtaacggcgggtaaaccctggtaagttccg

SEQ ID NO: 97901 - DNA, 653 bp, Homo sapiens
  misc_feature: GYAE6OF01A3FHT.4.60.F05.1.454.CMB.1.raw
  modified_base (245)..(245): a, c, t, g, unknown or other
  misc_feature (245)..(245): n is a, c, g, or t
tcagagcactgtagcacgaccggtgctcgatttagtacgtcatcagggaaagggggctctgagagaggagcccagccctgggattttcaggtgtttttcatttggtgatcaggactgaacagagagaactcaccatggagtttgggctgagctggctttttctgtggctattttaaaaaggtgtccagtgtgaggtgcagctgctggagtcgtgggggagcgttggtacagccgtgggggtcccngagcctctcctgtgcagccctgtggattcacgtttagccacctaatgccctgaggtttcggggtccgccaggcctccgaggggaaggggtcgtgggagtgggtcgcgaggcatcgcgtggtagtcggaaatgtaagtttaagacagactacgcagactctggtaggacgggccgaccgtccaaccgatcccgtacgaccgaagtaaccgaaacctttcccaacgttaccggaacctaacccccgtggttaacctaccgtacgaccgtaaaatcgtaaaccgaagtacgtaacggacgggacgtaacccggaagaacccggaacggtcccgtaaacgtaccgtacgtccggacgtaaccggaaacgtaacgttaaacgggggtaggggacccttaacgaagtttacggg

SEQ ID NO: 97902 - DNA, 656 bp, Homo sapiens
  misc_feature: GYAE6OF01BE85H.4.60.F05.1.454.CMB.1.raw
  modified_base (347)..(347): a, c, t, g, unknown or other
  misc_feature (347)..(347): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctgctggagtcgtgggggagcgttggtacaggccgtgggggtccctgagactctccgtgtcgcagcctcgtggattcacgtttagcaccatcgcctgagttcggccgcgacggctccggaggggacgggctgggaggtgggtcgcgnggcacgtcgaggtggtaggtaggaaagtgtaattttaaggacgaagtaccgtacgcagtacgttcgtggtcggacggggtaccgaccgtaccgacctactacctccgaagacgtaactaacttaccaacgtacgaaccctaccttagtactcgtacgaactaaacgtacgaaaccgtaacgacgtagacggaccgtacggaacgggacccgaaccgggtaccgtacgttaaccgtacgtacggaaccggaaccggaaaggtaacggttaacgggggtacgggggtaacccttaacggtagtttaccggg

SEQ ID NO: 97903 - DNA, 853 bp, Homo sapiens
  misc_feature: GYAE6OF01ACGDT.4.60.F05.1.454.CMB.1.raw
tcagagcactgtagcacgaccggtgctcgatttagtacgtcatcagggaaagggggctctgagagaggagcccagccctgggattttcaggttgttttcatttggtgatcaggactgaacagagagaactcaccatggagtttggctgagcttggtcttttttcttgtggtcttaagttttaaaaggtgtcctaggttgtggtaggtcgcagtctgcgtaggagtcggttagggggacgtcttagggtaccacggtccggttcggggggtccctggtacgtaccttccgttccgttgtacggaccgtacgtcccgttcggttacggtaacgttttaccgttaacggttttaccgacctaacccgtaaacgttccggtaccccggttagggtttaacgggtttcccggggttaccccgaccggaacgggtcccgttaaccggggaaacggggggtaacgggggtccgttaaggggtacgggttcggggtccgacggacggtacgtagtaccggttaggttagggtaaggtaggttaaagttaggttaaagttttaaagaacgtaacgtaccgtaacgaccaaggtacctggttacgggtacgggaccgggtcccgtaacgtacctaacccgtgtacccgttacgaacgaacgtaacctaccttacgaacgtacccgtaacccgaccgttgtaaccttcgtaactaaccgtaaacacgtaaaccgagtaaccgtggaaccggacgaaccggacgtaacccggacccggtaccgttaacgtaacccggttacgacgggtaacgaaacggtaaacgtaagggttaacggggtaacccgggcctaacgtaggtttacg

SEQ ID NO: 97904 - DNA, 692 bp, Homo sapiens
  misc_feature: GYAE6OF01DOP0G.4.60.F05.1.454.CMB.1.raw
  modified_base (157)..(157): a, c, t, g, unknown or other
  misc_feature (157)..(157): n is a, c, g, or t
  modified_base (183)..(183): a, c, t, g, unknown or other
  misc_feature (183)..(183): n is a, c, g, or t
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
  modified_base (495)..(495): a, c, t, g, unknown or other
  misc_feature (495)..(495): n is a, c, g, or t
  modified_base (613)..(613): a, c, t, g, unknown or other
  misc_feature (613)..(613): n is a, c, g, or t
tcagagcactgtagcacgaccggtgctcgatttagtacgtcatcagggaaagggggctctgagagaggagcccagccctgggatttcaggtgttttcatttggtgatcaggactagaacagagagaactcaccatggagtttgggctgagcgtggtnttttcgtaggtggctaatttaaaggngtcagtgtgagtgcagctgcgtaggagtcgtggggagngtagtacagtcccgtgggggtccctgaacgtcctctaccgtgngtacaggtcctagtgataccgacgttaacgcaacctaagtcggaccttggtacgggttacggtaccggaccgtagggtcctcccgggaaaggggaacggggccggttagggaaaccggtttggggtctaccgaagggccgtaaccttcgagggttaccgggtagttaaaggaaaccgttaggtaagtttaaacggacctaagggtaccctagggactaacgacttaccggnggttaacggtacgggtcccggaacttaccaacgtacttaccggactaacggacaactaaccttccaagaacgaacctaccctagtaactccgtaatacgaaacgtagacgtaagaganacgaacgaccggaacacggaacggtaccctaagtactccgtaagccgtagaaacgaggtagtaggggacagtaagtacg

SEQ ID NO: 97905 - DNA, 813 bp, Homo sapiens
  misc_feature: GYAE6OF01CLXR2.4.60.F05.1.454.CMB.1.raw
  modified_base (656)..(656): a, c, t, g, unknown or other
  misc_feature (656)..(656): n is a, c, g, or t
  modified_base (702)..(702): a, c, t, g, unknown or other
  misc_feature (702)..(702): n is a, c, g, or t
tcagagcactgtagcacgaccggtgctcgatttagtacgtcatcagggaaagggggctctgagagaggagcccagccctgggtatttttcaggttgtttttctagttttggtgatcgaggactgaacagagagaactcaccagtgggtagtttgggctggagtcgtggttcgttttcgtaggtcggtacttaaagttttaaaggcgtacaggttgtgaggtgcgacgtcgtggcgtgggtacggtcgggtggggagttcgttaggtaacgcggtccgggtccggggtccagacgtcctcgtcgtgtcgacgcgtcctcgacgtcttacgtacgttacgactacgtaacgtcgtccgtggtcggttccggtccggaccgtcggtaccggtaacggggacgggggtacgggtcggtagggtacggttaccggggacgccggtaggtacccgtaaggaccggttaagggttaggtaaaggttaacgtaaagtttacgggttaatttaaacgggaactaagaaccgtacggactaccgtacgttcgggtacggtccgggcggtacccgtaccgtacgtaccctacggttaccgaacggtaaggactaaccgttaacgttaccgaccgttaaacccgtaccgttaacccgtgtttaaccgntaaccggtaaacgtaacgtaacggaaccgtaaggttacgagggaanacccggggtacgaccgggtaaccgaacggtaccgtaccggtcctaaggtcgggaaaccgaaacgtaaggttaaccggggtaacgggtccggtaaaccttgtcgtttaacgg

SEQ ID NO: 97906 - DNA, 534 bp, Homo sapiens
  misc_feature: GYAE6OF02HEG3J.4.60.F05.1.454.CMB.1.raw
  modified_base (153)..(153): a, c, t, g, unknown or other
  misc_feature (153)..(153): n is a, c, g, or t
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgngtgtttctaggtggctatttaaaggtgtcagtgtgaggtgcagctgctggagtctgggggaggcttgggtacagcctggggggtccctggagactctcctgtgcagcctntggattcacgtttagcaccaatgccctgagttgggtccnccaggctccgagggaagggctggagtgggtcgcaggcatcagtggtagtggaaatgatttaagacagactacgcagactcgtgtgagggccgactcaccatctaccgagagactaattccaatcgaaccaccctagactctacgacaatgaacagactagagacgacgaggacgacggccggtatacctacgtcgcgacgaagagtaaggtacggggactaccgagttacgg

SEQ ID NO: 97907 - DNA, 565 bp, Homo sapiens
  misc_feature: GYAE6OF02HP099.4.60.F05.1.454.CMB.1.raw
  modified_base (179)..(179): a, c, t, g, unknown or other
  misc_feature (179)..(179): n is a, c, g, or t
  modified_base (299)..(299): a, c, t, g, unknown or other
  misc_feature (299)..(299): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtgtttctaggtggctatttaaaggngtcagtgtgagtgcagctgctggagtctgggggaggcttggtacagcctggggggtccctgagctctcctgtgcacgcctctggattcacgtttagcacaatgcctgagttgggccgccnggctccgagggaagggctgggagtgggcgcgaggcatcgagtggtagtaggtaaatgtaagttttaagacaagtacctacggacaggaactctaggtggacggggaccgactacacctactctaccgagaacgactaacttccatacgaaccaccctagtactctagactaatgaacagactgagacgaccgaggaccacggaccgtacaaccgttacgcggacgacggaaagtagtaagggtacggggtaacctaccgattacgg

SEQ ID NO: 97908 - DNA, 512 bp, Homo sapiens
  misc_feature: GYAE6OF02FK2SH.4.60.F05.1.454.CMB.1.raw
  modified_base (497)..(497): a, c, t, g, unknown or other
  misc_feature (497)..(497): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacagcctggggggtccctgagactctcctgtgcagcctctggattcacgtttagcaccaatgccctgagttgggtccgccaggctccagggaagggctggagtgggtcgcaggcatcagtggtagtggaatgatttaagacagactacgcagactctgtgaggggccgactcaccatctcagagacaattccatgaacaccctgtatctgacaaatgaacagactgagagccgaggacgacggccgtatactactgcgacgaagagtaaggnggggactacgatacg

SEQ ID NO: 97909 - DNA, 537 bp, Homo sapiens
  misc_feature: GYAE6OF02G5961.4.60.F05.1.454.CMB.1.raw
  modified_base (261)..(261): a, c, t, g, unknown or other
  misc_feature (261)..(261): n is a, c, g, or t
  modified_base (383)..(383): a, c, t, g, unknown or other
  misc_feature (383)..(383): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtgtttctaggtggctatttaaaggtgtcagtgtgaggtgcagctgctggagtctgggggaggcttggtacagcctggggggtccctgagactctcctgtgcagcctntggattcacgtttagcaccaatgccctgagtttgggccgccgaggctccgaggggaagggctggagtgggtcgcaggcatcagtggtagtggaaatgatttaagactagactacgcagactntgtgaggggccactcaccatctaccgagaacgacaatttcccattacgaaccaccctgtatcctagactaaanananacgactagagacgacgacgacgacgacgtactactacgtcgacgacgaacgacgtaggtacgggacgtacgtagtcg

SEQ ID NO: 97910 - DNA, 548 bp, Homo sapiens
  misc_feature: GYAE6OF02INHMD.4.60.F05.1.454.CMB.1.raw
  modified_base (368)..(368): a, c, t, g, unknown or other
  misc_feature (368)..(368): n is a, c, g, or t
  modified_base (447)..(447): a, c, t, g, unknown or other
  misc_feature (447)..(447): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttctagtggctaattttaaaaggtgtccagtgtgaggtgcagctgctggagtctgggggagcttggtacagcctgggggtccctgagactctcctgtgcagcctctggattcacgtttagcaccaatgccctgagttgggtccgccaggctccgagggaggggctggagtgggtcgcaggcatcagtggtagtggaatgatttaaganagactagcagctcgtgtgacgggccacgtcaccgatctccagagactaattccgatacgaacctaccctagtactctanactaaactgaaacacgaactagagacgaccgacggacgacggacgtactaaccgtacgtcgacggacgaaagacgtaaggtacgggggactacgacttagg

SEQ ID NO: 97911 - DNA, 559 bp, Homo sapiens
  misc_feature: GYAE6OF02HWW1W.4.60.F05.1.454.CMB.1.raw
  modified_base (422)..(422): a, c, t, g, unknown or other
  misc_feature (422)..(422): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcgttttctagtggctattttaaaaggtgtccagtgtgaggtgcagctgctggagtcgtgggggagcttggtacagccgtggggggtccctgagactctcctgtgcagcctctggattcacgtttagcaccaatgccctgagttcgggtccgccaggctccgagggaagggctgggagtgggtcgcgaggcatcgagtggtagtggaaatgtattttaagacagactacgcagactcgtagtggagggccgacgtcaccgatctccanagacaattccatcgaacaccctgtaactctagactaaatagtaacagactaggagacgaccgaggaccgacggaccgtaactacctacgtcgacgacggaaacgagtaaacggtacgggggaactaccgagttacgg

SEQ ID NO: 97912 - DNA, 524 bp, Homo sapiens
  misc_feature: GYAE6OF02IL9EX.4.60.F05.1.454.CMB.1.raw
  modified_base (397)..(397): a, c, t, g, unknown or other
  misc_feature (397)..(397): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggcttttcttgtggctattttaaaaggtgtccagtgtgaggtgcagctgctggagtctgggggagcttggtacagcctggggggtccctgagactctcctgtgcagcctctggattcacgtttagcaccatgccctgagttgggtccgcaggctccgagggaaggggctgggagtgggtcgcgaggcatcagtggtagtggaatgattttaagacagactacgcagactctgtgaggggccgacncaccatctccagacgacaattaccatagaaccaccctgtactctagacaaatagaacagactgagagccgagacacggaccgtatactactgacgagaacgagtaaggtagggggactaccgatacg

SEQ ID NO: 97913 - DNA, 530 bp, Homo sapiens
  misc_feature: GYAE6OF02GZYXD.4.60.F05.1.454.CMB.1.raw
  modified_base (495)..(495): a, c, t, g, unknown or other
  misc_feature (495)..(495): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggcgttttcttagtggctattttaaaaggtgtccagtgtgaggtgcagctgctggagtctgggggaggcttggtacagcctggggggtccctgagactctcctgtgcagcctctggattcacgttttagcaccaatgccctgagttgggtccgccaggctccgagggaaggggctgggagtgggtcgcgaggcagtcaggtggtaggtggaaatgattttaagacagactacgcagactctgtgaggggccgactcgaccatctccagagacaattccatcgaacaccctgtactctgacaatagaacagactgagagcgaggacacggccgtaatactacngcgacgaagagtaaggtcggggactaccgagttcg

SEQ ID NO: 97914 - DNA, 598 bp, Homo sapiens
  misc_feature: GYAE6OF02H67XT.4.60.F05.1.454.CMB.1.raw
  modified_base (228)..(228): a, c, t, g, unknown or other
  misc_feature (228)..(228): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (352)..(352): a, c, t, g, unknown or other
  misc_feature (352)..(352): n is a, c, g, or t
tcagagcactgtagcacgaccggtgctcgatttagtacgtcatcagggaaaggggctctgagagaggagcccagccctgggattttcaggtgttttcatttggtgatcaggactgaacagagagaactcaccatggagtttgggctgagcggtcgtgtttctaggtcggctaattttaaaaggtgtcagtgtgagtgcagctgctggagtgtgggggaggcttggacngccgtgggggtccctgaacgctctcctgtcncncgctcgtgtagttcgtacgttacgacacacgtcgtccgtgtgtcggtccgcgcgtcgtacggacgggaggcggtggtggtggcgcgagcgngtgtgtaggtaggtagtaagtagtagttaagacgacgtacgtacgacgacgtacgtcgtgtggacgggtccgtacgtacgactactccgacgacgacgtactaacttacgtacgtacgtaacctacctacgtacgtacgtacgtaacgtaacgtacgaacgtacgacgtagagacgacgacgacgacgtacgtacgtactacgacgacgaacgaagtaacggtacggtacggtacgtacgtagtcg

SEQ ID NO: 97915 - DNA, 537 bp, Homo sapiens
  misc_feature: GYAE6OF02HP0HA.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacagccgtggggggtccctggagactctcctgtgcagcctctggattcacgtttagcaccaatgcccctgagttgggtcccgccaggcctccgagggaaggggctgggagtgggtcgcgaggcatcagtggtagtggaaatgtattttaagacagactacgcagactcgtgtgaggggccgactcaccatctcagagacaattccatcgaaccaccctagtactctagacaaatagaacagacagagacgcgagacgacggaccgtactactactcgacgacgaagagtaaggtaggggactacgagtacg

SEQ ID NO: 97916 - DNA, 538 bp, Homo sapiens
  misc_feature: GYAE6OF02G4F1A.4.60.F05.1.454.CMB.1.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtgtttctaggtggctaatttaaaggtgtcagtgtgaggtgcagctgctggagtcgtgggggagcttggtacagcctggggggtccctgagctctcctgngcagcctctggnttcgacgtttagcaccatgccctgagttcggccgcnggctcgagggagggctggaggtgggcgcgaggcatctaggtggtagtaggaaatgtaattttaagacgtaganacgcaagctctgtggaggggccactcacatcaccgagaacncaaattccagtanaaccacctntacttcgnacaanagaacgaanagagagacgacgacgacgacgtacgtactactacgtcgacgaagaaggtaaggtaaggtagggtacgtacgtagtacg

SEQ ID NO: 97917 - DNA, 562 bp, Homo sapiens
  misc_feature: GYAE6OF02IRNU6.4.60.F05.1.454.CMB.1.raw
  modified_base (153)..(153): a, c, t, g, unknown or other
  misc_feature (153)..(153): n is a, c, g, or t
  modified_base (179)..(179): a, c, t, g, unknown or other
  misc_feature (179)..(179): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (323)..(323): a, c, t, g, unknown or other
  misc_feature (323)..(323): n is a, c, g, or t
  modified_base (472)..(472): a, c, t, g, unknown or other
  misc_feature (472)..(472): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgngtgttctaggtcgctaatttaaaggntcagtgtgagtgcagctgctggagtcgtggggagcttggtacagccgtggggtcctgagtctctctgngcagcctgnggattcgtaacgtttgcacctaatcgcctgagttcgggccncgaggtcnccgaggggacgggctggnggtcgggtcctgacggcatcgagttgagtaggaatagtaactttaaggacagactacggcagtactcgtagtagacggggccacgtcaccattccacgagacgactaaacttccaagtacgaaccaccttagtaactctgaactaatanaacacgtactacgacgacgacgacgacgacggacgtactactactacgacgacgaacgtaagtaacggtagggtacgtaccgtagtaacg

SEQ ID NO: 97918 - DNA, 533 bp, Homo sapiens
  misc_feature: GYAE6OF02H55TZ.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtggggggaggcttggtacagccgtggggggtccctggacgactctcctgtgcagcctctggattcacgtttagcaccaatgccctgagttcgggtccgccgaggctccgaggggagggcgtgggagtgggtcgcgaggcatcagtggtagtggaaatgtaatttaagacagactacgcagactctgtggacgggcgactcaccatctaccagagactaacttcatcgaaccacctatactctagacaatagaacagactgagacgcgagacgacggacgtatactacagacgagaagagtaaggtacggggactaccgatcg

SEQ ID NO: 97919 - DNA, 647 bp, Homo sapiens
  misc_feature: GYAE6OF02HA1M8.4.60.F05.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
tcagagcactgtagcacgaccggtgctcgatttagtacgtcatcagggaaagggggcgtctgagagaggagcccagccctgggattttcaggtgttttctatttggtgatcaggactgaacagagagaactcaccatggagtttgggctgagcgtggtcgtttctaggtggctatttaaaaggtgtcagtgtgaggtgcagctgctggngtcgtgggggagcttggtacagccgtggggggtccctgaagctctccgtgtgcacgcctcgtggattctacggtttancaaccaatcgccctgtagttcgggccnccgacggctccgagggaagggctggagtgggcgacgaggnatgagtggtaggtaggtaagtagtaagttaagtaacgtagtacgtacgacgacgtacgtacgtcggtagggtacgggtaccgtacgtaccgaaccgtactactacgacgaacgaactaacttacctactacgtaacctaaccgttacgtacgtacgtacgtaactaaagtaacgtaaacgaacgtacgtacggacggaacgacgaccggaccggaccggtaccggtaacgtaacctacgtacgtacgaacggaacgtaaggtaacgggtacggggtaacggtacgtacgtacg

SEQ ID NO: 97920 - DNA, 545 bp, Homo sapiens
  misc_feature: GYAE6OF02HRCE9.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttcttaggtggctattttaaaaggtgtccagtgtgaggtgcagctgctggagtcgtgggggaggcttggtacagcctgggggggtccctgagactctcctgtgcagcctctggattcacgtttagcaccaatgccctgagttggtccgcaggctccgagggaaggggctggagtgggtcgcgaggcatcagtggtagtggaaatgtaatttaagacagactacgcagactcgtgtagacggggccgacgtcaccatcctaccagacgacaacttaccatacgaaccaccctagtatctacgacaatagaacagactgagacgcgagacgacggacgtaatacctactcgacgacgaagacgtaaggtaggggaactacgatacgg

SEQ ID NO: 97921 - DNA, 542 bp, Homo sapiens
  misc_feature: GYAE6OF02GI4SC.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacagccgtggggggtccctgagactctcctgtgcagcctctggattcacgtttagcaccaatcgccctgagttgggtccgccaggcctccgagggaaggggctgggagtgggtcgcgaggcatcagtggtagtggaatgtatttaagacagactacgcagtactctgtggacgggccgactcacactctccgagagacaacttcattacgaaccacctgtactctgacaagtagaacagtactgaagacgacgacggacgacggaccgtactactacgtcgacgacgaagaggtaaggtaggggactacgatacgg

SEQ ID NO: 97922 - DNA, 552 bp, Homo sapiens
  misc_feature: GYAE6OF02GYX8Y.4.60.F05.1.454.CMB.1.raw
  modified_base (335)..(335): a, c, t, g, unknown or other
  misc_feature (335)..(335): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacagccgtgggggtccctgagactctcctgtgcagcctctggattcacgtttagcaccaatgccctgagttgggtccgccaggcctccgagggaagggctggagtgggtcncgaggcagtcgagtggtagtggaaatgtaatttaagacagacgtacgcagtactcgtgtggacggggccgactacaccatcctaccgagacgacgtaacttaccatacgaaccacctagtactctgacaatagaacagactagagacgaccgaggacacggaccgtaatacctacgtgaccgagaaagagtaagggtaggggtacctacgagttacg

SEQ ID NO: 97923 - DNA, 615 bp, Homo sapiens
  misc_feature: GYAE6OF02HEELQ.4.60.F05.1.454.CMB.1.raw
  modified_base (386)..(386): a, c, t, g, unknown or other
  misc_feature (386)..(386): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctggagtcgtggggggaggcgttggtacaggccgtggggggtccctgagactctcctgtgcagcctctggattcacgtttagcaccaatcgccctgagttgggtccgccgaggcctccggaggggaaggggctgggagtggggtcgcgaggcagtcagtggtagtggaaatgtaatttaaganagactacgcagcttcgtgtggacgggccgactcgaccatcctacaggagaactaacttaccatacgaacctacccgtgtaactcctagacctaaagtagaaaccgaacgtaactaggacgaacggaccgaagggacccgacgggacccgtaacgtaaccgtacgtacggaccggtaacggaaacggtaggtaaacggggttacgggggtaacctaccggtagtttacgg

SEQ ID NO: 97924 - DNA, 528 bp, Homo sapiens
  misc_feature: GYAE6OF02GYFXO.4.60.F05.1.454.CMB.1.raw
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (483)..(483): a, c, t, g, unknown or other
  misc_feature (483)..(483): n is a, c, g, or t
  modified_base (509)..(509): a, c, t, g, unknown or other
  misc_feature (509)..(509): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacagccgtggggggtcccctgagactctcctgtgcagcctctggattcacgtttagcaccaatcgccctgagttgggtccgccaggcctccgagggaaggggctggaggtgggtcgcgaggcagtcgaggtggtagtaggaaatgtatttaagacagactacgcagactctgtggagggccgacgtcaccntcncagagacattcatcacncctgtatctagacaatgaacagactgagagcgagacgacgacgtanactacgcgacgacgaagacgtaaggnggggtacctacgagttacg

SEQ ID NO: 97925 - DNA, 535 bp, Homo sapiens
  misc_feature: GYAE6OF02FTQLG.4.60.F05.1.454.CMB.1.raw
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgcgtttctagtggctatttaaaaggtgtccagtgtgaggtgcagctgctggagtctgggggaggcttggtacagcctggggggtccctgagactctcctgtgcagcctctggattcacgtttagcaccaatgccctgagttgggtccgcaggctccagggaacggggctggagtgggtcgcaggcatcagtggtagtgggaaatgattttaagacagactagcagactctgtgagggccgacgtcaccatctccagacgacaattccattacgaacacctgtatcngacaactgaaacagactgaagngacgacggacgacggaccgtaataccgtactgtcgacggaaagacgtaagggtacgggggactaccgattacgg

SEQ ID NO: 97926 - DNA, 762 bp, Homo sapiens
  misc_feature: GYAE6OF02F8KR9.4.60.F05.1.454.CMB.1.raw
  modified_base (225)..(225): a, c, t, g, unknown or other
  misc_feature (225)..(225): n is a, c, g, or t
tcagagcactgtagcacgaccggtgctcgatttagtacgtcatcagggaaagggggctctgagagaggagccccagccctgggattttcaggtgttttcatttggtgatcaggactgaacagagagaactcaccatggagtttgggctgagtcggtcgttcgttttcgtaggtcggtacttaaagttttaaaaggtcgtaccgaggtgtggaggtcgcagtctgngtggagttcgggtgggggacgtcggttaggtacgcggtccgggtccgggggtccctaggaacgtcctccgtccgtgtcgacacgtcctcgtaggtacttcgtaacgtttagccaacctaagtccgtcccgtgtaggtttcgggcccgccgtacggccctaccgggaaggggaagggtcgtgggtaggtcgggtcgcgaggacacgtcgaggttggtaggtaaggtaaatggtttaaagtttaacgacgaagtaaccgacgacgtaagaccttcgtaggtgggacggggtacccaccgtaccaaccgtacttccgtaacccgaaggtaccggaacttaaccgttaccagttaacggaacccctaacgtgtttaacctacgtacgaactaaagtaaccgaaactaacgtacgaagtaacggaccaaccgggaagaccgtacccgggtaccgttaaacgtaacccttacggccggaaccgtaaaccggaaaggtaacggttaaacggggggaacgggtaccccttaaggagtttaaccgg

SEQ ID NO: 97927 - DNA, 559 bp, Homo sapiens
  misc_feature: GYAE6OF02HCM6H.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtggggggaggcttggtacaggccgtggggggtccctgagactctcctgtgcagcctctggattcacgtttagcaaccaatcgccctggagttgggtccgccgaggcctccgaggggaaggggctgggaggtgggtcgcgaggcagtcaggtggtagtggaatgatttaagactagactacgacagactcgtgtggacgggccgactcgacctatctccagacgacaattaccatacgaaccaccgtgtactctagacaaatgaacacgactgagacgaccgagacgacggacgtaagtacctacgtcgacgacgaaagacggtaggacggggtaactacgagttacgg

SEQ ID NO: 97928 - DNA, 620 bp, Homo sapiens
  misc_feature: GYAE6OF02GFWTP.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcttttctgtggctaatttaaaggtgtccagtgtgaggtgcagctgctggagtcgtgggggagtcgttggtacaggccgtggggggtcccctgacgactctccgtgtcgcagcctctggtattctacgtttagccaaccaacgtcgccccgtgtaggttcgggtccgccgaggcctccgaggggaacgggcgtggaggtggtcgcgaggcagtcgaggtggtagtaggaagtgtatttaagacagacgtacgcgagactcgtgtaggacggggtccgaccgtacgaccacgttcctaccgagaacgactaacgttccataacgaaccacccgttagtactcgtacgaactaacgtacgaacaacgtacgttagacggtacgaccggacggacgacccgtacggtaactaccgtacgtcgacgtaacgaaagtacggtaagggtacggggaactaccgagttaccg

SEQ ID NO: 97929 - DNA, 749 bp, Homo sapiens
  misc_feature: GYAE6OF02H1QKA.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcacatggagtttggctgagcgtggtcttttcttgtggctattttaaaaggtgtccagtgtgaggtgcagctgctggagtcgtgggggaggcgttgggtacaggccgtgggggtccctgaggactctcctgtcgcagcctcgtggtattctacgttagcctacaagtcgccctggacggttcggtccgccgacgggtcctaccggaacggggaacggggtcgtacggggtagggttcgggggtccgtacggaacggggtcctagtccggaaagggtttgggttaaaagggtgggtaaaagttaggtttaaacgttttaaaacggaaacgtacggaaaccttaacgggaccgtaaacggtaacctttacggttgggttacggggacggggtcccgtaacccgttaccgaaccctacgtaccgtaccgaacggacgtaactaacctaccgtaactacgaaccctacctacgtactacgtacgtaactaaacgtacgtaaacaacgtaacgtacggtaaagaccggaccggaacgggtaccgacccgggttacctaacgtaaccgttacgacggtaccgaacggaaggtaacggtagggtaaccggggtactacgtagttacgg

SEQ ID NO: 97930 - DNA, 645 bp, Homo sapiens
  misc_feature: GYAE6OF02HYJQA.4.60.F05.1.454.CMB.1.raw
  modified_base (179)..(179): a, c, t, g, unknown or other
  misc_feature (179)..(179): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (321)..(321): a, c, t, g, unknown or other
  misc_feature (321)..(321): n is a, c, g, or t
tcagagcactgtagcacgaccggtgctcgatttagtacgtcatcagggaaagggggctctgagagaggagcccagccctgggatttttcaggttgttttcatttggtgatcaggactgaacagagagaactcaccatggagtttgggctgagcggtgtgttctaggtcgctatttaagngtcagtntngtncagcngctgagtgtgggcgnttggcngccgtggggtcctgcgctctctgtgcacgccttgaggtatctagttacgcaccancgtcctgtgttcggccgacccgtggctaccggagggtagggcgtagggngtggtcgacgacgcagtcgtacgtggtagtagtaagtagttaagttaagtacgtacgacgtacgtacgtacgtacgtcgtaggtcggacgggaccgtaccgtaccgtaacctactaccgtaccgtacgaacgtaactaacgttacctacgtacgtaccgtaaccgtacgttacgtacgtacgtaacgtaacgtaacgtaacgtacgtacgtaacgtacgaacgacgaccggtacggtaccggtaccgtaacgtacgtacgtacgtacggtaacggtaacggtaacgggtaacggggtaacgggtaaccgtaccgttacgtacgg

SEQ ID NO: 97931 - DNA, 600 bp, Homo sapiens
  misc_feature: GYAE6OF02GT68R.4.60.F05.1.454.CMB.1.raw
  modified_base (270)..(270): a, c, t, g, unknown or other
  misc_feature (270)..(270): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcgttttctaggtggctattttaaaaggtgtccagtgtgaggtgcagctgctggagtcgtgggggagcttggtacagccgtgggggtccctgagactctcctgtgcagcctctggnttcacgtttagcaccaatcgccctggtacgttcgggtccgccgaggcctccggaggggacgggctgggagtcgggtcgcgaggcagtcgagtggtagtaggaatgtaatttaacgacgagaactacgcagtactcgtgtggacgggccacgtcaccagtcctccgaagacgaactaacttaccagtacgaacctacccgtagtactcgtacgaacctaaatacgaacaacgactacggagaacgaccgacgacgaccggtacgtaactacctaacgtagtaccgaacgaaacggtaagtaagggtacggggtaactaccgtagtttacgg

SEQ ID NO: 97932 - DNA, 805 bp, Homo sapiens
  misc_feature: GYAE6OF02H11JY.4.60.F05.1.454.CMB.1.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (260)..(261): a, c, t, g, unknown or other
  misc_feature (260)..(261): n is a, c, g, or t
  modified_base (263)..(265): a, c, t, g, unknown or other
  misc_feature (263)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
tcagagcactgtagcacgaccggtgctcgatttagtacgtcatcagggaaagggggctctgagagaggagccccagcccctggggatttttacgaggtttgttttcttagttttgggtagtactacgaacggtacgtagaaacgaaggaaggaaacgtaacctacccaacctaggtagggtttagggtttcgggtcgtaggacggtcgggtcgtttcgttacgtagggtcgtactttaaagttaaggtctgngtgngngnngnnngngngntgggtggngtgtagcgcgtcgggtccggtcgagctctccgtgtgcgacgcctcgtggtagttactaccgttagtaccaccctaatcgtcccgtacgtggttacgggtcccggtacccgaccggcgtaccgacggggaagggtaccggtggtagggtcggttcggccgtaagggcgacgtagtcgggttagggttagggtaaggaaagttaagtacggttttttaaaaggaacgaacggaacgttaaccgtcgaacggtaacttcccgtacgggttaggtaccgggggaccggtacccgtaaccgtacccgtaacctcgtacccgtaaccgtaaggaacaaccgttaacctacgtaacgtaacccgtaacccttaccgtactaccgttacgaacctaaacgttaacgaaaccgtaacgaacgtacgtagaccgggaaccgaacggaccgaccggtaccgttacgtaacctacggtacgcgtaacgaacggtaagtaacgggtacggggtaaccggtaaccgttacggtgttacgg

SEQ ID NO: 97933 - DNA, 574 bp, Homo sapiens
  misc_feature: GYAE6OF02IPDB9.4.60.F05.1.454.CMB.1.raw
  modified_base (166)..(166): a, c, t, g, unknown or other
  misc_feature (166)..(166): n is a, c, g, or t
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (416)..(416): a, c, t, g, unknown or other
  misc_feature (416)..(416): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcgtttctaggnggctatttaaaaggtgtcagtgtgaggtgcagctgctggagtcgtgggggagnttggacagccgtggggggtcctgaagctctctgtgcagcctntggattcacgtttagcaccaatcgcctgngttggccncaggtcnccgagggaagggcgtggagtgggtcgngaggcagtcgaggtggtaggttaggaaatagtatttaaggataacgactacgacagtaactcgtggtcggagggccagtacacngtcctacgagacgataactcactagaaccacctgaacgttcagataactacgaaaccgtaagacgtggaacgcgtaccgaacggaccgtaacggtccgtaactaaccgttacgtacgacgaacgaagaacggtaacggtggggaactaccgattacgg

SEQ ID NO: 97934 - DNA, 582 bp, Homo sapiens
  misc_feature: GYAE6OF02GN7IQ.4.60.F05.1.454.CMB.1.raw
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggcttttctgtggctattttaaaaggtgtcagtgtgaggtgcagctgctggagtctgggggagcgttggtacagccgtggggggtccctgacgactctcctgtgcagcctctggattcacgttttacgcaccaatgccctgagttgggtccgccgaggctccaggggaaggggctggagtgggtcgcgaggcatcagtggtagtggaaagtgattttaagactagactacgcagactcngtgagggccgacgtcaccagtcnccgtagacgactaattaccaacttacgaaccgaccccttgtaactcttcggacaaatacgaacaagacgtagagaagccgaaggtaccgacggacccgtaagtacctactacgtacggaacgaaacggacggttaaacgggtaggggggaccttaccgattaccggg

SEQ ID NO: 97935 - DNA, 662 bp, Homo sapiens
  misc_feature: GYAE6OF02JANW4.4.60.F05.1.454.CMB.1.raw
  modified_base (207)..(207): a, c, t, g, unknown or other
  misc_feature (207)..(207): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggngtctgggggagcttggtacagccgtggggggtccctgagacctctcctgtgcagcctctggattcacgtttagcaccaatcgccctgagttgggtccgccgaggcctccgaggggaagggcgtggtacggtcgggttcggacgacggacgagtcgtacggtagggttacggtagggtaagtaggttatttaaagtactagacgtacgacacgacgtactggtacggtacgggaccggtaccgaccaccgactacgtccagacggaactacttaccgactacgaaccgaccctacgtacttacgcgtaacaactaacggaacaacggacaggtacggaagacccgtaacgggacgtaaccggccggttaacctaactttaaccggacggtccggaacccgtaagggtaaccggttaaggggtaccggggggttaaccggaccgtacggtttacggg

SEQ ID NO: 97936 - DNA, 617 bp, Homo sapiens
  misc_feature: GYAE6OF02HZAWS.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggcgttttctaggtggctattttaaaaggtgtccagtgtgaggtgcagctgctggagtctgggggaggcttggtacagccgtggggggtccctgagacgtctcctgtgcagcctctggattctacgttagcaccaatcgcctgagtggtccgcgaggctcgagggagggcgtggagtgggtcgcgaggcatcagtggtagtggaatgtatttaagacagactacgcagactcgtgtaggacgggaccgacgtcacctatctacagacgactaattccagtacgaacctacccgtagtactacgtacgactaaagtacgaaacgaacgaacttgggaacgaacgggtacccgaacgggaccgtaaccgggtacccgttaagttaacccgttaacgtcggaaccggaacggaaacggttaacggtaaacgggtacggggggtaaccttaaccggtacgtttaacgg

SEQ ID NO: 97937 - DNA, 564 bp, Homo sapiens
  misc_feature: GYAE6OF02HNO04.4.60.F05.1.454.CMB.1.raw
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
  modified_base (449)..(449): a, c, t, g, unknown or other
  misc_feature (449)..(449): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgcgttttctggtgctattttaaaaggtgtcagtgtgaggtgcagctgcgtggagtctgggggagcttggacagcctggggggtcctgagactctcngtgcagcctntggacttcacgtttancaccaatnccctgngttggtccgccgaggcgtccgagggaaggggctggagtgggtcgnaggcatcagtggtagtaggaaatgtaagttttaagacgagaactacgcagactcgtgtaggagggccgacgtcaccactactcagagaacaattccatagaactacccagtactntacgacaactagaacagtacagagacgacgaacggagaaccggacgtaacgtaacaccgtagaccgtaacggaaacgtaagtaaaggtaggggggaaccttaccggagttaacgg

SEQ ID NO: 97938 - DNA, 815 bp, Homo sapiens
  misc_feature: GYAE6OF02I0OU0.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcacatggtagttggctgagcgtggtcgttttctggtcggtacttaagttttaaaggtcgtccagttgtgaggtgacgagctcgtcgtggacgtcggtagggggacggtcttgggtacaggtccggttcggggggtcccctaggacgtaccgttcctcgtgtacgcgagtcctcgtaggacttacgtaccgtttagaccaacgtaacgtcgtccctgttacggttcggtacccgccgtacggtcccgtaaccggaggggaacgggtcgtagggtacgggtcgggtaccgcggaaggtccaacgttcgagggttggtagggttaaggtaaagtaggttaaagttttaacggaactacggtaccgtaccgacgaacgtaccgttcgtaggtcgggaacgggtcccgactaccgacctagtacctacgaaacgtaccgtaactaacgttacctagtaaccgaaaccgttcccgtaagttacgtacgttacgaacgtaaacgtacgtaacgtaacgtaccgtaggaaaccggaaccggaaccgggaaccggacccggtaacgggttaaccccgttaaacggtttaacccgtacggtttacccgggaacccgtaaacccgggtaaaagtaaccggggtttaaccggggtaaccgggggttaacccgtttaaccgaccggtttttaacccggg

SEQ ID NO: 97939 - DNA, 761 bp, Homo sapiens
  misc_feature: GYAE6OF02H8GT6.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtctttttcttgtggcttaattttaaaagctgtccagtgtgaggtgcagctgttggagtcgtgggggaggtcttgggtccgacgggtccgggggggggtccctaggacgaccgtcttccttgttctcgcctcgtggtacttctacctttatgttaattttcgcctagtcgagtcgtcgggtcccgccagtacctccgaacgggacggggtctgggaggttcgggtcctacgtaagttcgtttacgtggtactaggttgggtggtactaccactactacgtacgctaagtactaccgggtagggaaccgggttacccgggttacctaaccgtacttcccgtaccgaaggtaacggtaaacctaacttaacccgaaaacggaaacccctaccccgttaaggtaactttaccgtaacggtaaactaaaacgtacgaaaaccgtacgtaccgttaaggacggacgggaaccggacgaaccgaaccgggttaccggtaattaacgttacttcgggtaataaccgtaaaagtttacgttttaggtaacgtacgtagttaccggttacccgtttaacgtttcgtttttacgtacccggtttcggtaacccgggg

SEQ ID NO: 97940 - DNA, 598 bp, Homo sapiens
  misc_feature: GYAE6OF02IWDIM.4.60.F05.1.454.CMB.1.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagagcactgtagcacgaccggtgctcgatttagtacgtcatcagggaaagggggcgtctgagagaggagcccagcccctgggattttcaggtgttttctatttggtgatcaggactgaacagagagaactcaccatggagtttgggctgagcgtggtcgttttctaggtggctagttttaaaaggtgtccagtgtgaggtgcagctgctggagtcgtgggggaggctttgggacctagccgtggggggtccctgagactctcctgtgcngccttcgnggtnttcgaccgtttagcctaaccaagtcgccccgtggtacgttcggggtccgcccgtaggcttcccgagggaagggctgggagtggggtccgcgnggacngtcaggtggagtagggaaatgtatttaaggacaagacgtacgacgagactcgtgtggacggcgacgtcacgatctacgagagacgaacttaccatacgactaccgtgtactctagacacgtagaacgtacgactacgagacgacgaacgacgaaccgacgtacgtaacctacgtacgcgacgaacggtaacgaaggtacggggactaccgagttacgg

SEQ ID NO: 97941 - DNA, 593 bp, Homo sapiens
  misc_feature: GYAE6OF02FY7HD.4.60.F05.1.454.CMB.1.raw
  modified_base (497)..(497): a, c, t, g, unknown or other
  misc_feature (497)..(497): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggcgttttctagtggctattttaaaaggtgtccagtgtgaggtgcagctgctggagtcgtgggggagcttggtacagccgtgggggtccctgagactctcctgtgcagcctctggattcacgttttagccaaccaatcgcccctggtagttcgggtcccgccgaggcctcccggaggggaacggggcgtagggaggtggggtcgcgacggcagtcgaggtgggtagtagggaaatggtagtttaagacgtagtactacgcagactcgtgtacggaggggccactccacactccgtaccagacgacctaattaccatacgaaccacctactactctgactaaacngaaacgacgtaacgtagacgacgacgacgaccgacggaccgtaactactacgtcgacgacgaacgacggtaagggtacggggactacgtagtacgg

SEQ ID NO: 97942 - DNA, 559 bp, Homo sapiens
  misc_feature: GYAE6OF02HCLH7.4.60.F05.1.454.CMB.1.raw
  modified_base (399)..(399): a, c, t, g, unknown or other
  misc_feature (399)..(399): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcacatggagtttgggctgagctggctttttcttgtggctattttaaaaggtgtccagtgtgaggtgcagctgctggagtcgtgggggaggcttgggtacagccgtggggggtccctgagactctcctgtgcagcctctggattcacgtttagcaccaatgccctgagttcggggtccgccgagggcctccgaggggaaggggccgtgggaggtcggggtcgcgaggtcgatcgagtggtagtggaaatgtaatttaagacagactacganagactcgtgtggagggccgactcaccatctaccagacgacaattacatacgaaccaccctgtatactcgacaaatacgaaacagactagacgagaccgaggaccgacggacgtaactactacgtacgacgacgaagagaggtacggggactaccgatcgg

SEQ ID NO: 97943 - DNA, 591 bp, Homo sapiens
  misc_feature: GYAE6OF02H98ZA.4.60.F05.1.454.CMB.1.raw
  modified_base (400)..(400): a, c, t, g, unknown or other
  misc_feature (400)..(400): n is a, c, g, or t
  modified_base (439)..(439): a, c, t, g, unknown or other
  misc_feature (439)..(439): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctgctggagtcgtgggggagcttgggtacaggccgtggggggtcctgagactctctgtgcagcctctggattcacgtttagcaccaatcgccctgagttcggtccgccgaggtctccgagggaagggcgtggagtgggtcgcgaggcagtcaggtggtagtaggaaatgtaatttaagacgagactacgcagactcgtgngagggccgactacacactctcgagacgaacaattaccanagaaccctaccgttagacttaccgtacgtaacaaactacgaaacgacgaactgaacgaacgccgaacggaccgacggtaccgtaacgtacctacgtacgaccgaacggaaacgtaacggtaagggtacgggggtaactaccgtagttaacgg

SEQ ID NO: 97944 - DNA, 623 bp, Homo sapiens
  misc_feature: GYAE6OF02I3T1R.4.60.F05.1.454.CMB.1.raw
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (441)..(441): a, c, t, g, unknown or other
  misc_feature (441)..(441): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttctaggtggcttatttaaaaggtgtcagtgtgaggtgcagctgcgtggagtcgtgggggagtcttggtacaggccgtcggggggtccctggagacctctccgtggtgaccagtcctcgtaggtattcctacgttagacacaatcgccctgaggtcggtccgacnggcctcgagggaggctaggngtcggtcncgaggcagtcgagtggtagtggaatcgtagtttagacgagtactacgacgacgtactgtgtaggacggggccgaccgttacaacccgnttaccgtccgagaacggtaactaaccggttactaacgttacgaaacccgtaccctaacggttcctacgtacgtactaaacgtacgaacgacgtacgtacgagacgtacgaggaccgacggtacctaacgtcaccgtagaccgaacgaacgtacgtaaggtcggggaacttaccgagttacgg

SEQ ID NO: 97945 - DNA, 685 bp, Homo sapiens
  misc_feature: GYAE6OF02HM47X.4.60.F05.1.454.CMB.1.raw
  modified_base (268)..(268): a, c, t, g, unknown or other
  misc_feature (268)..(268): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtggggggagcttgggtacaggccgtggggggtccctgagactctcctgtgcagcctntggattcacgtttacgcaccaatcgcccctggaggttcgggtccgccgacgggctacccgaggggaacggggcgtgggaggtggggtccgcggaggcgatcaggtggtagtaggtaatgtaattttaaggactagactacgcagactcgtgtggacgggccgacgtaccacctatcgacctagaacgactaacgttccacttacgaaccaccctagtacttcgtgactaaacgtagaaacctacgacgttacggaacggtacggacccggaagggacccgtaaccgggtacccggttaaacgtttaacccgtaaccggttcgggaacccggtaaccgggtaaaacggttaagggttaaaaccggggggttaaccgggggggttaacccgttaaacccggttaagttttaacccgggg

SEQ ID NO: 97946 - DNA, 578 bp, Homo sapiens
  misc_feature: GYAE6OF02GBZIC.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacaggcctgggggggtccctggagactctcctgtgcacgcctctggattcacgttttagcaccaatcgcccctgaggttgggtccgccgaggctccgaggggaacggggctgggagtgggtcgcgaggcatcgaggtggtaggtaggaatgtattttaagactagactacggcagactcgtggtggacggggccgacgtccgaccatccaccagacgaacacttaccatacgaaccaccgtgtactctagactaaagtacgaacagtactagagacgaccgaggaccgacggaccgtagtacctacgtgacgaacgaaggaacgtaaggtaggggacctaccgtagttacgg

SEQ ID NO: 97947 - DNA, 676 bp, Homo sapiens
  misc_feature: GYAE6OF02JOQCF.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttagttttaaaggtgtccagtgtgaggtgcagctgctggagtcgtgggggaggtcgttgggtacacggtcccggttcgggggggtccccttggacggtaccttccgttccgttggtcggccgacggtcccttcgtgggtactttccgtacgttttagcctaaccaagtcgcccctggtaggtttccggggtcccgccgacggtccgtaccggaggggaacggggtcgtgggagggtcgggtcgcgtaggcagtcgaggtcggtaagtaggtaaattgtaagtttaacgacgagactacgacagtacgtgtggtcggacgggcccacgtcacctagtcacgagtacgaactacttccagtacgacctaccttagtacctcgttacgaactaaagtcgaaacgacgtaacgtagacggtacgaccgaagaccgtaaccgtaccgtaattaccgtacgtacgaccgtaagtaacgaacggttaagggtaccgggtaactaccgtagtcgg

SEQ ID NO: 97948 - DNA, 775 bp, Homo sapiens
  misc_feature: GYAE6OF02GXT05.4.60.F05.1.454.CMB.1.raw
  modified_base (153)..(153): a, c, t, g, unknown or other
  misc_feature (153)..(153): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (765)..(765): a, c, t, g, unknown or other
  misc_feature (765)..(765): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcacatggagtttgggctgagcggngtgttctaggtgctattaagntcngtgtgagtgcagctnctggagtgtgggggaggcttaggtacngtccgtgggggtcctgagctctcctgtcgcactcctcgtggtacttacgtacgtttacgcaacccgtaattcaccccgtggtaacgggtttccggggtccgaccgtacgggcccgttacccggaagggggaacgggggtcgtggggtaacgggttgggggtccggaccgacgggggataaccgtcggttaggttaggggtaaggttacggggtaaaattacggtttaaaggtttttaaaagaaccgttaagggaacccttaaccggaacgaacggtaacgtttccggtaggtttacggggaccggggaccggtacctaccgtaaccctacgttcctacccgaagggaacgtaaccctaaacttcccgaaacttacgggtaacctaacccgttaggttactccttaggaacctaaagtaacgaaacgtacgttaacgtgaaacgaacggccgggaacggtaccaccggtaccggtaattaacccgtaggtacccggacgaacggtaaaggtaaacgggttaggggtaaccggggtacttaaaccggngtttaaccgg

SEQ ID NO: 97949 - DNA, 664 bp, Homo sapiens
  misc_feature: GYAE6OF02FZNXV.4.60.F05.1.454.CMB.1.raw
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtcgtggttcaaggtcgctaatttaaggntcngngtgngtngagtctgctgagtgtgggagcgttgacngcgtcgggtcctgacgtctcgtacgtgtcgacgtacgtccgtagtcgtattacgtacgttacgaccgtaacgactcgtaccgttaggtacggttcggaccgacgtacggccgtaccggaagggtacggtcgtacgggacggttgggtacgacgtacggtacgtagtacgtacggtaggtacgtaaggtaagtacgttaagttaacgtaacgtacgtacgtacgtacgtacgtacgtacgtaggtacggacggacgtacgtaccgtacgtacgtacgtacgacgtaacgtactactacgtacgtactaccgtacgtacgtacgtacgtacgtacgtacgtacgacgacgtagacgacgacgtacgacgtacgtacgtacgtacgtacgtacgtacgtacgtaacgtaacgtacggtaacggtacggtaacgtacgtacgttacg

SEQ ID NO: 97950 - DNA, 596 bp, Homo sapiens
  misc_feature: GYAE6OF02IAG8X.4.60.F05.1.454.CMB.1.raw
  modified_base (440)..(440): a, c, t, g, unknown or other
  misc_feature (440)..(440): n is a, c, g, or t
tcagagcactgtagcacgaccggtgctcgatttagtacgtcatcaggggaaagggggctctgagagaggagcccagccctgggattttcaggtgttttcatttggtgatcaggactgaacagagagaactcaccatggagtttgggctgagctggtctttttctgtggcttaattttaaaaggtgtccagtgtgaggtgcagctgctggagtcgtgggggagcttggtacaggccgtggggggtccctgacgactctctgtgcagcctctggattctacgtttagccaccaatcgccctgagttcgggtccgccgtaggccgtcccggaagggacgggggcctggggacggtcggggtcgcgaggcactcgaggtggtaggtaggaaatgtaagttttaagacctagactacgctagactctggtagaggggccgactcncatctcagacaacaacttccatacaacctaccctagtactcgtagactaatacgaacagacctggaagacggaccgagaccgaccggacggttaactaacctaacgtcggaccaacggaagtacgtaacgggtagggggaacttaccggattacgg

SEQ ID NO: 97951 - DNA, 663 bp, Homo sapiens
  misc_feature: GYAE6OF02FYLEE.4.60.F05.1.454.CMB.1.raw
  modified_base (656)..(656): a, c, t, g, unknown or other
  misc_feature (656)..(656): n is a, c, g, or t
tcagagcactgtagcacgaccggtgctcgatttagtacgtcatcagggaaagggggctctgagagaggagcccagccctgggattttcaggtgttttcatttggtgatcaggactgaatagagagaactcaccatggagtttgggctgagcgtggtctttttcttaggtggctaatttttaaaaggtgtccagtgtgaggtgcagctgctggagtcgtgggggaggcgttggtacagccgttggggggtccctgacgactctcctgtcgcagcctcgtggtactttcgtacgttttacgccaacccaaattcgccccttggtaggtttcggggtacccgccgacgggcctacccggagggggaacggggtccgtagggaggtcggggtcgccgaggccagtcgagttggtagtaggaatgtaatttaagacagactacgcagactcgtggtaggacggggtccactccgaccactccgtaccaaggaccgaaactaaccttaccaacttacgaaaccctcccgttagtactacctagaacctaaagtacggaaacagtaacaggaacgacggaccgacggaccgtaacggaccgtaagtaccgtacgtacggaccgtaaggaaacgtaggtaacgggtacggggaactaccggttnttaacgg

SEQ ID NO: 97952 - DNA, 589 bp, Homo sapiens
  misc_feature: GYAE6OF02F9KK8.4.60.F05.1.454.CMB.1.raw
  modified_base (569)..(569): a, c, t, g, unknown or other
  misc_feature (569)..(569): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctggagtctgggggagcttggtacagccgtggggggtccctgagactctcctgtgcagcctctggattcacgtttagcacaatgccctgagttggtccgccaggctcgagggagggctaggagtgggtcgcgaggcagtcgagtggtagtaggaatagtaagtttaaagacgtaagtacgtacgcaaggtactcgtggtaggacggggccgtaaccgtcgacctagtccgtaccgaggaacgaccgtaattacccagtacgaacctaccctagtactcgtagactaataagaacgaagacgtacgagacgacggacgaccgtacggaccgtaagtaactaccgtcgacgtacgaacgtagtaacgggnggggaacctacgagttacgg

SEQ ID NO: 97953 - DNA, 687 bp, Homo sapiens
  misc_feature: GYAE6OF02H37TJ.4.60.F05.1.454.CMB.1.raw
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (190)..(191): a, c, t, g, unknown or other
  misc_feature (190)..(191): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcacatggagtttgggctgagcggtgtcgttctaggtcgctaagtttaaggntcagtngagnnagctgcngngtgngggagtcgttgacngtccgaggggtcctaagcgtctctcgngtnacgtcgtctacgtgtctcgtacgtacgacacgtacgtccgtacgtagtcggtcggccgacgtacggaccgtcggaggggacggtcggtagggcggtacggaccgtagaggactacgtacgtaggtaggtaaggtaagtaagttaggtaacgttaagaacgtacgtacgtacgtacgtagtacgtaggtaggtacgggacccggtcgacccgtccacgtaacgtcgtaacgacgtacgtaactaccttactaacggaaccttaaaccgtacgttaacgttaccgtaaagacgtaaacgtaaacgtaacgtaaacgtacgaacgtacggtaacggtaaccggaccggaccgtaccgtaccggtaaccgtaaccgtaacggtaacgtacgtacgtaagtaacggtaacgggtaaccggtaccggtacggtacgttagtacgg

SEQ ID NO: 97954 - DNA, 536 bp, Homo sapiens
  misc_feature: GYAE6OF02FHKDH.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacagcctggggggtccctgagactctcctgtgcagcctctggattcacgttttagcaccaatgcccctgagttgggtccgccaggctccagggaaggggctgggagtgggtcgcgaggcagtcagtggtagtggaatgatttaagacagactacgcagactcgtgtgaggggccgactcaccatctacagagacaattccatcgaaccaccctgtactctagacaaatcgaacagactagagacgaccgagacgacggccgtaatacctacgtcgcgacgaagagtaaggtagggggactacgagttacgg

SEQ ID NO: 97955 - DNA, 686 bp, Homo sapiens
  misc_feature: GYAE6OF02GO757.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacagccgtggggggtccctggagactctccgtgtgcagcctctggattcacgtttagcacaatcgccctgagttcgggtccgccgaggcctccgaggggaacgggcgtgggagtaggggtcgcgaggcagtcaggtggtacgtaggaaagttgtaattttaagacgtagacgtacgcgagacctcgttggtacgggaacggggtcccggaaccgttccaacccgtacttaccgtaccgaacgaacgtaacctaactttacccaagttacgaaaccctaccctagttactctacgtaacaaagttacgaacgtaacgtaccgtaagaacggaacgacccggaagggtacccgaccgggtaacccgttaagttaacccggttacggtacggacccggtaaacggtaaacggtaacggttaaacggggttacgggggtaaaccttacccggtaagtttaccgg

SEQ ID NO: 97956 - DNA, 675 bp, Homo sapiens
  misc_feature: GYAE6OF02HV12N.4.60.F05.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcacatggagtttgggctgagcgtgtcgtttctaggngctaatttaaaggntcagtgtgagtncgagctgcttggatcgtgggggagcttggtacagtccgtgggggcctgagtctctctgtcncacgtcctcggtnattctacggtttacaccgacctaaagttcgacccgtagtaggttcggtccgaccggagacgtacggacgggaagggtcgtagggagtacgggtcgcgacggatcgtacgaggttggtaggtaagtaagttggttaaattttaaacgacgtacgaaacgttaaccggataccggtaacttacggtacgtacgggacgggtaccgtaaccttaccgaacgtactactacggtaacgaaggtaactaacgttaaccgtaactacggtaacccttaaccgtacggttaactactacggtaacctaacgaacgaacgtaacgacgtagacgacgaccgagacgtaccgtacgtactaccgtagaccgtagaaccggaataggtaaccgggtaggggtaaccacgtagttaaccgg

SEQ ID NO: 97957 - DNA, 623 bp, Homo sapiens
  misc_feature: GYAE6OF02IA55L.4.60.F05.1.454.CMB.1.raw
  modified_base (231)..(231): a, c, t, g, unknown or other
  misc_feature (231)..(231): n is a, c, g, or t
  modified_base (431)..(431): a, c, t, g, unknown or other
  misc_feature (431)..(431): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctggagtcgtgggggagcgttggtacnggccgtgggggggtccctggacgtactctcctgtgcagcctctggattcacgttttagcaccaatgccctggagttcgggtccgccgaggcctccgagggaacgggcgtgggaggtcggggtcgcgaggcatcgaacggtggtagtaggaaatggtaattttaagaacgtgactacgcagactcgtgtgagggccgtacncaccatctaccaagacgaactaattcccatacgaacctacctagtactccgtagactaacagaacagtaacgtagacggacgaccgtaacggaccgaacccgggaccgttaactaaccgtaccgtacggaccggaacgtaaacggtaaggtaaacggggttaggggggtaccttaacccggtagttaaccgg

SEQ ID NO: 97958 - DNA, 822 bp, Homo sapiens
  misc_feature: GYAE6OF02HAPIZ.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctggagtcgtgggggaggcgttggtacagccgtggggggtccctgagactctcctgtgcagtcctctggattcacgtttagcaccaatcgccctggtagttcgggtcccgccgtaggcctaccgaggggaacgggccgtgggaggtcggggtcgacgtagggaccagtccgaggttgggtaaggtagggaaacgttagtaagttttaaacggaacgtaggtaaccgtaaccggacgtaaggtaaccgttcgttagggtacgggtacgggggacccgtaacccgttaacccgaacccgtaacgttacccgtacccgaaacggaacgtaaacctaaacgtttaccctaacgtaaccgtaaaaccctaaccccgttaacggttaaccttaccgttaacggtaacccgtaaaacgttaacggtaaacccgtaacggttaaccgttaacgggaaccggtaaccgggacccgggaaccgggtaacccggaacccggggttaaccccggttaaacgtttaaacccgtaacccggtacgggtaacccggtaaccgggtaaaacggtaacgggttaaacgggggttaacccggggggggtaacccttaacccgggtacggtttaaccggg

SEQ ID NO: 97959 - DNA, 681 bp, Homo sapiens
  misc_feature: GYAE6OF02H1QUU.4.60.F05.1.454.CMB.1.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcacatggagtttgggctgagcgtgtcgttttctaggtggctaatttaaaggtgtcagtgtgaggtgcagctgctggagtcgtggggagnttggacagccgtgggggtccngagctctcgtgtgcacgcctgtggacttcgtacgtttagcaacctaatcgcctgtaggttcggccgcgacggcnccggagggaggtcgtaggnggtggcgacgaggccattgagtaggtgtagaaagttgtaagtttaagacagtaacgtacgacgagtaccttgtagtacggacgggtaccgtacgtaccaaccacgttccaccgaagacgaactaacttaccgattaacgacctaactacgtactacttacggaacctaagttaacgaaactaaccgttaacgtaaggaacggaaccggttaaccgggaacggtaaccggaacccgggtacccggttaacgttaacccttaacggttaacggaaccggaaccggttaaaaccgggaaagggtaaacgggtttaccggggggaaaccttaacccggtaaggtttaacccgg

SEQ ID NO: 97960 - DNA, 652 bp, Homo sapiens
  misc_feature: GYAE6OF02IN3L8.4.60.F05.1.454.CMB.1.raw
  modified_base (180)..(180): a, c, t, g, unknown or other
  misc_feature (180)..(180): n is a, c, g, or t
  modified_base (193)..(193): a, c, t, g, unknown or other
  misc_feature (193)..(193): n is a, c, g, or t
  modified_base (273)..(273): a, c, t, g, unknown or other
  misc_feature (273)..(273): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtcttttctgtggcttatttaaaggtntcagtgtgaggtncagctgctggagtcgtgggggagtcgttggtacaggccgtggggggtcccctgacgtacctctcctgtgcagcctctggnttcacgtttagcaccaatgccctgagttgggtccgccgaggcctccgaggggaagggctggagtgggcgcgaggcatcgagtggtagtgaaactgtatttaagacagacagcagacttcgtgtaggacgggacccgactaccgtacctacgttcctactaaggaacgaacctaacttacccgaagttacgaaacctaccccttaggtacctacgtacgtaactaaagtacgaaaacacgtaacctaggtaacggtaaccggaccgggaaccgtaccggaccgggtaacccgtaacgttaccgtaaccggtcgacccggtaaccggtaaaggtaacgttaaccgggggtagggggtaacctacccggtaagtttaccggg

SEQ ID NO: 97961 - DNA, 814 bp, Homo sapiens
  misc_feature: GYAE6OF02IKB2J.4.60.F05.1.454.CMB.1.raw
  modified_base (238)..(238): a, c, t, g, unknown or other
  misc_feature (238)..(238): n is a, c, g, or t
tcagagcactgtagcacgaccggtgctcgatttagtacgtcatcagggaaagggggcgtctgagagaggagcccagccctgggagttttctaggtgtttttctatttggtgatcaggactgaacagagagaactcaccatggagtttggctgagctggtctttttcttgtggcttattttaaaggtgtccagtgtgaggtgcagctgcgtggagtcgtgggggaggtcgttggtaacnggccgttgggggggtcccctggaggacctctcctgtgccagccgtctggtacttcgtacgtttacgcacctaatcgcccttgaggtttcgggtaccgccgacggtccgtaccgaaggggacgggtcgtggggtacggtggggtccgtcgacggggacagttacgaaggtggggttaacggtaggtaaaacgttaggttaaacgtttttaacggaacgtaacggtaaccgtaacggtacgtacgtaccgtttcggtacgggttacggacgggggtaccccgttaacgtacccgaacccgtaccgttccttacccggaaacgttacggtaaaccgtaacgtttacccgaacttaaccggtaaacccgtaaaccccgttggttaacttaccggtacgttaaaccgaaacgtttaccgaaaacggtacgtaaacggtacggtaacggaccggttaaccgaaccggggtaccaaccggggttaccgtaaaccgttacgttaacccggtcggtaaccgtaaccgggtaaacgggtacggtaaccggggttaccggggtaacgttaccccgtagggttttacg

SEQ ID NO: 97962 - DNA, 751 bp, Homo sapiens
  misc_feature: GYAE6OF02JXYMS.4.60.F05.1.454.CMB.1.raw
  modified_base (213)..(213): a, c, t, g, unknown or other
  misc_feature (213)..(213): n is a, c, g, or t
  modified_base (635)..(635): a, c, t, g, unknown or other
  misc_feature (635)..(635): n is a, c, g, or t
tcagagcactgtagcacgaccggtgctcgatttagtacgtcatcagggaaagggggctctgagagaggagcccagccctgggattttcaggtgttttctatttggtgatcaggactgaacagagagaactcaccatggagtttgggctgagcgtggtctttttcttgtggtcttaatttaaaggtgtccagtgtgaggtgcagctgctagggngtcggtgggggaggcgttggtacgacggtccggtcggggggtccctggacgtacctccgttccgtgtcgcacgtccctagtcggtaacttccgtacgtttacgacctaccaagtccgtccgtggtacggttcgggtccgccgtacggcctaccggaggggtaagggcgtagggtacgggtcgggaccgtcggaggctacgtgacggttagggtaggtaaggtaaattacggtttaaagtttaaaacggacgtaacgtaaccgttaaccgacgtaacggtaccgtttacgttacgggtacgggaaccggggtacccggtaaccgttacccgaaccccgtacgtaccgttacccgaaggtaaccgtaaccgtaacttacccgaacgtaccgaaaccctaccgtacgtacttactagtaacctanaacgaactacgacttacggaacgtacgaccgaacgaccgtaacgtaccgtactaaccgtacgacgacgtaacgtaacggtaacggtaaggtacggggaacctaccgtagtttacgg

SEQ ID NO: 97963 - DNA, 803 bp, Homo sapiens
  misc_feature: GYAE6OF02FSFYY.4.60.F05.1.454.CMB.1.raw
  modified_base (234)..(234): a, c, t, g, unknown or other
  misc_feature (234)..(234): n is a, c, g, or t
tcagagcactgtagcacgaccggtgctcgatttagtacgtcatcagggaaagggggctctgagagaggagccccagccctgggattttcaggtgttttcatttggtgatcaggactgaacagagagaactcaccatggagtttgggctgagcgtggtcgttttctgtggtcttaattttaaaaggtgtccagtgtgaggtgcagctgctggagtcgtgggggagtcttggtacnggccgtcgggggtccctgacgctctccgtgtcgcacgtcctcgtcggtattccgtaacggtttagcctaacctaagtccgtcccgtggtacggtttccggggtccccgtaccggtacgggtacccgtaccgggaacgggggtaacgggggtccgttaggggtaacgggtcggggttccggacgtaacgggccgtaagttccgtaggttagggtaacggttaagggtaaagttagttaaagttttaaacggacgtaacgtaaccgtacgaccgtaacggtaccgttcgtaggtcgggaaccggggtaccctaccgtacctacccgtaccgtacccgtaccgtaacggaacgtaaccttaacgtttacccgaaagttaacccgtaaaccccgtacccttacggtttaaccgttaccgttaccggtaacgttaaaaccgtacggtaaaccgtaaccgtaacggtaacggtaacggaaccgggtaccgaacggtaccgaccggtaccgtaacgtaaccgtacgtacgaacgaacgaacgtaggtaacgggtaccgggtactacgtagttaccg

SEQ ID NO: 97964 - DNA, 703 bp, Homo sapiens
  misc_feature: GYAE6OF02FKRPW.4.60.F05.1.454.CMB.1.raw
  modified_base (357)..(357): a, c, t, g, unknown or other
  misc_feature (357)..(357): n is a, c, g, or t
tcagagcactgtagcacgaccggtgctcgatttagtacgtcatcagggaaagggggctctgagagaggagcccagccctgggattttcaggtgtttttcatttggtgatcaggactgaacagagagaactcaccatggagtttgggctgagctggctttttcttgtggctattttaaaaggtgtccagtgtgaggtgcagctgctggagtcgtgggggaggcgttggtacagccgtgggggggtcccctggacgactctccgtgtcgcacgcctctggtattcctacgttttagccaccaatcgcccctggtacggttcggggtcccgccgaggtccgtaccgaaggggaacggggngtcgggaggtcgggtcgcgaggcatcgaggtggtagtggaaatgtaatttaagacacgactacgacagtactcgtaggtcgggagggacccgtacgtaccacctctccttaccgaaggtacgaaacctaactttccgaacgttaccgaaaccctacccgttagtacttcgtacgtaaccgtaaacgtaacgtaaacgacgtaacgttacggaacggaacggaccggtaacggacccgaaccgggtacccggttaaagttaaccgttaaccgacggtaaccggaaccggtaaacggtaacggttaacgggggaccgggggttaaccctaccgggttactttaacggg

SEQ ID NO: 97965 - DNA, 751 bp, Homo sapiens
  misc_feature: GYAE6OF02HAROA.4.60.F05.1.454.CMB.1.raw
  modified_base (304)..(304): a, c, t, g, unknown or other
  misc_feature (304)..(304): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttctagtggctaattttaaaaggtgtcagtgtgaggtgcagctgctggagtcgtggggggagtcttggtacaggccgtggggggtccctgacgactctcctgtgcagcctctggattctacgtttagcaccaatcgtccctagngttcggtccgcaggctcgagggagggcgtgggagtgggtcgacgaggcacgtcgagtgggtagtagggaagttacgttaagttttaacgacgtaaagtacgttaaccgcgtaacggtacgtttccgtggggtacggggtaaccgggggtacccgtaaccgtccccggaaaccctacgttacccctccggaaacggtaaccgaaccgttaaaccgttccctaagttaccgaaaaccccgtaccccgttacggtaaccttacgttcgaaccgttaaaacgttacggaaaccctaacgggtacttaacgggaaggaaccggtacccgggaaacggacccggaccggtaacccggtaacgtttaccgtaaccggtcgggtaaccggaacggtaaaacggttaccggtaagggggtaaccgggggtaaccgtaacccgtaggtttaaccggg

SEQ ID NO: 97966 - DNA, 747 bp, Homo sapiens
  misc_feature: GYAE6OF02JBN9O.4.60.F05.1.454.CMB.1.raw
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtgtcgtttctaggtggctaattttaaaggtgtccagtgtgaggtgcgagctgctggagtcgtgggggagcttggtacngccgtgggggtccctgacgactctccgtgtncngcctgtggacttcacgtttagcaccgaatcgcctgagttcgggtccgccgacggtcctccggagggaacgggtcgtgggaggtggtcgacgaggccagtcgaggttggtaaggttaggaaagttggtaaagttttaacggaacaacgtaaccgttaacgaccgtaacggtaaccgttcgttaggtacgggacggggtacccgtaaacgttacccgaaccgaccttaccgttaacccgaacggtaaccgtaaaccttaaacggtttacctaacgttaaccggaaacccttaaccccgttaacgttaccgttacgttaacggaacccttaaaaggtaccgtaaacgaccgtaacgttaaggaacggtaacggaccggtaacggtaccgaaccgggtaaccgttaacgttaacccgtaacgttacggaccggtaaacggtaaacgtaaggtaaccgggttacggggaacctaacggtacgtttacgg

SEQ ID NO: 97967 - DNA, 617 bp, Homo sapiens
  misc_feature: GYAE6OF02HHYVW.4.60.F05.1.454.CMB.1.raw
  modified_base (262)..(262): a, c, t, g, unknown or other
  misc_feature (262)..(262): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttctgtggctattttaaaaggtgtccagtgtgaggtgcagctgctggagtcgtgggggagcttgggtacagtccgtgggggtccctgagactctccgtgtgcngcctctggtattcacgtttacgcacaatcgccctagtcgttgggccgccgaggcctaccggaggggaacggggtcgtgggaggtcgggtcgcgtaggcatcgaggtggtagtagtaatgtaatttaagactaagtactacgacgagtactcgtggtcggacggggtccgtaacgtacctaccacgtcctaccgaagacgtaactaacttaccaagtaccgtaacctacccttagtacttctacgaactaaacgtacgaacgacgtacgtacggacgacgaccggacggaccgacggtaccgtactactacgtcgacgtaacgaagtacgtaggtaccgggtactacgtagttcgg

SEQ ID NO: 97968 - DNA, 578 bp, Homo sapiens
  misc_feature: GYAE6OF02I5M4X.4.60.F05.1.454.CMB.1.raw
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(193): a, c, t, g, unknown or other
  misc_feature (192)..(193): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (374)..(374): a, c, t, g, unknown or other
  misc_feature (374)..(374): n is a, c, g, or t
tcagagcactgtagcacgaccggtgctcgatttagtacgtcatcagggaaagggggctctgagagaggagcccagccctgggattttcaggttgttttcattttggtgatcaggactgaacagagagaactcaccatggagtttgggctgagcggtgtgttctaggtcgctaatttaaggntcagtgngngnnagctgctggcgtgngggagctggactgccgtggggtcctgagctcgcctgngcncgctntgtatctacgttacgacactatcgtccgtgtggtcggccgcgngcgacggaggaggngtggngnggtgcgngcgtatgngtgagtagaagtagtagtaagagacgactacgacgacgtacgngtggacggcggtccgtacgtacacctacgtacctacgaactaacgtaactaaccgttaacgtactaccgtaaccgtaacgtacgtacgttacagtaagaacgtaacgtaagtagtacgtagagacgacgaacgacgaacgtaccgtaactacgtacgcgtacgaaggaagtaacggtaagggtacgggtacgtacgtaggtacg

SEQ ID NO: 97969 - DNA, 717 bp, Homo sapiens
  misc_feature: GYAE6OF02GEMD7.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggctattttaaaggtgtccagtgtgaggtgcagctgctggagtcgtgggggaggcttggtacaggcccggtggggggtcccctgacgtactctcctggtcgcagcctctggattcgacgtttagccaccaatcgccccgtgaggttcgggtcccgccgaggccgtaccggaggggaacggggcgtagggaggtggggtccgaccgtagggctagtcgacggttagggtaggtagggaaaattggtaaagttttaaggaactaagtaactacgacagtactcgtggtaggtacggggaccgacgtccacctacgtcctaccgagaacgaacctaacgttaccaacgtaccgaaactaccccgttacgttactaccgtacgaactaaagtaacggtaacgaacgaacgtacgaacggtaacggaccggaacgggaccgaaccgggtaccggtaacgttaacccgttaaccgtaccgggtaaccggaaccggaaacggtaacgggttaaacggggttacggggggtaacccgttaacccggtacgttttacggg

SEQ ID NO: 97970 - DNA, 888 bp, Homo sapiens
  misc_feature: GYAE6OF02HHOPE.4.60.F05.1.454.CMB.1.raw
tcagagcactgtagcacgaccggtgctcgatttagtacgtcatcagggaaaggggctctgagagaggagcccagccctgggattttcaggtgttttcatttggtgatcaggactgaacagagagaactcacatggagtttggctgagctggtctttttcgtgtggcttaagttttaaaggtgtccagtgtgagtcgcagcgtgcgtggagtcgtgggggagtcgttaggtacgacgccggttcgggggtccctgacgtacttccgtcgtgtgacgacgtccgtacgttggacttaccgtaacggttttagaccctaaccgtaaatccgtaccccgttaggtacggtttacgggggtacccgtaccccggttaacggcccgttaacccggtaagggggtaaaccggggggttccgttacgggggtaaacgggtttcggggtcccggtaacggaacgggggtaacctaacggttaccggtaaggttacggggttaaccgggtttaaggtaaaaggtttcggttaaaacgtttttaaacggaaacgttaaccggtaaccgtaaaccggtacggtaacgtacccgttacgtaggttaggaaccgggggtacctaacccgttacccgaacccgtacgttacccgtaccgtaacggtaaccgtaaccgtaacgttacccgaacgtaccgtaaacctacccgttaggtaaccgtcgttaacgtaaccgtaaaacgtacggtaaaccgtacggtaaccgttaggaaaccggaaccgtcccggttaaaccggggaccgttaacccgggaaccgttaacgtacccgttaacgttacggacccgaacggttaaacgtacggtaacgggttacgggtaacccggttacgacggtttaccg

SEQ ID NO: 97971 - DNA, 900 bp, Homo sapiens
  misc_feature: GYAE6OF02FXWEX.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtctttttcttgtggtctattttaaaaggtgtccagtgtgaggtgcagctgctggagtcgtgggggagcgttggtacagtccggtggggggtccctgacgactctccgtgtgcacgtcctcgtggacttctacgtttagcctacctaagtcggcccttggtacggttcggggtcccgccgacggtccgtacccggaagggggaacggggtccgtggggtacgggttcgggggtccgacggacgggtacctacgtacgtaagggtacggggttaaggtaaggggtaaattcgggtttaaattttaaacggaaaccgtaacggtaaccgttaaaccggaccggtaacgttaaccgtacggttacgggtaccgggtaccggggggtaccctaacccggttaccccgaacccgttaaccgtccccggttaaccgaacgggtaaccgtaaacccgttaaaccgtttacccgtaaccgtttaaccggtaaaccccgtaaccccgtttacggttaaccttacccgggtaaccgtaaaccttaaaacgttaccgggtaaaccgtaacggttaaaccggttaacgggaaaccggtaaccgggacccgggggtaaaccggtacccgggaacccgggtaacccgtttaaacgtaacccggttaaacccggtcggaacccggtaacgggaaaacgggttaacgggttaaccgggggtaaccgggggtttaaccccgtaaccggttacggttttaccgg

SEQ ID NO: 97972 - DNA, 609 bp, Homo sapiens
  misc_feature: GYAE6OF02F44IF.4.60.F05.1.454.CMB.1.raw
  modified_base (484)..(484): a, c, t, g, unknown or other
  misc_feature (484)..(484): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacaggccgtggggggtccctgagactctccgtgtgcagcctctggacttcacgtttagcaccaatcgccctgtaggttgggtcccgccacggcctaccgaggggaaggggctgggaggtcggggtcgcgaggcatcgagtggtagtaggaaatgtaatttaacgacagtacgtacgcagactcgtaggtcggaggggcccgtacgtccaaccgtactccgtaccgagaacgtacctaacttaccatacgaacctaccctntacgtactagacaacgtacgaacagtacgtagacgacggaccgaaggaccgacggtaccgtaacgtaaccgtacgtacgaccggaagtaacggaggtaacgggtcggggaacttaccgagttacg

SEQ ID NO: 97973 - DNA, 720 bp, Homo sapiens
  misc_feature: GYAE6OF02HGOXK.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttctaggtggctattttaaaaggtgtccagtgtgaggtgcagctgctggagtcgtgggggaggcttgggtacagccgtgggggtccctgagactctcctgtgcagcctcgtaggacttcgtacgtttagcctaccaagtcgtccccgtggtacggtttcggggtaccctaaccgacgggccttacccggaaggggggtaaacggggccgttaggggtacgggttcgggggttccgaccggtaagggaccgtacgttacggtaaggttggggttaacggttaagggtaaaacgttaggtttaaagtttttaaaacggaaccgttaaggtaaccgttaacgaccgtaaggtaaccctttggttagggttacgggaaacggggtcccgtaaccgtaccctaacgtacgtacctacgaagtacgaactaacttaccatacgaaccactagtctcagactaatacgaacagtactgaacgacgacgacggaccgacggtaccgtaataccgtagtaccgacgaacgtaacgacggtagggtacggggtaactaccgtagttacgg

SEQ ID NO: 97974 - DNA, 1014 bp, Homo sapiens
  misc_feature: GYAE6OF02F35PQ.4.60.F05.1.454.CMB.1.raw
  modified_base (201)..(201): a, c, t, g, unknown or other
  misc_feature (201)..(201): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggtagtttgggctgagctggtctttttctgtggtcttaagttttaaaggtgtccagtgtgaggtgnagctgcgtggacgtcggtgggggagtcgttaggtacacggtccggtcgggggttccctaggacgtaccgttccgttccgtaggtcggaccgtacggtcccttcgtgggtactttaccgtaacggtttttacgacctaacccgtaattccggtcccccgttaggtacgggtttaccggggtaccccgacccggtagggtcccgtacccggaagggggaacgggggtaccgtagggggtacgggttcggggtaccgtacggacgggtaccgtaacgtccggtaagggttagggttaacgggtaagggtaaaacgttagggttaaacgttttaaaacggaccgtaaaggtaacccgttaccggacggtaacgtacccgtttcggttagggtaacggggtaccgggggtaacccgtaccgttaccccgtaacccgtaccgttacccgtaacccgtaaaggtaaaccgtaaaccgttaaaccgttacccgtaaacgtaacccgttaaaacccgtaaccccgttttacggtaaaccgtttaccgtaaggtaaacccgtaaaacggttaacccggaaaaccgttaacgggtaaacccgttaaggaaacgggtaaccccggggtaaacccgggtaacggggttaaacccccgtaacccggggttaaaccccgttttaaacccggtaaacccggttttacccggtaaacccggggtaaacccgggtaaaaccggtaaaaaaccggggttacgggtttaaaacccggggggggtaaacgggggttaaacccccctttaaaccgggttagtttttaacccgggg

SEQ ID NO: 97975 - DNA, 796 bp, Homo sapiens
  misc_feature: GYAE6OF02J1MX0.4.60.F05.1.454.CMB.1.raw
  modified_base (197)..(197): a, c, t, g, unknown or other
  misc_feature (197)..(197): n is a, c, g, or t
tcagagcactgtagcacgaccggtgctcgatttagtacgtcatcagggaaagggggctctgagagaggagcccagccctgggattttcaggtgttttcatttggtgactcaggactgaacagagagaactcacatggagttgggctgagctggtctttttctgtggcttattttaaaggtgtccagtgtgaggtgcngctgctggagtcgtgggggagcgttaggtacgaggccggtggggggtccctgacgtacctcctccgtgtgcacgtcctcgtaggtacttccgtaggtttacgccaaccgaacgttcgtccccgttggtacggtttccgggggtaccccgccgtaacgggtcccgtacccggtaacggggggaacggggtccgtaggggtaacgggttcgggggtaccgaccggacggtcgaacgttcgtacgggttagggttaaggtacgggtaagttaccggtaaagttttaaacggacgtaagtaacccgtaacggtacgacggtacctgtagggtcgggtacggggtacccgtaaccgtccgaacccgttactcccgttaaccgaaccggtaaacgtaacccgtaaacgtttacccgaacgttaccggtaaccctaaccgttacgttaaccttacgtacgtaaccgtaaactaacggaaacgtaacgacggtacgaacgaaccgggtaccgaaccggacgtaccggtacccgtaaacgttaccgtacgtaccggaccgaagtaacggtacgggtaacgggtacgggtaaccttacgtacgttacgg

SEQ ID NO: 97976 - DNA, 652 bp, Homo sapiens
  misc_feature: GYAE6OF02HDGS1.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctggagtcgtgggggagcgttggtacacgccgtggggggtccctagagactctccgtggtcgcagcctctggacttcgacgtttagcaccaatgcctgtagtcggtccgcagctccgagggaacgggtctgggagtcgggcgacgaggcacgtctaggtcggtagtacggaaagttgtaagttttaaggacaagtacgtaccgacaggactcgttagtacggacggggaccgtacgtaccgaacctacgtacctaccgtaagaacgtaactaacgttccaagtacggaacctacccgttacgtacttcgtacgaactaaattacgaaaccgtagtacgtaacgtaggaacgccgaacggacgaaccggtaccgtaacgtaaccgtacgttaacgaccgtaacggtaacgtaacggtacgggtaacggggtacccttaacgagtttaaccgg

SEQ ID NO: 97977 - DNA, 752 bp, Homo sapiens
  misc_feature: GYAE6OF02G9HZF.4.60.F05.1.454.CMB.1.raw
  modified_base (707)..(707): a, c, t, g, unknown or other
  misc_feature (707)..(707): n is a, c, g, or t
tcagagcactgtagcacgaccggtgctcgatttagtacgtcatcagggaaaggggctctgagagaggagcccagccctgggattttcaggtgttttcatttggtgatcgaggactgaacagagagaactcaccatggagtttgggctgagctggtctttttcttgtgtcttatttaaaaggtgtccagtgtgaggtgcgagctgctgggagtcggtgggggagtcgttggtaccgacggtccggtgggggtcccctggacgtacgttcctccgtgtcgcgtagtcccgttcgtggacttcgtacggtttagaccaccgtaagttccgaccgttaggtaggttcgggtcccgaccgacggtcccgtaccgggaacggggaacggggtcgtaggggtaggttcggggtcggacggtaacggcctaagtccgtaggttcgggttaaggtaggtaaagtagtttaacgttttaaacgaacgtacgtaacgtaccggacgtaacgtactcgttacgggtacggacggggtaccccgtaacgtacccgtaccgtacgttccctaacccgaggaacccgtaactaaccgttacccgtaagtacggtaaaccctaccgttacttacgtacccgtagtaccctaaagttaacgaacctacgtaacgtaggaacgtacggaacgtaccggacgtacccggtagtaccacgttaccgngtaaccggtagaacgttggaagggtacggaacttaccgagttcgg

SEQ ID NO: 97978 - DNA, 572 bp, Homo sapiens
  misc_feature: GYAE6OF02I8971.4.60.F05.1.454.CMB.1.raw
  modified_base (144)..(144): a, c, t, g, unknown or other
  misc_feature (144)..(144): n is a, c, g, or t
  modified_base (160)..(160): a, c, t, g, unknown or other
  misc_feature (160)..(160): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (186)..(187): a, c, t, g, unknown or other
  misc_feature (186)..(187): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
tcagagcactgtagcacgaccggtgctcgatttagtacgtcatcagggaaagggggcctctgagagaggagcccagccctgggattttcaggtgtttcattggtgatcaggactgaacagagagaactcaccatggagttggcngagcggctgtctaggngctattaagncgangtgactgnatgnngtgagctggaggtctgtngngnggcacngctgcagtgcacgntcgtgtagtacgtctacgtnacattcggctgagtcgtcgcgtcgtctacggtggaggacgtggacgtggacncgacgacntacgngttacgnggtagtagtagtagtagtacgagtacgtagtacgtacgtacgtcgtagtacggtaggacgtacgtacgtactactacgtacgtacgtacgtacgtacgtacgtacgtacgtacgtactcgtacgtcgtacttacgtacgtacgtaacgtacgtacgtacgtacggtacgtaacggtacgacgaccggacggacgtaacgtacggtaacgacgacggtacggtacgtacggtacggtacgtacgtacgtacg

SEQ ID NO: 97979 - DNA, 739 bp, Homo sapiens
  misc_feature: GYAE6OF02IIX1F.4.60.F05.1.454.CMB.1.raw
  modified_base (292)..(292): a, c, t, g, unknown or other
  misc_feature (292)..(292): n is a, c, g, or t
  modified_base (505)..(505): a, c, t, g, unknown or other
  misc_feature (505)..(505): n is a, c, g, or t
  modified_base (551)..(551): a, c, t, g, unknown or other
  misc_feature (551)..(551): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcttggtcttttttcttgtggtcttaattttaaaaggtgtccagtgtgtaggtgcgagctgcgtggtaggtcgtgggggacggtcttagggtacacggtccggttcggggggttcccttggacgtacctccgtccgttggtcncgacgccgttcgtggttacgttaccgttacgtttacgaccgtaccgaacttccggtcccgttggttacggtttcggggtccgtcccgacggtcgtacccgaggggtacggggacgtgggtacggtcggggtcgcgaggctacgtcgacggtaggtaggtaacggtaagtggttaagtttaacgacgtagtaacgtacgacagtacgtcgtggnggacggggtccaacgtcgaccgtatacccgtacgtaggaaccgtanaaccttccgactaccgaccctaccgtacgttacgttactacgaacttaagtacgaacgagtacgttaagaacggtacggaaccgacgggaccgtaaccgggtacgtaaccgtaacgttaacccgtggtaacccgaaaggtaacgtaacgggttaacgggggtacgggtaaccggtacgtacgttacgg

SEQ ID NO: 97980 - DNA, 777 bp, Homo sapiens
  misc_feature: GYAE6OF02G0M83.4.60.F05.1.454.CMB.1.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
tcagagcactgtagcacgaccggtgctcgatttagtacgtcatcagggaaagggggctctgagagaggagtccagccctgggattttcaggtgtcttcatttggtgatcaggactgaacagagagaactcaccatggagtttgggctgaactggtatttttcttgtggcttattttaaaagctgtccagtgtgaggtgcagctgttggagtcgtgggggagcgttggtccgagggtcgggggggtccctggacgtctcctcctgttctcgtcctgtggattctacctttatntaatttcgacctntgacggtcgtcggggtcccgaccgacgacctacccggaacggggtaacggggtcgtaggggaggttacgggtcgtacgtaacggttcgtttaacggtcggtacggttaggtcgggggttcgtaccgtaacgtaactacgttaacctaaccggtacgaacggtaaccgttcccgggtaagggaacccggggtccggttacccaccgtacctccgtaaccgaacggaacgtaaacctaacttaaccgaaaaccgtaaccctaaccgttacgtaacttaaccgtacgaaactaaacgtacgaaaccacgtaccgacggtaacggaccggtaaccggaacgggaccgtaaccgggtcgttaaacttacgttaacgttacgtaagtaaccgttaaaggttagttttaaggaacgttccgtaggttaccgttaccgtttacgtttaccgttttaccggaccggttcgtaacccggggg

SEQ ID NO: 97981 - DNA, 711 bp, Homo sapiens
  misc_feature: GYAE6OF02HX4Y1.4.60.F05.1.454.CMB.1.raw
  modified_base (250)..(250): a, c, t, g, unknown or other
  misc_feature (250)..(250): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgcttggagtcgtgggggagcgttggtacaggccggtgggggtcccngagtactctcctgtgcatcctctggtatctacgttacgcaacctaagtcgccgtagtaggttcgggtcccgaccgtaggaccttccggaacggggaacggggtcgtagggagggttacggggtcgacgaacggccgtaacgtccgtaaggtggttaacggaggtaaagtgtaagttaagaacagtactacgacaggtactcgtaggtacggacgggtacgccgtaaccaccgtataccgttacgaacgaacgaactaaaccttacgaacttacgaaacctaccctagtacctattaccgaacgtaaacgtactaaaaccgtacgaacgttacggaaagaaccgggacggaccggaaccggtaacccggtccgtaaacggtaccttaaccggtaccgaaccggtaaccgtaaaacggtaaggtaaacggggtacggggtaaaccctaccggtaagttaccgg

SEQ ID NO: 97982 - DNA, 826 bp, Homo sapiens
  misc_feature: GYAE6OF02IOX0R.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggtcttaagttttaaaaggtgtaccagttgtgaggtgcagctgcgtggagtcgtgggggagtcgttggtacacggtccggtcgggggggttaccctggacgtaccgttccgttccgtgtcgcacgtcccgtacgtaggtacttaccgttaacggtttacgaccgtaaccgtaaacgttccggtacccccgttagggttaccgggtttccggggtaccccggtaccccggtaacggggtcccggttaacccggggaacggggggggtaacgggggtacgggtacgggggtaacgggttccggggggttcccggtaaccgggaacggggtaccgtaacggttaccggtaacgggtttaggggtaaagggtttaacgggtaaaaggtttacggtttaaagttttaaacggaacgtaacggtaactacggacgtacgtacgttacgtaggtacgggacgggtacccgtacgtacccgaccgtactacgtaccgaacgtaacgaacttaaattccgaacgtaaccgaacctacccgttagtacgttcgtacgaacttaacacgtaacagtacgtaggacgacgacgaacggacgaccgacgtaacgtaccgtacgtaacgaccgtaagaacgtaggaacgggtacgggtaacgtacgtagttacg

SEQ ID NO: 97983 - DNA, 788 bp, Homo sapiens
  misc_feature: GYAE6OF02JCX02.4.60.F05.1.454.CMB.1.raw
  modified_base (199)..(199): a, c, t, g, unknown or other
  misc_feature (199)..(199): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcttttcttggtcggctattttaaaaggtgtccagtgtgaggtncgtagcgtgtcgtggtaggtcgtgggggtagggtcgtttcggttaaccgaggccgttcggggggttccccggttcgtagtaccgtccgtcccgttcgtggtccgacgccgttcccgttaggtaccgtttcgtaaccgtttacgtacgaccctaagtccgtccgtcgtaggtttcgggtccgcccgtaggccgtacccggtaacgggacgggggtacgtggggacgggtaggggttccggaccgacggcggtacgtccgtaagggttgggtacggtacgggtaaaagtgttaagtttaaacgtacgaacgtaacttaccggaaccgttagaaccgtacgttcggtacggtaccgggaccgggtacgttaccggaccgtacctaccgtacgtacggtaaggtaccgtaaagttcccttaagtaccgttaaccaccgttaaccgtacgtacgttcgtaacgtaacgtaacgaacgtacgtaacgtagacggagtaccgggtaacggaccgtaaccggtacccgtaaacggttacctaccgtcggtaacgtacgaacggtaagtacggtaaggggtaccgtacgtaggttacg

SEQ ID NO: 97984 - DNA, 833 bp, Homo sapiens
  misc_feature: GYAE6OF02IN0EL.4.60.F05.1.454.CMB.1.raw
  modified_base (222)..(222): a, c, t, g, unknown or other
  misc_feature (222)..(222): n is a, c, g, or t
tcagagcactgtagcacgaccggtgctcgatttagtacgtcatcaggggaaagggggctctgagagaggagcccagccctgggattttcaggtgttttcatttggtgatcaggactgaacagagagaactcaccatggagtttggctgagctggtcttttcttgtcggtacttaagttttaaaaggtgtccagttgtgtaggtgcagctgctggacgtcggngggggtagtcttggtacacggtccggtcgggggtccctggacgtaccgttcctccgttgtgtaccgacgtccgtcgtagggtacttccgtaaccggttttacgacctaaccgtaacgttccggtaccccgttgggttaacgggtttccggggggtaccccgttacccgggtaacgggtaccccggttaccggggaaacggggggtaaccggggggtacccgggtacggggtagggggtttaccgggggggttccgaccggttaacgggggactaacgtccggtaggtttacgggggtaaggttaaacggtaaaggttagtttaaggttttaaaacggaacgttaacggtaaccgtaaacgaccgtaacgtaaccgtttcgtagggtacgggacccggggaaccctacccgtaccaccgtacgttccaccgagaaacgtaccaacgttaccagtaaccctaaaccgacccttgtacctactacgaataacgagaactacgaacgtacgtacgaacgaccggaacggtacccgaacggtacgttaacctaacgtaccgtacgaacggtaacgaacggttaaggtccgggaacgggtacctacggtattccggg

SEQ ID NO: 97985 - DNA, 755 bp, Homo sapiens
  misc_feature: GYAE6OF02HDSS4.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcgtggtcgttttctagtggcttaattttaaaggtgtccagtgtagaggtgcgagctgctggagtcgtgggggagtcgttggtacgaggtccggtgggggtccctaggacgcttcgtccgtgtcgctagcctcgtggtacttcgacgtttagaccaaccgtaagtccgtccgttagtacggttcgggtccgccgacggtccgtaccggaagggggtaacggggtccgtagggtaggtcgggtcggcgtaacgggctacgtacggtaggttgggtaagtagggaaatttaggttaaagtttaacgaagtaacgtactacggtctaaagtccttcggtagtacggggaaccgggtcctaaccggtaccctaaacccgtcgttacccgtaccgaaacggtaaccgtaccgtaaacttacccgtaacttaacggtaaccccgtacgttaagtacgttcccgagtaaaccaagttaacgaaacgtacgtaacgtaggaaaccgtacgaccgggtaacgaccgtaaccgggtacgtaaccgtaactacggttaccgaacggtaacggtaaaggaccggttaaggggtaccggaacctttagaggttacccgg

SEQ ID NO: 97986 - DNA, 955 bp, Homo sapiens
  misc_feature: GYAE6OF02I60GQ.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggacttattttaaaaggtgtccagtgtgaggtgcagctgcgtggagtcgtgggggaggtcgttggtacacgccgtcggggggtccctggacgtaccgttcctccgtgtcgcacgtcctcgtggtacttacgtaccgttttagacctaaccaacgttcgtccccgttggttacggttcggggtccccggccgacgggtcccgtaccggaacggggggaacggggtcggttacggggtagggttcggggttaccgggcgtaacggggcctaagttccggtagggttacggggtaagggtttaagggtaaaagttacgggtttaaagttttaaaacgggaacgtaacggtaaccgttaaccggtacgtaaacggtaccgtttaccgttagggtacggggtaaccgggggtacccggtaaccgttacccgtaacccgttaaccgttaccgtaacccggtaacggtaaaccgtaaccgttaaaccgttaacccgtaaacgttaacccggtaaacccgttaaccccgttacggtttaaccgttaccgttaaccggtaaaccgtaaacgttaaacggtaaaaccgaacggttaaccgttaacgggtaaacggtaaccgggaacccgggtaaaccgggaacccggtaaacccggggttaacccgttaaacggttaaccccgttaaaccggttaaccggtaaacccgggtaaccgggtaaaaccgggttaaacgggtttaaaccgggggttaaccgggggggttaaaccctttaacccggttaacgttttaaaccggg

SEQ ID NO: 97987 - DNA, 778 bp, Homo sapiens
  misc_feature: GYAE6OF02F039A.4.60.F05.1.454.CMB.1.raw
  modified_base (282)..(282): a, c, t, g, unknown or other
  misc_feature (282)..(282): n is a, c, g, or t
tcagagcactgtagcacgaccggtgctcgatttagtacgtcatcagggaaagggggctctgagagaggagcccagcccctgggattttcaggtgttttcatttggtgatcaggactgaacaggagagaactcaccatggagtttgggctgagctggtctttttcttgtggctaattttaaaaggtgtccagtgtgaggtgcagctgctggagtcgtgggggagcttggtacaggccgtcgggggggtccctggagacttccttccgtgtgcacgcctctggnttccaacgttttacgccaaccaagtcgcccgtgacggtttgggtccgccgacggtccaccggtacggggaagggggcgtgggtagggtcggggtccggcgaggtctagtacgaggttgggttaacgggtaggtaaagttaaggttaagtttttaaacgggaacgtaaacgaacgttaacccggagtacggtaaccgtttccgtgggttacgggtacggggggaccccggtaaccgttacccgaacccgtacttacccgtaacccaacgggtaaccgtaaaccttaacccgtttaccgtagtaacccgtaaacctaccccgttagttaacctcggttaccgtaactaaacgtaacaaaccgtaggtaaccgtaaggaccggtaacggaccgggtaacggacccggtaccggtaaccggttaactacgttacgtacggtaaccgaacggtaacggtaaggtaacgggggttaacgggggacccttaccgtagttacgg

SEQ ID NO: 97988 - DNA, 780 bp, Homo sapiens
  misc_feature: GYAE6OF02F5GZ9.4.60.F05.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagttgggctgagcggtcgtgtttcgtaggtcggactaatttaaaggngtcagtgtgagtgngagtctgcgtaggngtggtggggagtcgtgtacgnggtccggtcggggtccngacgtctctcgagtgacgacgtcgtgtacgttacttcgtaacgtaacaccgtaaccgtactccggtaccgttaggtcggtcccgaccggtaccgaccggtaccgccgggaaagggggaccgggttcggtacggggtacgggtcgggtaccggtacggaaccgtaccgtacgttaggtaacggttaggtaacgtaagggtaacgttaggtttaaagttaaccgtaacggtaacgtaaaaccgtaccgaacgtaacgttccgtacgtaagggacgggtaccggggaccctaccgtaccgtaaccgtacccgtaccgaacgtaaccgtaccgtaaccgtaacttaccgacgtaacccgtaaccttaccgttacgtaacctagtaaccggtaacgtaaccgtaagtaaacgtacgtaaacgtacggacggacggaaccgtacgggtacccggaaccgtacgtaaccggttagtacggtaacgtaggtaacggttaaggacgggtaaccgggtaccggtagtacccgtagttccg

SEQ ID NO: 97989 - DNA, 1049 bp, Homo sapiens
  misc_feature: GYAE6OF02JN5JD.4.60.F05.1.454.CMB.1.raw
tcagagcactgtagcacgaccggtgctcgatttagtacgtcatcagggaaagggggcgtctgagagaggagcccagccctgggattttcaggtgttttcagtttggtgatcaggactgaacagagagaactcacatggagttgggctgagctggtcttttctgtgtctagtttaaaaggtgtccgagtgtggaggtcgcagctgcgtaggacgtcgtaggggggtacgtcgttgggtaccacggtccggttcggggggttcccctaggacggtaccttccggttccgtagtaccggccgaacgtcccgttacgtacggggttacttacccgttaaggtttaccggtaccttaaaccgtaacgttaccggtacccccggttagggttaaccgggtttcccggggggttaccccgacggttaacccgggtccgttacccggggtaaagggggtaaacccggggggtccgtaaggggtccggggttaggggtaccggaccggtacggggtattacggttacggtaagggttacgggttaaacgggttaagtaaaccgtttaagggtttaaacggtttaaaacggaaccggttacggaaacccgttaccggaagttaaccgttacccggtggttaacggggtaacggggacccggggtacccctaacggtaaacccccgggtacttaaacccgggttcccgtaaacggtaacgggtaaaaccggtaacccttaaacggtttaccctaaacgggttaccaaaacccggttacccgtttacgtaaccggttaccgtacggtaaaaccgttaaacggtacccggtaaaaggtaaccgtaacccgggttacgggtaaccggtaaacccgggaacccggggtaaccccgggttacccggtaaccccggggtttccgtaaaaccccggttttaaaccggttaaaacgggtccccgggtaaacggtaaaaaccccggtttaaaacgggtaaaccggggtttaaacgggggtaaccccgggggtttaaaacccgaggttttaaaccccgggtttaacgggg

SEQ ID NO: 97990 - DNA, 543 bp, Homo sapiens
  misc_feature: GYAE6OF02GAG49.4.60.F05.1.454.CMB.1.raw
  modified_base (182)..(182): a, c, t, g, unknown or other
  misc_feature (182)..(182): n is a, c, g, or t
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagcggtgtcgtttctaggtggctaatttaaaggngtcagtgtgaggtgcgagctgcgtggagtcgtggggagcttggacaggctgggggtcctagcgacgtctcctgtgacncgtctcgtggacttcacgttacgcaaccagtcgccctgtacggttcggccgcgngccgtacggagggaacggcgtaggaggtcggcncggaggtnacgtcgaaggtggtagtacggatagtagtttagagtagacagcagtacntagaggaggcnacncatcacagactacattcagtacataccctgtctcagacancgtanagcgagtagngtacgnggtacgacggtactaacggtactacgtcgagaccgaagtacgacgggtaggccttaagcgttgg

SEQ ID NO: 97991 - DNA, 672 bp, Homo sapiens
  misc_feature: GYAE6OF02HAV7J.4.60.F05.1.454.CMB.1.raw
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggcttaagttttaaaaggtgtccagtgtgaggtgcagctgctggagtcgtgggggagtcgttggtacaggtccgtgggggtccctgacgtacctctcctgtcgcagcctcgtggattcgtacgtttagcaaccaatcgccctggtgttcggtccgccgacggcctccggaaggggacgggcgtgggtagtcggggtcgcgaggcgatcgaggtcgtaggtaggaaagtagtaagtttaaacgacgtaacgtaactaacgcgtaacgactcgtaggtggaccggggaccgtacgtccgaaccgtactccgtaacgaacgaacgaaccgtaacttaaccgacttaaccggaacctaacccgtataacgtcgtaacgaactaaagtaacgaaacgacgtaacgtagaacgaacggtaccgaacggaccgtacggtaccgtaacgtaccgtacgtacgacgacgtaaacggtacggtaacgggaacggggtaacctacggtagtttacgg

SEQ ID NO: 97992 - DNA, 760 bp, Homo sapiens
  misc_feature: GYAE6OF02G0EEY.4.60.F05.1.454.CMB.1.raw
  modified_base (269)..(269): a, c, t, g, unknown or other
  misc_feature (269)..(269): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggctaattttaaaggtgtccagtgtggaggtgcagctgctggagtcgtgggggagtcttggtacaggccggtggggggtccctaggagtacctcctccgtggngcagtcctcgtggacttacctacggtttacgaccacctaatcgccctggtacggttcgggacccgccgtacgggtccgtaccggtaagggggaacggggtcgtaggggtaacgggttcgggggtccggacgtacggggactacgttccgaggttaggggttaaggtagggtaaagttaggtttaaagttttaaacggaactaaggtaacgtaacggaccgtaacgtaccttcggtggtacgggtaacggggccgtacctaccgaaccctacgtccgtaccgaagaactaaccgtaacttcctaataccgaaccctaccgtagtactaccgacgtaaccgtaagtaacgaaacgtacgtacggtaacggacggacggaccgggaacgtacccggaccgggtaacccgtaacgtaaccgttaccggtaacgtaaccggaaggtaaaaccggtagggtaacggggaacggggttaaccctaccggagtttacgg

SEQ ID NO: 97993 - DNA, 956 bp, Homo sapiens
  misc_feature: GYAE6OF02IT1SM.4.60.F05.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
tcagagcactgtagcacgaccggtgctcgatttagtacgtcatcagggaaagggggctctgagagaggagcccagccctgggattttcaggttgttttcatttggtgatcaggactgaacagagagaactcacagtggtagtttgggctggagtcgtggttaccgttttcttggtacggtactttaaagttttaaaggtgttaccagtgtagnggtcgnagtctgcgtaggtaggtcggttgggggacgttcgttacggtacgacggtccgggttacgggggttccctaggtacgtccgtccttccgtgtacgtccacgtcccgtagttacggtactttaccgttaacgtttaacgaccgtaaccctagttccgtacccgttaggtaccggtttccggggacccgtccggaacggtccccgtacggggtaacggggtacggggtcgtacggggtacgggttaccggggtccggaacggttacggacgttaacgtccggttaaggtttaacggggtcgggtttaaaacgtaaggtttaaacgttttaacgtttaaaaacggtaacggttaacccgtaaccgttaaccgtacgtaacccggttaaccgtttacggttaccggggtaacgggtaaccccgggtaacccgaacccgtttaaaccggacccctaaagttacccgtaaaccggtaaggaaacccctttaaccggtaaaccttaccgtaaaccgtaccgttaaaccccgtaccgttaaagtttccgtaaacggtaccgtaaaccgttaaacaacggtaaaccgtaacgtacggttaacggtacgtaaccccggacgggtacctaaccccgggaacgtttacccgttataaaccccgggttccgaaaacgggtcccggtaaattaaacgggtaacggggttaccgggttaaacggtaaacccgtttacgtaagggtttacccgg

SEQ ID NO: 97994 - DNA, 661 bp, Homo sapiens
  misc_feature: GYAE6OF02HR38F.4.60.F05.1.454.CMB.1.raw
  modified_base (277)..(277): a, c, t, g, unknown or other
  misc_feature (277)..(277): n is a, c, g, or t
tcagagcactgtagcacgaccggtgctcgatttagtacgtcatcagggaaagggggctctgagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctgctggagtcgtgggggagtcttggtacaggtccgtggggggtccctggacgactcctcctgtgcgagtcctntggattctacgtttacgacaccaatcgtcccgtgtaggttcgggtccgccgaggcctccggaggggaacggggcgtgggaggtgggtcgcgaggcatcgaggtggtaggtggaaagtgtaagttttaagacgtagtactacgcagtactcgtgtgggacggggccgtactccgacctacttctaccgagaacgactaacttccgtatacgaacctaccctagttactcgtacgtaacaaaacgtagaaaccgacgtaacgtaggaacggaacgggtacccggaacgggacccgaaccggtacccggtaattacccgtaacggtcggaaccgaacggaaaacgtacgggtaaacgggtacgggggtaaccaccgtagtttaccgg

SEQ ID NO: 97995 - DNA, 728 bp, Homo sapiens
  misc_feature: GYAE6OF02GTNGT.4.60.F05.1.454.CMB.1.raw
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (310)..(310): a, c, t, g, unknown or other
  misc_feature (310)..(310): n is a, c, g, or t
tcagagcactgtagcacgaccggtgctcgatttagtacgtcatcagggaaagggggctctgagagaggagccccagccctgggattttcaggttgttttcatttggtgatcaggactgaacagagagaactcaccatggagtttgggctgagcgtgtcgtttctggtgctagtttaaaggngtcagtgtgnggtncagctgctggagttcgngggggagtcgttacggacaggtccggttggggggtccctggtaacgtacttccgtccgtggtgcacggtcctccgtggtacttaccgtacggtttacncctaaccgtaatccgtcccgttaggtcggtttaccgggcccgaccggtacggccgtaccgggtaagggggacgggtcgttagggaagggtccgggtcgtaacggacggtccaagttgacggttaggtagtaggtaaattagttaaccgtttaaggaccgtaaagaccttaacggactaacggaccttacggtggtacgggacggggaccctacgtaccctactactccgtacaacggtactaacctaacgttaccataaccggaaccgtacctacgttacgtactacgaacgttaacgtaccgaacgtagaagacgtaacggacgtaccgggacgtaccgacgttaccgtaagtacgtacgtacggacgtaaccgtaagtaagggttaccggtaacggggtaacctcgtaaccggttg

SEQ ID NO: 97996 - DNA, 757 bp, Homo sapiens
  misc_feature: GYAE6OF02HRSLC.4.60.F05.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (586)..(586): a, c, t, g, unknown or other
  misc_feature (586)..(586): n is a, c, g, or t
tcagagcactgtagcacgaccggtgctcgattttagtacgtcatcagggaaaggggggctctgagagaggagccccagcccctggggatttttcaggttgttttcatttggtgatcaggactgaacagagagaactcaccatggtagtttgggctgagtcggtcgtgtttctaggtcggcttaagtttaaacggtgtcctagtgtgnggtgtcgagcgtncggtagttcgcgggtaggcgtggtacgacgacggtcgggtcggacgtcgacgtctcgtacttgactacgccgtcgtcgagtccgtatttacggtcaacctaacctagtacctgtacggttaccggtccggttccaacggttccaccggaggaacggggtcgtccgggtaaggttcgggcggtacgtaacggtacgacgtacgtacggtagtccggttaagttacgtagttacgtttaagttaccgaagtacccgtataccgtaacgtactaacgtacgtcgggacggtaccgtaacgacccttacgactacgtcgtaaccgaagtactaactactaaccgttacgaacctaccggtacacgtaacnggttaaccaacgtaaaccgccgtaagtaacgttaacggaccgacgaacccgaacggtaccgaaccggttaccggtaacgtaaacccgtggtaacccgtaaaccggtaccgtaaagggtacggtttaaacgggaacccggtacccggtaaggttaccttacgggtttaaccg

SEQ ID NO: 97997 - DNA, 613 bp, Homo sapiens
  misc_feature: GYAE6OF01AZYJZ.26.73.G07.1.454.CMB.1.raw
  modified_base (352)..(352): a, c, t, g, unknown or other
  misc_feature (352)..(352): n is a, c, g, or t
  modified_base (401)..(401): a, c, t, g, unknown or other
  misc_feature (401)..(401): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggccgtggggcctcagtgacggtttcctgcagggcctcgtgggtacacgatcactaccatgctatcaacgtgggtcgcgacacggccccgtggacaaggcttggaggtggtggatggatacaacaccaacgacgtcgggacacccgacgttacnccgtaccgacggacctcaacgagggaccgtcttcggttccttttccggnggtacctacgttctcgtacacgcgacggctatactcgtgcagtactcgacgctacgtacaacgtcgtagacggactaccgtgtaccgttagttacgtttacgttacggtaacgagtaacgtaacgttagtcgtacgttaggttaggtggggttaggttggttcgttacctttacgtttacggacgttacgggtcgggaccggtagggtcccg

SEQ ID NO: 97998 - DNA, 792 bp, Homo sapiens
  misc_feature: GYAE6OF01EH19K.26.73.G07.1.454.CMB.1.raw
  modified_base (228)..(228): a, c, t, g, unknown or other
  misc_feature (228)..(228): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacgaggtcgcccactcccaggtgcagctggtgcaatcgtgggtctgagtggaagaggcgtggggcctcagtgacggtttccngcgagggcctcgtgggtacacgactcacctaccatgactatctaacgtggtcgcgacgacggccccgtaggacaacggtacgttgaggttgggttagggagtggataccaaccgaaccaacgtacgtcgggacccaacccggtacgttactacctaccgaacggaccctacgacgacgggacggtcctttcggttccgtttttaccggacggtaaccttaaccgtttcgttacggttccgaacgccgtaaccgggtactaacgtttaacgttaccgtgaaccgtaagtaccgtacggtaacgtaccgtaaaggttaccctaaaacggtcccgttaacggaacggtaacctaccggttcgggtaacccggttttaggttaacgttttaacggtttacggtaacggggaaccgttaaaggttaaccgtttagtaccggttaccggtttagggttaacgggtttaggggtttagggtttaacgttaccgggttaccttttaacggttttacgtaaccgggttttaccggggtaccggggtacccgggtaacgggggttaaccccggg

SEQ ID NO: 97999 - DNA, 606 bp, Homo sapiens
  misc_feature: GYAE6OF01BMP1R.26.73.G07.1.454.CMB.1.raw
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
  modified_base (330)..(330): a, c, t, g, unknown or other
  misc_feature (330)..(330): n is a, c, g, or t
  modified_base (597)..(597): a, c, t, g, unknown or other
  misc_feature (597)..(597): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcgagtgacggtttccnggcagggcctctgggtacacgatcactacccatgctatcaactgggtncgacacggcccctggacaaggcttggacgttgggttggatggatacaacaccaacncgtcgggccacccgtagtactcctaccgacggtacctcacgacggacggtcttcgttccgttttcggcggtacctactttcgtcgtcgtacgtccacggtacctagtacttccgtagctagtactcgagtctaacgttactaaccgcgttagacggtaactcgtacggtccgttagttactttagtacgtacggagtaacgtacgttatcgtaccttggtacgttggtcggttgtcgtacttacgttacgtacgtagggcgggtcgngggtaccgg

SEQ ID NO: 98000 - DNA, 732 bp, Homo sapiens
  misc_feature: GYAE6OF01BCQ9I.26.73.G07.1.454.CMB.1.raw
  modified_base (272)..(272): a, c, t, g, unknown or other
  misc_feature (272)..(272): n is a, c, g, or t
tcagagactatactcacgaccggtgctcgatttagctctacgctcaggggacccaacaaccacacccctcctaagaagaagcacctagaccacagctccacaccatggactggacctggaggatcctcttcttggtggcagcagcaacgaggtcgcccactcccaggtgcagcgtggtgcaatcgtgggtctgagtggaaggacggccgtggggcctcgagtggtaccggtttcctgcgacgggcctcgtcggtacacgactccacctaccntcgctatacgacgtgggtcgaccgacgaccggtccccgtaggaacgtaaggtacgttggaggttgggtagggagtaggactacaacaccaacgacgtcggacctacccggtacgtactccgtaccgacggtacctacacggacggtacgttcgtttcggtttccttttccggtacggtacctacgtttcgtcgtaccgacgtcgaccggtctattacgcgtacgacgtagtacgttcgacgtacgtacgtaacgtaacggtcccgtaagggaccgacgttaccgtcggttacccggtttagtttaacgttttacgttacgggtaacggtacgttaaacggttaccgtttagttacggtccggtttaagggttacgggttagggttaggtttacgtttcgtaaccgttttacggtttaaccggaccggtttacggggtccgggggtaccggtaacccgggg

SEQ ID NO: 98001 - DNA, 929 bp, Homo sapiens
  misc_feature: GYAE6OF01DS9QL.26.73.G07.1.454.CMB.1.raw
tcagagactatactcacgaccggtgctcgatttagctctacgctcaggggacccaacaaccacacccctcctaagaagaacgcccctagaccacagctccacaccatggactggacctggaggatcctcttcttggtggcagcagcaacaggtcgcccactcccaggtgcagctggtgcaatcgtggtctgaggtggaagcggccgtggggcctcgagtgtaccggtttcctggcgacgggtccttcggtcgggtaacacgtactccacctacccagtcgacttactacgaacggttggggtacgaccggaacgaccgggcccccgtagggaaacccgtaaagggttaccgtttaggggtaggggtttcgggggtttaggggaactttacggggaaccttaaacccgaaaacccgaacccgtaaaaccgtaccgggttaccggggaacccctaaccccgggtaacgtttaaccgttccgtacccggtaaaccggtacccctaccggaaaccggtaccggggtaacccggtttcgttttaccggtttacccgttttaccgggtaccggtaacctttaccgtttccgttaccggtaccgtaacggtcccggaaccggtacttaacgttaccgtcgttacggacctaaggtacgtacgaacggtaccttaacggttaaccgttaaacggtccgtaacgggtaaaccggtaccgttacgttaccgggttaccgtttaagtttaaacgtttaggttaacggtaacggtaggtaaacgtttaacgttcggtaccgttagggtttaacgggtttcggggttagggtttaacggggtttacgtttaccgggttaaccgtttttaaccggtttaccgggtaaccccgggtttaacgggggtcccggggggtaacccgttacgggggttaacccccggg

SEQ ID NO: 98002 - DNA, 806 bp, Homo sapiens
  misc_feature: GYAE6OF01CUARN.26.73.G07.1.454.CMB.1.raw
  modified_base (153)..(153): a, c, t, g, unknown or other
  misc_feature (153)..(153): n is a, c, g, or t
tcagagactatactcacgaccggtgctcgatttagctctacgctcaggggacccaacaaccacacccctcctaagaagaagcccctagaccacagctccacaccatggactggacctggaggatcctcttctggtggcagcagcaacaggtcnccccactcccgaggtcgcgagcgtggtgaccaagtcgtgggtctggagtagggaagacggccgtcggggcctcgaggtcggtacggtttcctgccggagggtcctggtacgggtacacgtactacaccgtaaccctagtcgtactaagtaccgtaacggttgggtacgaccggaccgaccgggtaccccgtaggaaacggaacggttaccgtttaggggtaacggtttacggggttagggtaagttacgggtaacctaaccgaaaaccgaacccgtaaacggaccgggttccggaacccgtaaacccggtaaccgttacttacccgacccgaaacggtaccctaaccgaacggtaacgggtaccgttcgtttacggtttcccgttttacgggacgtaaccttccttacgtcgaaccgacggtaccgacggtactatactgtacgacgaacgtacacaacggacgtaacgtaaccgtaacgcgttaggaaccgacgtaccgtacgttaccgttagttaacgttaagtacggtaacgacgtaagttacgtacgtacggttccgaaggttcgggttacggttaggttccgttaggttaaccgtttagttacccgggttaactacgggggtacccggaacggggtacggttacccgg

SEQ ID NO: 98003 - DNA, 765 bp, Homo sapiens
  misc_feature: GYAE6OF01B2LIL.26.73.G07.1.454.CMB.1.raw
  modified_base (203)..(203): a, c, t, g, unknown or other
  misc_feature (203)..(203): n is a, c, g, or t
tcagagactatactcacgaccggtgctcgatttagctctacgctcaggggacccaacaaccacacccctcctaagaagaagcccctagaccacagctccacaccatggactggacctggagatcctcttcttggtggcagcagcaacaggtgccccactcccaggtgcagctggtgacaatcgtgggtctggaggtggaaggnggccgtggggcctgagtggtacgtttcctgcgagggcctcgtgggtacacgatcactaccatgctatcaacgtgggtcgcgacacggcccctaggacaaggtcgtggaggttgggtggagtggactacgaacaccaacgacgtacgggccaaccgtacgtactccgtaccgacgtacctacgaacgacgggtacggtctttacggttccgttttaccggaggtaccttacgttccgttacggtacgacgtccggaacggtctaagtttacgtacgtaggaccgtaagggtacctcggaacggttacgtaaccggtttaacgtaaaccggtcccgttaagggaaccggttacctacggttaccggtaccggtttagtttaacgtttacggttacggttaaccggtaaaggtaaccggtttaaacggttacggtccggttaaccggtttgggtttaacgggttcggggtttaaggtttaccgggttaccgtttacccgtttaacggtttacgggtaccggttaaccgggttccggggggtaaccgtaaccgggggtttacccgg

SEQ ID NO: 98004 - DNA, 809 bp, Homo sapiens
  misc_feature: GYAE6OF01A9H0K.26.73.G07.1.454.CMB.1.raw
  modified_base (330)..(330): a, c, t, g, unknown or other
  misc_feature (330)..(330): n is a, c, g, or t
  modified_base (475)..(475): a, c, t, g, unknown or other
  misc_feature (475)..(475): n is a, c, g, or t
tcagagactatactcacgaccggtgctcgatttagctctacgctcgagggacccaacaaccacacccctctaagaagaacgcccctagaccacagcctccaacaccatggactggcctggagatcctcttcgttggtggcagcagccaacgaggtcgcccactcccaggtcgcagcgtggtcgctaacgttcgtgggttactagggtacggtagggaacgcgggtcccggttggggtcctacgtagggttcggttaacccgggttttcctggccggtacgggtcccgttcgtaacggggttacacggtaactttccgaaccttaacccgngttacgtacgtacttacgacggtgggtacgaccgacgaccggtcccaagggactaaggtcttggacggttggttggactaggtacactaaccgactaacgcgttaccggacccaaccggttacgactccgaccgtacggtacccncggaacgcggtacttcgtttacgttccgtttaaccggcgttacttaccgttcgtgaccgtcggactacgtacttagttctacgtacacgtaagttcgacgtacgttagaaccgttaacggacctcggtacgaactccgtacgtacggttacttacgggtttaacttagggttacgtaacgaacgggttaccgttaacggttttaaccggcggtttaccgttaacggggtggttttaccgggtggtttaacgtttaccgggttaccctttaaccgggtttaacggtacccgggtttaccggggtaaggggttccccggcggggttttaaccccgg

SEQ ID NO: 98005 - DNA, 551 bp, Homo sapiens
  misc_feature: GYAE6OF02JM48M.26.73.G07.1.454.CMB.1.raw
  modified_base (373)..(373): a, c, t, g, unknown or other
  misc_feature (373)..(373): n is a, c, g, or t
  modified_base (473)..(473): a, c, t, g, unknown or other
  misc_feature (473)..(473): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatcactacccatgctatcaactggtgcgacaggcccctggacaaggacttgagtggttggatggatcaacacaacacgtgggcacccgacgtatctccaggacctcacgaggacgcttgtctttccgnggactacttctgtcagcacggcagtatctgcagatcagcagtctaaagcctgacggacacgtcgccgtgtacttattgtaacgagtaagtaacgtttagngtccttaggttacggtaggttggttaagttgccgtttacgttttacggacttacggtcggggtaccgagggtacccgg

SEQ ID NO: 98006 - DNA, 548 bp, Homo sapiens
  misc_feature: GYAE6OF02GGH5K.26.73.G07.1.454.CMB.1.raw
  modified_base (379)..(379): a, c, t, g, unknown or other
  misc_feature (379)..(379): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatccactacccatgctatcaactgggtgcgacaggcccctggacaaggcttgagtggttgggatggatcaacaccaacactgggcacccgacgtatcctccaggacctcacgaggacggtcttgtcttttccgnggactacgttctgtcagcacggcatatctgcagatcagcagtactaaagcctagacggacacgtgccgttgttattagttgtaacgagtaagtaacgttatgccgttaggtaggttggttggtagttgtcgttacgtttgaccgttacggtcggggtaccagggtaccg

SEQ ID NO: 98007 - DNA, 523 bp, Homo sapiens
  misc_feature: GYAE6OF02FXA04.26.73.G07.1.454.CMB.1.raw
  modified_base (379)..(379): a, c, t, g, unknown or other
  misc_feature (379)..(379): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatcactacccatgctatcaactgggtgcgacaggcccctggacaaggacttgagtggttgggatggatcaacaccaacactgggccacccgacgtactctccaggacctcacaggacggtcttgtcttttccgngactacttctgtcagcacggcatatctgcagatcagcagtctaaagcctgacggacacgtcgccgtgtattagttgacgagagaacgttatgactgtgtggtggtagttgtcttacgtttgacctagtcggggccagggtaccg

SEQ ID NO: 98008 - DNA, 546 bp, Homo sapiens
  misc_feature: GYAE6OF02GZ9VJ.26.73.G07.1.454.CMB.1.raw
  modified_base (380)..(380): a, c, t, g, unknown or other
  misc_feature (380)..(380): n is a, c, g, or t
  modified_base (480)..(480): a, c, t, g, unknown or other
  misc_feature (480)..(480): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggccgtggggcctcgagtgaccggtttcctgcagggcctctgggtacacgatcactacccatgctatcaactgggtgcgacaggcccctggacaaggacttgagtggtggatggatcaacaccaacacgtgggacacccggacgtatcctccaggacctcacgaggacgcttgtcttttcgnggactcttctgtcagcacggcatatctgacagatcgagacacgtacgtaagtcctagaggacacgtcgccgttagttattagttgtacgagagtaacgtntgtcctggtgtgggttacggtgttcgtcttacgttcgtacgttaggtcgggtaccgagggtaccgg

SEQ ID NO: 98009 - DNA, 693 bp, Homo sapiens
  misc_feature: GYAE6OF02IB4JB.26.73.G07.1.454.CMB.1.raw
  modified_base (504)..(504): a, c, t, g, unknown or other
  misc_feature (504)..(504): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggccgtggggcctcgagtgacggtttcctgcgagggtcctcgtgggtaccacgtatccacctacccattgactactacaacgtgggtgcgacgacggccccgtggacgaaggtacgttggaggttgggttgggagtggtactacaacgtaaccgaacgacgtcgggaccgacccggtacgtacgtcctacccgacggtacctacgaacgacgggaaccggttcgttacggtttcgtttttccggacggtacctactttcgttacgtacgacgtcgtaccggtatacgttactccgtgacctaacgntaccgacgaccgtagtaacctaaacgtccgtaggaacgtaccgacgttcggtacgttagtaatttacgttagtacgaagtaacggtaacgttagtcgtaccgttggttaggttagggttagggttagttacggtactttacggtttacgtaaccggttaccgggtcgggtaccgggtagggtaccccgg

SEQ ID NO: 98010 - DNA, 588 bp, Homo sapiens
  misc_feature: GYAE6OF02HBP3C.26.73.G07.1.454.CMB.1.raw
tcagagactatactcacgaccggtgctcgatttagctctacgctctggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatcactacccatgctatcaactgggtgcgacacggcccctggacaaggacttggaggtggttgggatggatcaacaccaacacgtcgggacacccgacgtactctaccgacggacctcacgaggacggctttcgtcttttccggtgactacttctgtcagcacggcatatctgcagatcagcagtactaaacgccgtagacgacacgtcgccgtagtattagttagtaacggagtaacgtaacgttagtcggtccgttaggttacggttgggttggttaaggtttcgtacgtttacgttttacggtaccgtttacgggtcggggtaccggtacgggtaccggg

SEQ ID NO: 98011 - DNA, 833 bp, Homo sapiens
  misc_feature: GYAE6OF02FWV87.26.73.G07.1.454.CMB.1.raw
  modified_base (211)..(211): a, c, t, g, unknown or other
  misc_feature (211)..(211): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctnagtgacggtttcctgcgagggcctcgtgggtacacgatccactacccatgctatcaacgtgggtgcgacacggcccctggacaaggcttgaggtggtgggatggatacaacaccaacacgtcgggccacccggacgtactcctaccgacgggacctacgacgaacgggtaccggtctttacggttccgtttttaccggacggtaacctaccgtttcgtacggtaccgtacggtaccgaaccgggtactaacgttacgttccgtacggaccgtaacggtaacgtaccgtaacggtacctaacggttacccgtaaaacggtcccgttaacgggaaaccgggtaaccgtacccgttacgggttacccgggttttaacgtttaaacgtttttaacggtttaccggggttaaaccggtaaacgggttaaaccgggttaaaaccggttttacggttaccgggttaaccccggtttaaggggtttaaagggggtttacgggggtttacggggttttaaccgggttttacggtttaacccggttttaaccggttttttaaccggggtaaacccggttttaacccggggtacgggggggttaccccgggtaacgggggttaacccccgggg

SEQ ID NO: 98012 - DNA, 650 bp, Homo sapiens
  misc_feature: GYAE6OF02FHRO0.26.73.G07.1.454.CMB.1.raw
  modified_base (406)..(406): a, c, t, g, unknown or other
  misc_feature (406)..(406): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggagaggccgtggggcctcgagtgaccggttttcctgcgagggccctcgtgggtacacgatccactacccatcgctactcgaacgtgggtcgccgacacggccccctaggacaaggacttggagtggttgggatggatcaacaccaacacgtcgggccacccggtagtactcctccgacggacctcacgaggaccgtcttgttccgttttccgnggtacctacttctgtcagcacggtctatactcgtgctagactcgagacgtagttactaaacgtccgtaggacggtacctacgtcggtacccgttagttaactttagttacgtaaacggaggtaacgttaacgtttagttcggtaccgtttagggttacgggttcgggttacgggttaaggtttacggtacgtttaccgtttacggtaaccgttacgggtccggggtaccggtaggggtacccgg

SEQ ID NO: 98013 - DNA, 668 bp, Homo sapiens
  misc_feature: GYAE6OF02H4D3Z.26.73.G07.1.454.CMB.1.raw
  modified_base (272)..(272): a, c, t, g, unknown or other
  misc_feature (272)..(272): n is a, c, g, or t
  modified_base (400)..(400): a, c, t, g, unknown or other
  misc_feature (400)..(400): n is a, c, g, or t
tcagagactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcgagtgacggtttcctgcagggcctgtgggtacacgatcactaccatgctatcaactgggtncgacaggcccctggacaaggcttgagtggttagggatggatacaacaccaacacgtcgggaccaaccccgacgtactcctaccgacggaccctgaacgagggaccggtcttacgttctttttaccggnggtacctacgtttcgtagttccagtacctacgggctaacgttactcgttgacgacgtattcgaacgtctaaggtacctaaacggtccgtaaggacggtaacctacgtcgtacccgttagttaatttacgttacgtaaccggtaggtaaacgtaacgtttactaggtacccgtttggtaaggttcgggtttaggttaaggtttcgtacctttttaaggtttacggtaaccgtttacggggtccgggggtaccgtaagggggtaccccgg

SEQ ID NO: 98014 - DNA, 256 bp, Homo sapiens
  misc_feature: GYAE6OF01D12DL.24.67.G01.1.454.CMB.1.raw
  modified_base (254)..(256): a, c, t, g, unknown or other
  misc_feature (254)..(256): n is a, c, g, or t
tcagactactatgtcacgaccggtgctcgatttagagtatacatattgggtttgggacagagttcactctcaccatcagcagtctgcagtctgaagattttgcagtttattactgccagcagcacagtgactggccgctcactttcggcggagggaccaaggtggagatcaaacgaactgtggctgcaccatctgtcttcatcttcccgccatctgaacatagtagtctgagcgggctgggcaaggcgcatagnnn

SEQ ID NO: 98015 - DNA, 256 bp, Homo sapiens
  misc_feature: GYAE6OF01D3M7G.24.67.G01.1.454.CMB.1.raw
  modified_base (253)..(256): a, c, t, g, unknown or other
  misc_feature (253)..(256): n is a, c, g, or t
tcagactactatgtcacgaccggtgctcgatttagagtatacatattgggtttgggacagagttcactctcaccatcagcagtctgcagtctgaagattttgcagtttattactgccagcagcacagtgactggccgctcactttcggcggagggaccaaggtggagatcaaacgaactgtggctgcaccatctgtcttcatcttcccgccatctgaacatagtagtctgagcgggctggcaaggcgcatagnnnn

SEQ ID NO: 98016 - DNA, 520 bp, Homo sapiens
  misc_feature: GYAE6OF01BNLNW.24.67.G01.1.454.CMB.1.raw
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtataagaagcaactacttagcctggtatcaacagaaacctggccaggctcccaggctcctcatctatggtatatccagcagggccactggtgtcccagccaggttcagtggcagtgggtctgggacagagttcactctcaccatcagcagtctgcagtctgaagtattttgctagtttattactgccagcagcacagtgtacgtggccgctctaccgtttcgggcgggacgggaccgtaagggtcggagagtaccgaaacgaacgtggtacggctagccaccgtgttccg

SEQ ID NO: 98017 - DNA, 528 bp, Homo sapiens
  misc_feature: GYAE6OF01CHXYQ.24.67.G01.1.454.CMB.1.raw
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
  modified_base (481)..(481): a, c, t, g, unknown or other
  misc_feature (481)..(481): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
  modified_base (522)..(522): a, c, t, g, unknown or other
  misc_feature (522)..(522): n is a, c, g, or t
tcagactactatgtcacgaccggtgctcgatttagagtatacatattgggtttgggggaactgctcagttaggacccagacggaaccatggaagccccagctcagcttctcttcctcctgctactctggctcccagagaccaccggagaaattgtgttgacacagtctccaggcaccctgtctttgtctccaggggagagagccaccctctcctgcagggccagccggagtgttagtaagtacttaggctggtaccaanagaaacctggccaggctcccaggctcctcatctatgatgtctccaacngggtcactggccgtccccgcaggttcaggtggcaggtggtctgggacagacttcactctcaccgtcagccagcctagagcctagaagtattttgcggttttactactgtcagcagcgttccgcctggccgtcgtacgttcgggcgggggacagggtggaggaggagacgatggnggctgcacatcgtgtntcnctcctcccgctatctagaactntgtacg

SEQ ID NO: 98018 - DNA, 520 bp, Homo sapiens
  misc_feature: GYAE6OF01EOCCJ.24.67.G01.1.454.CMB.1.raw
  modified_base (200)..(200): a, c, t, g, unknown or other
  misc_feature (200)..(200): n is a, c, g, or t
  modified_base (394)..(394): a, c, t, g, unknown or other
  misc_feature (394)..(394): n is a, c, g, or t
  modified_base (517)..(517): a, c, t, g, unknown or other
  misc_feature (517)..(517): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtataagaagcaactacttagcctggtatcaacagaaacctggccaggctccaggctcctcatctatggtatatccagcagggccactggtgtcccagccaggttcagtggcagtggtctgggacagagttcactctcacatcagcagtctgcagtctagaagtntttgcttagtttattactgcctagcagcacgtagtcgtacgtcggccgtctccgtacgtttcgggacggacgggaccgaagggtcggagacgtacgaaacgacgtggtcggactgacctacgntcg

SEQ ID NO: 98019 - DNA, 515 bp, Homo sapiens
  misc_feature: GYAE6OF01AVYBE.24.67.G01.1.454.CMB.1.raw
  modified_base (200)..(200): a, c, t, g, unknown or other
  misc_feature (200)..(200): n is a, c, g, or t
  modified_base (354)..(354): a, c, t, g, unknown or other
  misc_feature (354)..(354): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaagtagtcatgacgcagtctccagccaccctgtctgtgtctccaggggaaanagcccaccctctcctgcagggccagtgagaatgttggcagcaacttagcctggtaccagcagaaacctggccaggctcccaggctcctcctctatgctgtctccaccagggcccctggtgtcccagcccaggttcgtggcggtggtctgggacngatttcgactctcaccatcagcggcctccagtctgaagtatttgctactttattctgtcaacactatgtgactggtcctcgtactactttcggccgtagggaccaacgtggagatacaaacgactgtggctgcaccatctcgtcttcatccttcccgctac

SEQ ID NO: 98020 - DNA, 274 bp, Homo sapiens
  misc_feature: GYAE6OF01AEM0O.24.67.G01.1.454.CMB.1.raw
  modified_base (258)..(274): a, c, t, g, unknown or other
  misc_feature (258)..(274): n is a, c, g, or t
tcagactactatgtcacgaccggtgctcgatttagagtatacatattgggtctgggacagagttctactctcaccattacagcagtctgcagtctgaagattttgcgagtttattactgccagcaggcacagtgactggccgctcactttcggcggagggaccaaggtggagatcaaacgaactgtggctgcaccatctgtcttcatcttcccgccatctgaacatagtagtctgagcgggctggcaaggcgcatagnnnnnnnnnnnnnnnnn

SEQ ID NO: 98021 - DNA, 514 bp, Homo sapiens
  misc_feature: GYAE6OF01DNLV5.24.67.G01.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (510)..(510): a, c, t, g, unknown or other
  misc_feature (510)..(510): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctntcctgcagggccagtcagagtataagaagcaactacttagcctggtatcaacagaaacctggccaggctcccaggctcctcatctatggtatatccagcagggccacgtggtgtcccagccaggttcagtggcagtgggtctgggacagagttcactctcaccatcagcagtctgcagtctagaagtatttgctagtttattactgccagcagcacagtgacgtggccgtctcgtacgtttcgggcgggtacgggaccaaggggtggagagtacaaacggacttggtacggctggcaccntccg

SEQ ID NO: 98022 - DNA, 535 bp, Homo sapiens
  misc_feature: GYAE6OF01BMPFV.24.67.G01.1.454.CMB.1.raw
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtataagaagcaactattagcctggtatcaaacagaaacctggccaggctcccaggctcctcatctatggtatatccagcagggccacgtggtgtcccagccaggttcagtggcagtgggtctgggacagagttcactctcaccatcagcagtctgcagtctgaagtnttttgctagtttattactgccagcagcaacagtgacttggccgctccgactttccgggacggtaagggaccctaagggtgggaagaacgttacgaaaaccgtaacgttaggtcggactcggactaacccgtattcccg

SEQ ID NO: 98023 - DNA, 605 bp, Homo sapiens
  misc_feature: GYAE6OF01A9H5E.24.67.G01.1.454.CMB.1.raw
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
tcagactactatgtcacgaccggtgctcgatttagagtatacatattgggtttggggggaactgctcagttaggacccagagggaaccatggaaaccccagcgcagcttctcttcctcctgctactctggctcccagataccactggagaagtagtcatgacgcagtctccagccaccctgtctgtgtctccagggggaaagagccaccctctcctgcagggccagtgagaatgtggcagcaacttagcctggtaccagcaagaaacctggccaggcctccaggcctcctcctctatgctgtcctccaccgacgggcccctggtcgtccccagtcccgtaggttcggttgggcggttggggtcgtggggactaggtatttccacttctcacctntcgacgcggtcctcagtctagtaagtntttgcttactttattctgtactaactacttagtggtcgtacgtcggtccttaccgtacttaccgttttacggacccgtaacggggtaaccctaaacgtcgggaacgtacgtaaccgaaacgtaacgtggtacggcgtcgaccgactactcgttgttcttctacttccttcccgcctacgtaccg

SEQ ID NO: 98024 - DNA, 531 bp, Homo sapiens
  misc_feature: GYAE6OF01BT0W1.24.67.G01.1.454.CMB.1.raw
  modified_base (200)..(200): a, c, t, g, unknown or other
  misc_feature (200)..(200): n is a, c, g, or t
  modified_base (527)..(527): a, c, t, g, unknown or other
  misc_feature (527)..(527): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagagcaactacttagcctggtatcaacagaaacctggccaggctcccaggctcctcatctatggtatatccagcagggccacgtggtcgtccccagcccaggttccaggtggcaggtgggtctgggacaggagttcacttctcaccatcagcagtctgcagttctagaagtattttgctagtttattactgtccagcagcacagtcgtactcggccgtctacctaccgtttcgggccgggacgggaccgtaagggtcggaagacgtacgaaacgtactggtcggctagccacgntccg

SEQ ID NO: 98025 - DNA, 523 bp, Homo sapiens
  misc_feature: GYAE6OF01BJZWU.24.67.G01.1.454.CMB.1.raw
  modified_base (518)..(518): a, c, t, g, unknown or other
  misc_feature (518)..(518): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagagaccaccggagaaattgtgttgacacagtctccaggcaccctgtctttgtctccaggggagagagccaccctctcctgcagggccagtcagagtgttagcagcagctacttagcctggtaccagcagaaacctggcctggctcccaggctcctcatctatggtgccgtccaccagggccacgtggcgtcgcggacaggtcagtggcagtggcttgggacagacttcactctcatcatcgacagactggacgcccgaagtattttgacgtagtgtattactgtctagtcttgtttcgtcctcgtccttcctattcgtacttcgtttggtccgtaggttccgaggtctggtagatcgaaggtcgaacgtgtgtctgacaccntctcg

SEQ ID NO: 98026 - DNA, 607 bp, Homo sapiens
  misc_feature: GYAE6OF01BGFZ3.24.67.G01.1.454.CMB.1.raw
  modified_base (202)..(202): a, c, t, g, unknown or other
  misc_feature (202)..(202): n is a, c, g, or t
tcagactactatgtcacgaccggtgctcgatttagagtatacatattgggtttggggggaactgctcagttaggacccagacggaaccatggaagccccagctcagcttctcttcctcctgctactctggctcccagatgccatcggagacattgtgttgacacagtctccagccaccctgtctttgtctccgaggggaaangccaccctctcctgcgagggccagtgacaatgtagagttgttagctggtatcaacacaaacatggccaggcctcccggctcctcatctatgatgcatccaagtacggccactggcatcccagacaggttcagtggcaggtggtactgggacaggtacttcacttctacaccatcagcagtgtagagcctagaattagtttgacttaggttttacttacgttgtacacgtccgtaaccgtacgaaccgtaaccgtccggtaccccttaccgtttcccgggaccccgttacggggaccctaacggaccgttacgggaactaaccgtacccgaaaccggtaacgttcggtacggtacccgttacgaacccgttacctacgtttaccttcggttccctttccgtaaccc

SEQ ID NO: 98027 - DNA, 575 bp, Homo sapiens
  misc_feature: GYAE6OF01EU27D.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagatataagaagcaactacttagcctggtatcaacagaaacctggccaggctcccgaggctcctcatctatggtatatccgagcagggccacgtggtcgtcccagccaggttcagtcggcaggtggtctgggacaggtagttcacttctcaccatcagcagtctgctagtctaggaagtagttttcgcttagtttacttacgtgtaccagctagcgaactaggtcgtaccgttcgggccctacgtccgtacgtttcgggaccgggtagggtaaccgaaggggtcgggaagtacgtaaccgaaaacggtacgtacggtacggaccgttacggccgtaaccgtgttaccgg

SEQ ID NO: 98028 - DNA, 571 bp, Homo sapiens
  misc_feature: GYAE6OF01AEL7O.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccacctctcctgcagggccagtcagagtataagagcaactacttagcctggtatcaacagaacctggccaggcctcccgaggcctcctcatctatggtatactccgagcgagggccagtggtcgtccccagccgtaggttcaggtggcaggtgggtctgggacaggtacgttcacgtctcacctatcgagcagtctgctagtctagagtatttgtacttactttattctgtactaactacttagtggtacgtacgttcgtccttaccgttacttacgtttcggaccgtacgggtacctaaacgtaggacgtacgtacgaaacggtacgtacggtacggtcgtacgtacctacgtacttcgtcgttacc

SEQ ID NO: 98029 - DNA, 529 bp, Homo sapiens
  misc_feature: GYAE6OF01C15Q3.24.67.G01.1.454.CMB.1.raw
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
  modified_base (388)..(388): a, c, t, g, unknown or other
  misc_feature (388)..(388): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttgcctggtaccagcagaacctggccaggctccaggctcctcctntatgctgtctccaccgacgggcccctggtcgtcccagccaggttcgtggcggtggtctgggacagtatttcactctcacatcagcgcctcatctgaagtntttgctacttttattctgtcaactacttagtggtgtacgtcggtccttccgtactacgttttcggccgtagggaccaacgtggagatacaaacgtacgtggtacgcgtagccacatcttacgtcttcattccttccgctac

SEQ ID NO: 98030 - DNA, 603 bp, Homo sapiens
  misc_feature: GYAE6OF01EP1VM.24.67.G01.1.454.CMB.1.raw
  modified_base (419)..(419): a, c, t, g, unknown or other
  misc_feature (419)..(419): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagataccactggagaagtagtcatgacgcagtctccagccaccctgtctgtgtctccgagggggaaagagccaccctctcctgcagggccagtgagaatgttggcagcaacttagcctggtaccagcagaaacctggccaggctcccaggctcctcctctatgctgtcctccaccgacggggcccctggtcgtccccagcccgtagggtttcgttgggcgggttgggtcgtgggggacaggtacttttcactctcaccatcagccggcctccagtctgaagtnttttgcttactttatttctgtacaactactagtggtgtactggcccttcgtactacgttttcggaccgtaacggggaacctaaacgtagggagtaacttacgaaaaccgtacgttaggtcgggtctggaccaaccctacttccgttacgttccgtttactactttcccttcccccgtcctaccg

SEQ ID NO: 98031 - DNA, 596 bp, Homo sapiens
  misc_feature: GYAE6OF01A2YFN.24.67.G01.1.454.CMB.1.raw
  modified_base (201)..(201): a, c, t, g, unknown or other
  misc_feature (201)..(201): n is a, c, g, or t
  modified_base (439)..(439): a, c, t, g, unknown or other
  misc_feature (439)..(439): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccacctctcctgcagggccagtcagagtataagaagcaactacttagcctggtatcaacagaacctgccaggctcccaggctcctcatctagtggtatactccagcagggccagtggtcgtcccagccctaggttcaggtggctaggtcgggtctaggggacaggtacgtttcacttctcaacctatcagcagttccgtgctagtctagtaagtatttgacttagtttattacgngtacctagcgtagcaacgtacggtgtaccgtcggcccgtaccgttaccgtacggtttccgggaccgggtagggtaacccgtaagggtacggtaggaacgtaccgtaaaaccggaacgttacgggtacggtacgttacggaccctaccgtacgttccg

SEQ ID NO: 98032 - DNA, 631 bp, Homo sapiens
  misc_feature: GYAE6OF01CNVMQ.24.67.G01.1.454.CMB.1.raw
  modified_base (202)..(202): a, c, t, g, unknown or other
  misc_feature (202)..(202): n is a, c, g, or t
  modified_base (382)..(382): a, c, t, g, unknown or other
  misc_feature (382)..(382): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtataagagcaactacttagcctggtatcaacagaaacctggccaggctcccaggctctcatctatggtatatccagcagggccacgtggtcgtcccagccaggttcaggtggcaggtcgggtctgggacagtacttcacttctcacccgtnacgcacgcctacgacgccctaggtaacgttacgttttacggtaccggttttactaccgttggtctacggctacggtccgttcccgccgttcggtcccgtacgtttaaccggtttccggggaccggggggtacccgtagggggtggaacgggagggaacggtaccggtaacggtcgggtacgggtccgtcggtccgacccgtacgttccgttcggttcctttaccgtacctttcccgttccccggtaccc

SEQ ID NO: 98033 - DNA, 528 bp, Homo sapiens
  misc_feature: GYAE6OF01AWS81.24.67.G01.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtataagaancaactacttagcctggtatcaacagaacctggccaggctccaggctcctcatctatggtatatccagcagggccagtggtcgtccccagccctagggttcaggtcggactagggtgggtctgggacaggtacgttcactctcaccatcagctagtctgcagtctagtaagtatttgtctagtttacttactgcagcagcacagtgtacgtggtcctctcgtacgttcggcgggtaggaccgaagggtcggagacgtacgaaacgtagtcggtcggctagctcgtagtcg

SEQ ID NO: 98034 - DNA, 538 bp, Homo sapiens
  misc_feature: GYAE6OF01B1HRD.24.67.G01.1.454.CMB.1.raw
  modified_base (202)..(202): a, c, t, g, unknown or other
  misc_feature (202)..(202): n is a, c, g, or t
  modified_base (530)..(530): a, c, t, g, unknown or other
  misc_feature (530)..(530): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcagggccagtcagagtataagagcaactacttagcctggtatcaacagaaacctggccaggcctcccgaggcctcctcatctatggtatactccagcagggccagtgggtctccccagcccaggttccaggtggcaggtcgggtctggggactaggtagttccacgttcctccaaccagtcagctacgtctgctagtctagtaagtagtttgcttagtttattactgacagcagcgaactgtgacgtggcctctcgtcgttcggcgggtaggaccgaaggtggaagagtacgaaacgtacgtgtcggcagcnccgtgtcg

SEQ ID NO: 98035 - DNA, 571 bp, Homo sapiens
  misc_feature: GYAE6OF01BLPYQ.24.67.G01.1.454.CMB.1.raw
  modified_base (201)..(201): a, c, t, g, unknown or other
  misc_feature (201)..(201): n is a, c, g, or t
  modified_base (564)..(564): a, c, t, g, unknown or other
  misc_feature (564)..(564): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccaccctctcctgcgagggccagtcagagtgttagcagcagctacttagcctggtaccagacacgaaacctggcctggcctcccgaggcctcctcactctagtggtcgccgtccacgcgggccacgtggcgtcgcggacgtaggttcagtggctaggtcggtcgtttgggacacgtacttcactctactatcatcgacagtacgtggacgaccgtaagtatttcgctagttgttattacgtgtactgtcgttgtttcgtccttctccttaccgttattcgttacttcgtttcggccgtacggttccgaggttcgtcggtagtacgtacgaacgtcgtaacggttcggtacgcgtcgtccncgttacg

SEQ ID NO: 98036 - DNA, 263 bp, Homo sapiens
  misc_feature: GYAE6OF01DA0FJ.24.67.G01.1.454.CMB.1.raw
  modified_base (257)..(263): a, c, t, g, unknown or other
  misc_feature (257)..(263): n is a, c, g, or t
tcagactactatgtcacgaccggtgctcgatttagagtatacatattgggtctgggacagagttcactctcaccatcagcagtctgcagtctgaagattttgcagtttattactgccagcagcacagtgactggccgctcactttcggcggagggaccaaggtggagatcaaacgaactgtggctgcaccatctgtcttcatccttcccgccatctgaacatagtagtctgaggcgggctggacaaggcgacatagnnnnnnn

SEQ ID NO: 98037 - DNA, 889 bp, Homo sapiens
  misc_feature: GYAE6OF01EJYNP.24.67.G01.1.454.CMB.1.raw
tcagactactatgtcacgaccggtgctcgatttagagtatacatattgggtttggggggaactgctcagttaggacccagagggaaccatggaagccccagctcagcttctcttcctcctgctactctggctcccagagaccaccggagaaattgtgttgacacagtctccgagcctacctgttcttcgtcctcggagggagagacgcccaccctctccgtgacggacggaccacgggaccggtagttagttaagttaacgttacgttacggtcgtacggtaaccaacgaacgtaaccgtcggaccgacggtccctaccggacggtcctcctacacttactagtacgtagttccgttaccctaaccgaacgggtcggtaccgtaccggtcgggtcccccgtaccccgtacggttacggttcgagggtcggacggtagggtcggtcggtacggacgtacgttacctctaccgtctaccgtaccgtacacgtacgaccgtacgtaaggccgtacgtaagggttaacgttttcggttttaccggtttaaccgggtttaaaccttcgggttaccgtaacggtaccggtacgttacccgggtttccccggtttccccggaccgggttccccgggtacccgtttaaccggttttacccggggggtttaccccgggggggaccgggggtaaccgggttagggggggtaacgggtaaacggggaacggggtaaacccggtaaaccggggttacgtcgggggtacccggttacggtacccgtaacccggttaccgttacggtttcggttaccgtttacccgttaccttcccggtttacccccgtacccgtaaccgtttacgtacccgtaaataaccggttaagtttgggttaacccgg

SEQ ID NO: 98038 - DNA, 852 bp, Homo sapiens
  misc_feature: GYAE6OF01CKHMD.24.67.G01.1.454.CMB.1.raw
  modified_base (202)..(202): a, c, t, g, unknown or other
  misc_feature (202)..(202): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctccagataccactggagaaatagtgatgacgcagtctccagcccaccctgtctgtgtctccgaggggaaangcccaccctctcctgcgacgggccagtcagagtaataagaagctaaactacttagcctaggtactaccaaacaacgaaaccgtggaccaaggcctacccgaggtcctcctactattccgttaagtggttaatacgtcccgaaggccggacgggtccctaagttcgggtccgtaccccgaacggtccgtaacgggtttccgaagggttcgggacgtaggggttcggggttcgtagggggaaacctagggttacgtttaccaaccttccgtacccaaacccgtacgttccgaacggtcccgtaacggttaccgttacggtaccgtaaggtttaccgtaagggttaaacggttttacgtttttacgggtaacgttttaaacgggttttttaaactacccgttccgggtaaccaacggtaccgtaacggtaaccgtaaccgttaacggggttaaccggtaccggttacccgggtcccgttaaccggtttaccggttaacccgggttttaccgggggggaccgggtaaaccggggggtaaccgttaaaggggggtaacgggttaaaaggaaccggtttaaacccggaaaaacgggttaaccggttcgggtaaccgggtacttaccgggaaccccttaaccgttacgtttcccggg

SEQ ID NO: 98039 - DNA, 523 bp, Homo sapiens
  misc_feature: GYAE6OF01BYZUP.24.67.G01.1.454.CMB.1.raw
  modified_base (202)..(202): a, c, t, g, unknown or other
  misc_feature (202)..(202): n is a, c, g, or t
  modified_base (519)..(519): a, c, t, g, unknown or other
  misc_feature (519)..(519): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtataagaagcaactacttagcctggtatcaacagaaacctggccaggctcccaggctcctcatctatggtatatccagcagggccatggtcgtcccagccaggttcagtggcaggtgggtctgggacagagttcactctcaccatcagcagtctgctagtctgaagtattttgactagtttattactgccagcagcacgtagtgacgtggccgctcgtacgttcgggcgggacgggaccgaagggtggagtacgtacgaaacggtactggtacggctagccaccgtntccg

SEQ ID NO: 98040 - DNA, 540 bp, Homo sapiens
  misc_feature: GYAE6OF01AHY6C.24.67.G01.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctntcctggcagggccagtcagagtataagagcaactacttagcctggtatcaacagaacctggaccaggcctcccgaggctcctcatctagtggtatactccagcagggcctacgtggtctcccagccaggttcagtggcaggtcggtctgggacaggcgttcactctcactatcagcagtctgctagtctagaagttatttgacttagtttatacgtgtccagcagtcacgtagtcgacgtcggccgactacgtacgttcgggcggtacgggaccgagggtacggagtacgtacgaaacgtacgtcggtacggactagacctacgtcttcg

SEQ ID NO: 98041 - DNA, 921 bp, Homo sapiens
  misc_feature: GYAE6OF01C33JI.24.67.G01.1.454.CMB.1.raw
  modified_base (214)..(214): a, c, t, g, unknown or other
  misc_feature (214)..(214): n is a, c, g, or t
  modified_base (288)..(288): a, c, t, g, unknown or other
  misc_feature (288)..(288): n is a, c, g, or t
  modified_base (854)..(854): a, c, t, g, unknown or other
  misc_feature (854)..(854): n is a, c, g, or t
tcagactactatgtcacgaccggtgctcgatttagagtatacatattgggtttggggggaactgctcagttaggacccagacggaaccatggaagccccagcgcagcttctcttccctctgctactctgcctccagactaccacgtggaagaaggtagtcagtcgacgcagtcctccacgcccaccctgtctgtcgtcctccggaaggggaaanacgcccaccctctcctgcgacgggcctagtgaagtaagttggtggcagtactaacgtacgtccgtaggtaaccngacgaacggtaaaccgtcggacccgaacggtcctcccgaacggtcccttccccgtccttacttacgtcgtccgtccgttacctaccccgaacccggtccggggtccccttcgggtacccgtaccccgacggtacccggttacgggttttccgggttcgggtccggggtttcgggttaccggttacggggtaaccgttaaggtttaaccgttttactaaccccttcccggttaacccgtaccggttacgaacggtacctaaccggtaacccgtagggtaacccgttaccggtaaggttaaaacggttttacgttttaccggggttaaccgtttttaacccgtacgtttaccgggtccgtaaacggtcccgttaacgggttcccccggttaccggtacccggttccgggaccccgttttaacggtttacccggggggttttcccgggggggaaccggggggtaaacccggtgggggggttaacgggaacggggtaagggtaaacccggtaggtaaaccggttcgggtacggtccgtacgggtaccctaaacgttcgtttacccggttntttccccgttaacgttcccttacccccggttcccccgaagtttaacctccgggtaaactaaaaccgg

SEQ ID NO: 98042 - DNA, 558 bp, Homo sapiens
  misc_feature: GYAE6OF01CR8AR.24.67.G01.1.454.CMB.1.raw
  modified_base (203)..(203): a, c, t, g, unknown or other
  misc_feature (203)..(203): n is a, c, g, or t
  modified_base (407)..(407): a, c, t, g, unknown or other
  misc_feature (407)..(407): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagcccaccctgtctgtgtctccagggggaaanagccaccctctcctgcagggccagtcagagtataagaagcaactacttagcctggtatcaacagaaacctggccaggctccaggctcctcatctatggtatatccagcagggccagtggtcgcccagccaggttcaggtggctaggtgggtctgggacaggtagtttcactctcaccatcagcagtctgacagtctagtaagtnttttgacttagtttattacgtgccagcagcacgtagtgtacgtcggccgtcgtccgtacgtttcggggacggtacgggacctaaggggtacggaagtaacgtaaccgaaaaccgtaacgtacgggtacggactagaccaccgtaagttccg

SEQ ID NO: 98043 - DNA, 642 bp, Homo sapiens
  misc_feature: GYAE6OF01EF4VP.24.67.G01.1.454.CMB.1.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccaccctctcctgcagggccagtgacatgttaggagttgttagctgtancaanacaantgcagctcccggntctcatctatgatgcactccaagtcggccactggccatcccagacgaggttcaggtggacgtaggttcgggtctggactagacttcactcacaccatcagactaggtcgtaagacgtccgttagaacgtttacgtttttcggtaccggtttttaactacgttcgtaccgtaagccgtacggtcccgttcccggaccgttcgggtaccccgttacggtttaacccgggtttccggggggaccgggggtaaccggtagggggtagggtaacgggacgggtaacggaaccggttaacgggtgtcgggacttcgggacctaccgtacgttcggttaccgttacctttaccgtaccttccccgttaccccgg

SEQ ID NO: 98044 - DNA, 632 bp, Homo sapiens
  misc_feature: GYAE6OF01AJM1U.24.67.G01.1.454.CMB.1.raw
  modified_base (202)..(202): a, c, t, g, unknown or other
  misc_feature (202)..(202): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtataagaagcaactacttagcctggtatcaacagaaacctggaccaggcctcccgaggcctcctcactctatggtatactccagcagggccacgtggtcgtcccgagcctaggttcaggtggcgtaggtgggtctgggacaggtgttccactctcaccatcagcacgtctgctagtctagtagttatttgacgttagtttacttacgcgtaccgagtccgaacgtacctaacgtaggtacgtaccggttcgggacccgttccgtaccgttacccgggtttacggggaccggggtaaacgggtaacccgaaagggggttacggaaggtaacgttaacccggaaaaacggtaccgttacgggttacggaccgttaccggacccgtaacccgtagtttacccgg

SEQ ID NO: 98045 - DNA, 601 bp, Homo sapiens
  misc_feature: GYAE6OF01AM8CJ.24.67.G01.1.454.CMB.1.raw
  modified_base (202)..(202): a, c, t, g, unknown or other
  misc_feature (202)..(202): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaagtagtcatgacgcagtctccagccaccctgtctgtgtctccgaggggaaancgcccaccctctcctgcgagggccagtgagtaatggttggcagctaacttagcctggtaccagcaagaaccgtggaccaggcctcccgaggcctcctcctctatcgctcgtcctccaccgacggtcccctggtcctccagccgtagggtttcgtgggtcggtggtcgtgggactgtacttcnctctcacntcgacgcgtcctcgtagtctagtaagtgtttcgaccttatttcttcgtatactaactagtagtcgtacgtacgtcggtaccttcgtacgttacgtttcgggaccgtaacgggtaaccaacgtggtacgtacgtaacgtaaacgtacgtggtacgtccgtgacctacgtattccgttcgttacttactaccgttccctcccgtctaaccg

SEQ ID NO: 98046 - DNA, 802 bp, Homo sapiens
  misc_feature: GYAE6OF01B4HHL.24.67.G01.1.454.CMB.1.raw
  modified_base (204)..(204): a, c, t, g, unknown or other
  misc_feature (204)..(204): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagcccacctgtctgtgtcctaccgaaggggaaanacgcccaccctctcctgcagggtccagtcaagagtaataagaagctaaactacttagccgttaggtactacgaaacaggaaacctggaccacgggcctacccgaggtcctacccgtacgtaacttaccgtagtacggttaactacgttacccgaaggaccgtaacgggaccctacgttcgggtacgtaccccgtaggtaccgtagggttccgaggttcggacgtagggttcgggtacgtagggaacgtaaggtacgttaccaacgttcctaaccgaacccgtagtaccgaacgtacgtaacggttccgtacggtaccgtaacgggttacttaaggtaaacggttttattttaccgggtaccttttaaacgtttttaactttccgtaacgttaaccgtaaacgtacgttaaggtttcgggtaacgttaccggttacccgggtacccgttaacccggtttacgtttaacggtttacggaccccgggtaaacgggtaaaccctaaacggtaggaaacgttaactaaaccggtaaaacccgtcggttacgtacgggtccctaaccgggacccttaaccgtatttcccggttcgtttaacccg

SEQ ID NO: 98047 - DNA, 580 bp, Homo sapiens
  misc_feature: GYAE6OF01B1PLS.24.67.G01.1.454.CMB.1.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaaggggaaangccaccctctcctgcagggccagtcagagtataagaagcaactacttagcctggtaatcaaacagaaacctggccaggctccaggcctcctcatctatggtactatccagcagggccacgtggtcgtcccagccgaggttcagtcggacaggtggtctgggaacagtattcactcnccaaccatcagcagtctgctagttcgtagaatagttttgacgttaagtttactactcgactagacagctaacgtggtacgtacgtcggaccgtccttacgtaccggtttcggaccgggtacggaacccgtaagggtacggaacgtaacgtaacgaaaacggtacgtacgggtacggtacgtaacggcctaaccgtagttccg

SEQ ID NO: 98048 - DNA, 544 bp, Homo sapiens
  misc_feature: GYAE6OF01AEWT5.24.67.G01.1.454.CMB.1.raw
  modified_base (200)..(200): a, c, t, g, unknown or other
  misc_feature (200)..(200): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagaagcaactacttagcctggtatcaacagaaaccctggaccaggcctcccgaggcctcctcatctatggtatactccagcagggccacgtggtctcccagccaggttcaggtcggctaggtgggtctgggacaggtacgttcactctcaccatcagcagtctgctagtctagtaagtagttttgacttagtttacttactcgaccagcagcaacgaggtcgtacgtcggccctcgtccgtacgttcgggcgggacgggaccgagggtcggagtacgtacgaaacgtacgtggtcggactgctccgtatcg

SEQ ID NO: 98049 - DNA, 531 bp, Homo sapiens
  misc_feature: GYAE6OF01ENJXV.24.67.G01.1.454.CMB.1.raw
  modified_base (202)..(202): a, c, t, g, unknown or other
  misc_feature (202)..(202): n is a, c, g, or t
  modified_base (406)..(406): a, c, t, g, unknown or other
  misc_feature (406)..(406): n is a, c, g, or t
  modified_base (450)..(450): a, c, t, g, unknown or other
  misc_feature (450)..(450): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtataagaagcaactacttagcctggtatcaacagaaacctggccaggcctccccggctcctcatctatgatgcatccaagtacgggcctactggctactcccagaccaggttcaggtcggacgtaggttgggtcgtaggggacagtacttcactctcacctatcagcagtgtagngtcagtaagttatttgacgttagtttactacgtgtcagcacgtnacacgtcggacctcgttcgccctggacctagctgacacgtccgaacgtactggtcgctcgacctactattctcgttcttac

SEQ ID NO: 98050 - DNA, 579 bp, Homo sapiens
  misc_feature: GYAE6OF01DGA50.24.67.G01.1.454.CMB.1.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
  modified_base (417)..(417): a, c, t, g, unknown or other
  misc_feature (417)..(417): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcgagggccagtcagagtataagagcaactactagcctggtatcaaacagaaacctggccaggctccaggctcctcatctatggtatactccagcagggccacgtggtcgtcccagtccaggttcaggtcggcgtaggtcgggtgtgggacnggagttcactctacacctatcagcagttctgacgtagtctagtaagtnttttgacttacttttatttctcgttacaactacttagtaggtcacgttcggtccttccgtacttacgtttcggaccggtaacgggtaacctaaacgtggaacgtaacgtaaccgaaacgtacgtaggtacggtacgtacgacctacctactcgttcgttacc

SEQ ID NO: 98051 - DNA, 568 bp, Homo sapiens
  misc_feature: GYAE6OF01DTP4D.24.67.G01.1.454.CMB.1.raw
  modified_base (202)..(202): a, c, t, g, unknown or other
  misc_feature (202)..(202): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (490)..(490): a, c, t, g, unknown or other
  misc_feature (490)..(490): n is a, c, g, or t
  modified_base (521)..(521): a, c, t, g, unknown or other
  misc_feature (521)..(521): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtataagaagcaactacttagcctggtatcaacagaaacctggccaggcctcccaggctcctcatctatggtatactccagcgagggccacgttggcgtcccagccaggttcaggtggcaggtggtcngggacagtntcactctcacgtcagacacgcctagcgtacctgaagttagttttgtaccggtttactactgtcagtccgtagtccgttccgcgtcggccgtaccgttaacggttcgggccggggggtacgnggggtggaggaggaggacgtacgtggtcggngtcggcctaccgagttccgttcgttcttcacttccgttcccgtaccg

SEQ ID NO: 98052 - DNA, 593 bp, Homo sapiens
  misc_feature: GYAE6OF01EZ0RJ.24.67.G01.1.454.CMB.1.raw
  modified_base (203)..(203): a, c, t, g, unknown or other
  misc_feature (203)..(203): n is a, c, g, or t
  modified_base (408)..(408): a, c, t, g, unknown or other
  misc_feature (408)..(408): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtataagagcaactacttagcctggtatcaacagaaacctggccaggcctcccaggcctcctcatctatggtatactccagcagggccacgtggtctcccagcctaggttcagtgcaggtggtcgtgggacagtgttcactctaccaccatcagctagtctgctagtctagtaagtnttttagtcttacttttatttcttacgtacctaactacttagttcggtacgtacgttcggtcccgttaccgttaccgttaccgttttacgggaccggtaacggggtaaccctaaacggtggtaacgtacgtaacgtaaacggtaacgttacggtacgtcgtacgaccacctacttcgtcgttaccg

SEQ ID NO: 98053 - DNA, 757 bp, Homo sapiens
  misc_feature: GYAE6OF01CZBP9.24.67.G01.1.454.CMB.1.raw
  modified_base (203)..(203): a, c, t, g, unknown or other
  misc_feature (203)..(203): n is a, c, g, or t
tcagactactatgtcacgaccggtgctcgatttagagtatacatattggggtttgggggaactgctcagttaggacccagacggaaccatggaagccccagcgcagcttctcttcctcctgctactctggcctcccagataccacgtggagaaatagtgatgacgcagtctccagcccacctgtctgtgtctccgaagggaanacgcccacctctcctgcacgggccagtcaagagtaataagacgcaacttacgtgccgtaggtactacgaaacacgaaaccgtggaccaggtccctaccgacggccttccacacttaccttagtagttactacgtacccgaggtccgtacgggccctaaggtttccgggtaccgttcccccgaaggttacccggttacgggtttaccgtacgggtttacgggacggttaacggggttcggggtttaccggaaggggaccctaagggtttaaccggtttaccctaaacgttcccttaaccaacccgtagtacgacgtacgtacgtcgtacgaccgttagtacgttaggtaaattcgttttagtacgtttaagttttacgtacgtcgtacagtacgactaccgtatacggtactacggtccgggtactccgttaccggtaaccgggtttccgggaacgggtaaccgggtaaccggaacggggttggaaaccgttacgtaaaacggaacgttacgggttacgtacgggtacctacgaacccggtccgttagtttcccg

SEQ ID NO: 98054 - DNA, 778 bp, Homo sapiens
  misc_feature: GYAE6OF01DRSC9.24.67.G01.1.454.CMB.1.raw
  modified_base (218)..(218): a, c, t, g, unknown or other
  misc_feature (218)..(218): n is a, c, g, or t
tcagactactatgtcacgaccggtgctcgatttagagtatacatagttagggtttgggggaactgctcgagttacggacccacgacgggaacctatggaagtccccagtcgcaagcttctcttacctcctgctaactctcggctcccagtagtaccactggagaaagtagttgtatgacgtctaagtctccagccacctgtctgtgtctcgagggaancgccgaccgtctccgtgcgacgggccgtacgtcgaagtagtataacgaagctaactacttacgccgtaggtactaccaaactaacggtaaaccgtcggaccaaggcctacccgaggtcctccgtcgtacgttcctagtgggtactacgtccggaggcgagggcctagttcggtcgtcccagtccgtaggttccaggtcggcgtacggtcggtcgtagggaccaggtacgtctaccttcgtaccgtaacgtacgtccgtacgtaccgtacgttcgtaggacctaacggttacgtaacggtaaacgttaccgttttacgacgttttaacggttttacttaccgtacgtaaccgtaacggacctacgtaccgtaacggtacggtaccgtaccgtaccgggacccgttaccgttaccgttaaccggttttacccggggaacgggtaaaccgggtaacccgtaaaggggttacgggaacggttaacggtaaacccgggtaaaacgggttacgttacgggttaccggttaccgtacggttaacccgtaccggttaccgttacccgg

SEQ ID NO: 98055 - DNA, 619 bp, Homo sapiens
  misc_feature: GYAE6OF01D8Y3B.24.67.G01.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtataagancaactacttagcctggtatcaaacagaaacctggccaggcctcccgaggcctcctcatctagtggtatactccgagcgacgggccacgtggtctcccagcctaggttcaggtgcaggtggtctgggacagtcgttacactctacacctatcagctagtctcgcgtagtctagtaacgttattttcgacgttagtttaacttacgtcgaccgtaggacacgtaccaacgtaggtacgtacgttcgggtcccgtacgttaccgttaaccggtttcggggacgggtaccgggaaccggtaaagggtacgggtaacgtaacggtaaaccgaaaaccggttacgtacgggtacggtaccgtacggaccctaacgtacgttaccg

SEQ ID NO: 98056 - DNA, 706 bp, Homo sapiens
  misc_feature: GYAE6OF01BDWY6.24.67.G01.1.454.CMB.1.raw
tcagactactatgtcacgaccggtgctcgatttagagtatacatattggggtttggggggaactgctcagttaggacccagacggaaccatggaaaccccagcgcagcttctcttcctcctgctactctggctcccagagaccaccgggagaaattgtgttgacacagtctccaggcaccctgtctttgtctccgaggggagagacgcccaccctctcctgcgacgggccagccggagtgttagtaagtacttaggctaggtaccaacagaaacctggccaggcctcccaggcctcctcatctatgatcgtcaccaacgagggtcacgtcggcccgtccccggcctagggttccaggttgggactaggttcggggtcgtacggggaactacgtacttcgaccttctccgaccgttcacggtcacgtcctaaggaccgtcctaggtaagttgtttttacggtaccggttttactaccgttgtaccgtaagtccgtacgtcccggttacccgtccggttccgggccgttaccgttaaccgggtttccgggggaccggggggtaccgtagggggtcggaagggtaacgggaacggtacggtaacggtcggtcggacgtcggaccacgtcgttacgtcgttacctttacgtacgtttcccgttccccgacctacgttcttaacgtaaccgaacgtttagtacgttacggg

SEQ ID NO: 98057 - DNA, 709 bp, Homo sapiens
  misc_feature: GYAE6OF01DR784.24.67.G01.1.454.CMB.1.raw
  modified_base (239)..(239): a, c, t, g, unknown or other
  misc_feature (239)..(239): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagcccacctgtctgtgtctccgaggggaaagacgccaccctctccgtgcgacgggccagtcagagtanaagagcaactactagcctaggtactacaacgagaaacctggaccaggcctcccgaggtcctcccgtacacttactagtgggttaacttacgtcccgaggaccgtacgggccctaacggttcgggtccgtaccccgaacggtccgtaacgggtttccaggtcgggacgtacgggttcggggttccgtaggggaactacggttacggttcctaccgttcctccaaccgtacgtccacggcctacgttccgacgtacgtaacgttcgtaaggtaagtttacgttttcgacttttaacggttttacttaaccgttcgacccgtaaggtacctacggacaacgtaggtccgtaccgttcggacccgtcttccgttaaccggttccgggaacgggtacgggaccgtaaagggtcggaagtacgtaaaccggtaaacgtacggtggtacggaccgttacgcctaacgtcgttacccg

SEQ ID NO: 98058 - DNA, 595 bp, Homo sapiens
  misc_feature: GYAE6OF01D3VQA.24.67.G01.1.454.CMB.1.raw
  modified_base (199)..(199): a, c, t, g, unknown or other
  misc_feature (199)..(199): n is a, c, g, or t
tcagactactatgtcacgaccggtgctcgatttagagtatacatattgggtttgggggggaactgctcagttaggacccagagggaaccatggaaaccccagcgcagcttctcttcctcctgctactctggctccagccatcaccggaggaattgtgttgacgcagtctccaggcaccctgtctttgtctccagggganagagcccaccctctcctgcaggggccagtcagagtgttagcagcagctacttagcctggtaccagcaagaaacctggcctggctcccaggctcctcctctatgctcgtcctccgaccgacgggcccctggtcgtcccacgccgtagggttcggttgggcgggtgggtcgtgggacagtatttcactctcacctatcgagtccggccctacctacgtctagtaagtacgttttagccttacttttagtttcttcgtactaactacttagtcggtcgtacgtcggtccctaccgtacttaccgtttggccgtaacgggaacctaacgtggagactacgaaacgtactggtggtctgacctctactcttacgttccttactacttcccttcccgctacg

SEQ ID NO: 98059 - DNA, 572 bp, Homo sapiens
  misc_feature: GYAE6OF01BM6FQ.24.67.G01.1.454.CMB.1.raw
  modified_base (202)..(202): a, c, t, g, unknown or other
  misc_feature (202)..(202): n is a, c, g, or t
  modified_base (420)..(420): a, c, t, g, unknown or other
  misc_feature (420)..(420): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtataagaagcaactacttagcctggtatcaacagaaacctggccaggcctcccgaggcctcctcatctagtggtatactccagcgagggccacgtggtcgtcccagccgtaggttcaggtggcaggtgggtcgtgggacaggtacgttcacgtctccaccatcgagcagtctgctagtctagtaagtnttttgcttagttttactacgtcgaccgtagactagacacgtagtcgtacgtcggcccgtctccgtaccggttcgggacggtacggggaaccgtaagggtcggtagaacgtacgaaaccgtaacgtcggtacggactcgaccaccgtgtaccg

SEQ ID NO: 98060 - DNA, 566 bp, Homo sapiens
  misc_feature: GYAE6OF01ACHZK.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtataagagcaactacttagcctggtatcaacagaaacctggaccaggcctcccgaggcctcctcatctagtggtatactccagcacgggccacgtggtctcccagccctagggttcaggtggctaggtgggtctgggactaggtacgttccacttctacacctatcacgcacgtctgctagtctagtaagttatttcgacttagtttacttacgtcgccagcgacgcacgtagtcgtacgtcggccgtcgtcgtaccgttcggcgggtacgggaccgtaaggtcggagacgtacgaaacgtacgttacggtcggacgtagacctacgtgtaccg

SEQ ID NO: 98061 - DNA, 795 bp, Homo sapiens
  misc_feature: GYAE6OF01EUDWD.24.67.G01.1.454.CMB.1.raw
  modified_base (205)..(205): a, c, t, g, unknown or other
  misc_feature (205)..(205): n is a, c, g, or t
  modified_base (246)..(246): a, c, t, g, unknown or other
  misc_feature (246)..(246): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagataccactggagaaatagtgatgacgcagtctccagcccaccctgtctgtgtctccgaaggggaaanacgcccaccctctcctgcgagggccagtcagagtataagancaactattagccttggtatacaacaagaaacctggaccaggcctcccaggctcctcatctatggtatactccagcgacgggccacgtcgggtcgtccccaggccgtaggtttacgaggttcgggactaggggttcggggtacgtggggaacctaggtacgtttccacttccgtaccaacccgtattacccgaaggtacctaaggttccgtgtaaccgttaggttaccgttaagggtaaagtttacgtttttacgaccggttttaaagtttttaacgtttaaccgtcggtaaccccgtaaggtaccgtaacggacctaaccgtagggttaccggtaacccggtttccggggaccccgttaccgttacccggtttaaccgggttttaccgggggggaacccggggtaaaccgggggtaaaccggttaaaggggggtacgggtaaaaccgtaacggtttaaacccggaaaaaacccgggttaacggtttaccggggtaaccggggtaccgtacccgggttaaacccgttaaacccgtacggttttaacccgg

SEQ ID NO: 98062 - DNA, 603 bp, Homo sapiens
  misc_feature: GYAE6OF01C5CAU.24.67.G01.1.454.CMB.1.raw
  modified_base (164)..(164): a, c, t, g, unknown or other
  misc_feature (164)..(164): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
tcagactactatgtcacgaccggtgctcgatttagagtatacatattgggtttggggggaactgctcagttatgacccagacggaaccatggaagccccagcgcagcttctcttcctcctgctactctggctcccagataccactggagaaatagtgatgacgnagtctccagtcccacctgtctgtgtctccaggggaaangccaccctntcctgaagggccagtcagagtanaagagcaactacttagcctggtatcaactagaaacctggaccagcctcccaggtcncctcatctatggtatatccagccagggccacgtggtcgtcccagccaggttcaggtcggctaggtcgggtacgtggggacctagtacgttccaactccgtacaccaagtccgaagtaccacggttcctggtacctacgtacgtacgtaaagtactttttgacgttaagttttactacgtcggtaccaaggtcctaagacctacgtacgggtctacgtcgggccctacttccgacgtttccgggcgggtacgggaccgtaagggtggaacgtacgtacgaaaccgtacgtggtacggtctagacgcctagtccg

SEQ ID NO: 98063 - DNA, 810 bp, Homo sapiens
  misc_feature: GYAE6OF01DL5NI.24.67.G01.1.454.CMB.1.raw
  modified_base (203)..(203): a, c, t, g, unknown or other
  misc_feature (203)..(203): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagataccactggaagaaatagtgatgacgcagtctccagccaccctgtctgtgtctacgaggggaancgccaccctctcctgcagggccaggtgagagttgtggcagtactaacttgccgtaggtaccagcaacgaaaccgtcggccgacggccgtacccgacggtcctccctccttactactcggtcttcggtcctacccgaccgacggggtcccctggtccgtcccgacggtcctagggtttcggtgggccggggttggtcgtgggactaggttctttccaccttcgaccacgtactcgacggtccgacccttcgtacgttaccgtaggtaacgttattttacgaccttttacttttacgtttacgttaccgtaactaaccgttaacgtttaacggttcggttaacggttacccgttacgggttccccgtttaaccggtttaacccgtttaccggtttttaacggggaccccggttaaaccgggggtaaacccggttaaaaccgggttacgggtaaacgttaaccggtaaaccgtaaaacccgggttaagttacggggttacccggtaccgttaccgggaacccgttaccccgttaccgtttacccgtttacccggtttacccttttaccttaccccggttttcccgttacccccggtaaccttaaccccgg

SEQ ID NO: 98064 - DNA, 596 bp, Homo sapiens
  misc_feature: GYAE6OF01B2VMZ.24.67.G01.1.454.CMB.1.raw
  modified_base (339)..(339): a, c, t, g, unknown or other
  misc_feature (339)..(339): n is a, c, g, or t
tcagactactatgtcacgaccggtgctcgatttagagtatacatattgggtttggggggaactgctcagttaggacccagacggaaccatggaaaccccagcgcagcttctcttcctcctgctactctggctcccagccatcaccggaggaattgtgttgacgcagtctccaggcaccctgtctttgtctccgaggggagagacgccaccctctcctgcagggccagtcagagtgttagcagcagctactagcctggtaccagcagaacctggcctggctcccgaggcctcctcatctagtggtcgccgtccacgacgggccacgtggcgtcgcggacnggttcaggtggcgaggtggtcgtttgggacagtacttcgactcgtcatcagtcgacagacgtggacgacccgtaagtcgtttgctagttgttacttacgtgtacgtcgtcgtttcggtttcgtcccttccgtccctttcctagttaccgttacgtttaccgtttcgggccgttacgggttccgtacggtcgttacgggagtaccgtacgaacggtactaacggttggtacgtcgttacgaccctactgttccgttcg

SEQ ID NO: 98065 - DNA, 959 bp, Homo sapiens
  misc_feature: GYAE6OF01AS35O.24.67.G01.1.454.CMB.1.raw
  modified_base (952)..(952): a, c, t, g, unknown or other
  misc_feature (952)..(952): n is a, c, g, or t
tcagactactatgtcacgaccggtgctcgatttagagtatacatatgggggtttcgggggaactgctcacgttaggacccagacggaacccatggaagcccctagccgtacaagctttactcttcctcctggcctactcgtcggcctacccgaggactaccgacgtgggagaaactaggtgaatacgaacgactaggtcctaccaaacgccctacccgttggtcgtgttcgtccgtaccggaaagggggaaacgacgtccccgacccctcttcccgtacgacgaacggggaccaacggtaccgaaaggtaacgttaactaaacggaacggtaccgtaaaccgtttaccgttaaccgtacccgtttaagggttaaccgttaacccggaaaccgtaaacgggtaaaaaccccggttcgggggaaccccgaaccgggtacccctacccgggtaacgggttcccctttacccgttaaccttacgttaccgttaaggttacggtaacctacccgtacccgaggtaccggaccggggtaccctaagggtcgggtaccgtacccgaccggttaccgttacggttacgaacggtccgggacggtacgggtaccgggtccgtacggggtaacctacggtacctttacccgaccgttacccgtacccctaacccgacgtacccggtacgtaccgttacccgttcccgtaccggtacccgttacgttaaccgtacggtaaacgtttacggtttccgaccgtttacgttttacgtaccggcgtaacccggcggtacccgtacggaccgtaacgtacggttccgtaacggtcccgggaccctttccggttacccgtacccggggttaacggggccgggtaacccggtaaccggaaggggttacggaacggttaccgtaacgggaaaccggtacggtcgggtaaccgtacgtaaccgccgttaacncggttcc

SEQ ID NO: 98066 - DNA, 655 bp, Homo sapiens
  misc_feature: GYAE6OF01E3CDY.24.67.G01.1.454.CMB.1.raw
  modified_base (202)..(202): a, c, t, g, unknown or other
  misc_feature (202)..(202): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaagtagtcatgacgcagtctccagcccacctgtctttgtctccgaggggaaanacgccaccctctcctgcacgggccagtgaacaattgttaggaagttgttagcctaggtatcaaacacaaacatggccaggcctccccggctcctcactctatggatcgcactaccgaagtacggggcccacgtggacctactccccgagaaccgtaggttcgaggttcggacgtaggtcgggggtctaggggacctacgtaccttacacctctaccacctataccgagtcgtaggtcggtaagcggtaccgttaaggtaagtttacgttttagacttagttttaactacttcgtactacgtacccgttaaccgttaacgtaacgtccggtacccgttaccggtttccgggtaccccggtagggtaaccctacggtaccgtacggacctacctaccgaaacgtacgtcgtggcctcgacctacacgttcgtcttaccttctacgttccgtcccg

SEQ ID NO: 98067 - DNA, 756 bp, Homo sapiens
  misc_feature: GYAE6OF01C3ZGP.24.67.G01.1.454.CMB.1.raw
  modified_base (202)..(202): a, c, t, g, unknown or other
  misc_feature (202)..(202): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtataagagcaactacttagcctggtactcaaacagaaacctggaccaggctcccgaggtcctcctcattctacgtggtatactccagcgacgggccacgttggtcgtcccaaggtccctagggttccaggttcggccgttaaggtcgggttacgtaggggaactaggtacggtttaccctaacgttccgtaacgtaacccgtattaccgaacggtcctaacggttcgtacgtacgtacgttaccggtaaggtaaacgtttagtttttaccgtacgtttaacggttttactttacgtaccggtaccgtacgtaccgtaacggcctaacgtacggttaccgtaaccgttccgggtacccgttaccggttaccgttaaccgggttttacccggggaccggggttaaaccgggggtaaccccgtaaaggggggttccggaaacgggttaacctaaacccgggtaaaaaccggttaaccgttcgggtaacgggttacccgttaggaccccgtaaccgttacgtttacccgg

SEQ ID NO: 98068 - DNA, 269 bp, Homo sapiens
  misc_feature: GYAE6OF01DQVQJ.24.67.G01.1.454.CMB.1.raw
  modified_base (264)..(269): a, c, t, g, unknown or other
  misc_feature (264)..(269): n is a, c, g, or t
tcagactactatgtcacgaccggtgctcgatttagagtatacatattgggtttgggacagagttcactctcaccatcagcagtctgcagtctgaagattttgcagtttattactgccagcagcacagtgactggccgctcacgtttcggcggagggaccaaggtggagatacaaacgaactggtgctgcaccatctgtcttcactctcccgctatctagaacatagtagtcgtggaggcgggcgtggcgaacggcgacgatagnnnnnn

SEQ ID NO: 98069 - DNA, 912 bp, Homo sapiens
  misc_feature: GYAE6OF01D0YY6.24.67.G01.1.454.CMB.1.raw
  modified_base (208)..(208): a, c, t, g, unknown or other
  misc_feature (208)..(208): n is a, c, g, or t
tcagactactatgtcacgaccggtgctcgatttagagtatacatattgggtttggggggaactgctcagttaggacccagacggaaccatggaagccccagcgcagcttctcttcctcctgctactctggcctcccagactaccactggaagaaatagtgatgacgcagtctcagcccacctgtctgtcgtctacggaaggggaaacncgccctaccctctccgtgacgacgggcctaggtcgaaggtaaagttaacgtaaaggaacgtacctaaacttaaccgttacgccgttaggtactaacgaaacgaaacgaaccgtcggaccgacggtaccctacccgacggtcccttaccgtactacgttacgttagttacggtaacttaccgtaccgacggtaccgtaaccggggccttacggttcggtaccgtaccccgaacggtaccgttacgggttcgaggttcggtacgggtaacgggttcggggtacggtacgggtaacgacggttacggtttacctacccggttacctacccggtaacccttacgtaccggtaacgtaccggttaaccgtttccggttacggtaccggtttaacgggttacgttaaacgggtttaacgttttaccgttttacgggttaaccgtttttaaaggttttaaccgtttacccggtaacggtaacccggtaactaccggaaccgttaaccgaaacggtttccggaaccggttaaccccgggttccgggtaccccgttaaccggttttacccgggttaaccgggtaacgggggtacccggggtaaacgggttaaaccgggtaacgggggtaacccgggtaacgtaaaccggtaaaccggtaaacggttacgtacggggttaccgacgttaacccggactttacgtacgtttcccg

SEQ ID NO: 98070 - DNA, 664 bp, Homo sapiens
  misc_feature: GYAE6OF01AM6GL.24.67.G01.1.454.CMB.1.raw
  modified_base (204)..(204): a, c, t, g, unknown or other
  misc_feature (204)..(204): n is a, c, g, or t
  modified_base (414)..(414): a, c, t, g, unknown or other
  misc_feature (414)..(414): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagcccaccctgtctggtgtcctccgaggggganagacgcccaccctctcctggcgagggccaggccggagtgttagtaagtacttaggctggtaccaacagaaacctggccaggcctcccaggcctcctcatctatgatcgtcctccaacgagggtccacgtcggcccgtccccgcgtaggttcagggtggctaggtcgggtcgtggggactaggtctttcgaccttccgtaccgacccggtnaagctacgccctaaggacgtccgtagtaacgttagttttcggtaccggttttactacgtgtaccgagtcgtacgtccgttccgcccgtcggtaccctaccgttaccggttccggggaccgggggtaccgaggggtaggaggacgggacggacgtaacggtcggtcggtacgtcggaccgaccgtagttccgttcgttccgtttacgttaccgttcccgttccccgtacctacgttaccgtacgtaaaccg

SEQ ID NO: 98071 - DNA, 761 bp, Homo sapiens
  misc_feature: GYAE6OF01DRF24.24.67.G01.1.454.CMB.1.raw
tcagactactatgtcacgaccggtgctcgatttagagtatacatattgggtttggggggaactgctcagttaggacccagacggaaccatggaagccccagcgcagcttctcttcctcctgctactctggctcccagataccactggagaagtagtcatgacgcagtctccagccaccctgtctgtgtctccgaggggaaagagccaccctctcctgcacgggccagtgagaatgttggcagcaacgttagcctgtaccagcaagaaacctggaccgaggcctcccacggtcctccctcctctatcgtctcgtcctcccgaccgacgggccctggtcgtcccagtccgtaggttcgtcgggcggttcggtcgtcgggactaggttactttaccgaccgttcctaccaccctacgttccgaacgggtcccgggtaccccttaccgtacggttaccgttaacggtaaacgtttaacgtttttacgtaccgttttaaccgtttttaacgttttacccgtttacgttaaccgttaaacttaaccgtttaggttacggttacggtaccgtttccgggttacccctttacccggttaaccgttaccgttttacgggacccgggtaacgggtaaaccctaaacggtacgggtacgtaacgtaaccgtaaaccggtaaacgttcggtacggtacccgttagaccctaaccgtaaccgttcgttaccgtttaccttaccgttactttcccccgttcccgtcccttaaacg

SEQ ID NO: 98072 - DNA, 632 bp, Homo sapiens
  misc_feature: GYAE6OF01BKYG1.24.67.G01.1.454.CMB.1.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcagcagctacttacgcctggtaccagcaacggaaacctggcctggcctcccgacggcctcctcatctagtggtcgccgtccaccgacgggccacgtggcgtcggcggacgtacggttcaggtggacgaggtggtcgtttgggactagtaccttcacttcctcatctactcgacncggacgtgggaccgaccgtaagttacgtttcgacgttaggttgttacgttactggttacgtgtttccgttggttttccgtcccttccgttccgttaccttatttaccgtaccgtttaccgtttcgggtccgttacggggtttcccaggggttcgtacgggtaagacgttaacgacggtacgtaacggttcggtacgggttatacggcccgtacgttacg

SEQ ID NO: 98073 - DNA, 715 bp, Homo sapiens
  misc_feature: GYAE6OF01EKR3J.24.67.G01.1.454.CMB.1.raw
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (260)..(260): a, c, t, g, unknown or other
  misc_feature (260)..(260): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccacgtgganaaatagtgatgacgcagtctccagccacctgtctgtgttcacggaggaancgaccncctctctgcgcgcagtacagtagtaagaagagtacaacttacgtacgcgtagtanaaccaacgaacggtaacctcggaccacggtccctaccggacgtccttacctactaattaccgtaggttaggttaactaccgtaccgaacggtcggacccgggtactcggttcggttaccaccccgagtaccggtacggttacgagttcgggacgtcgggttacggtcggtacggaatagggttaacttcccacttccgaaccctacgtagttccgacgtagtacgtgtacgtagtacgttacgtaaggtaagtttcgtttaactacgtttaagttacttacggacgaccgtacggtaacacgtacgtacgttacggtacgtaccgttacgccgtaccgttaccgttaccgggtaccgggtaacgggtacggtaacgggtaacgggtagtaaccgtaactaaaccggtaaaccggttggaccgggttcctacgaacgtaccctcggttagttccgg

SEQ ID NO: 98074 - DNA, 793 bp, Homo sapiens
  misc_feature: GYAE6OF01C3N0O.24.67.G01.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagactactatgtcacgaccggtgctcgatttagagtatacatattggggtttggggggaactgctcagttaggacccagacggaaccatggaagccccagcgcagcttctcttcctcctgcttactctggcctcccagactacccacgtggaagaaatagtgaatgacgcagtctccagcccacctgtctgtcgtctaccggaagggaaacncgccctaccctctccgtgcgacgggccagtcaggtatanaagagctaactactgctagtacacaacacgaacctgacctacggacctccgacgtcctcctctaacttacgtattaggtactacgtccgaggtaccggaacggtccctaacggttcggtaccgtcccaggtacccgtagggttcgaacggtcggacggtaggggttccggggttcggtacgggtaacgtacggttaaccggtttactaccttacccgtacgaaccctacgtaccgacgttccgtaacggtttccgtacggaccgttacggttcgttaaacgttaacggtttacgtttttcggaacgttttaaacggttttacctaaccgttcgggtaaccctaagggtaccctaacgggtacgttaaccggttacgggtaccttcgggtacccggtcccgttaacgttccgggttaacgggttccgggggaaacgggttacgggaaaccggtaagggttcggaaagttaaacccgtaaacggtaaaccggttacggttcggggtaacgtaccggtataaccccgtattccgggttacccg

SEQ ID NO: 98075 - DNA, 818 bp, Homo sapiens
  misc_feature: GYAE6OF01EHIR7.24.67.G01.1.454.CMB.1.raw
  modified_base (151)..(151): a, c, t, g, unknown or other
  misc_feature (151)..(151): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagataccactggaanaaatagtgatgacgcagtctccagcccaccctgtctgtcgtctaccgaaggggaaancgccaccctcncctgcgagggccagtcaagagtataaagaacgctaaacttacgttagccttaggtaactacaaacgaacgaaacccgtggaccaggccctacccgaggccttccgtactaacgttactaagttacggtaacttaacgtccgaaggcgacggggtacctaacggttggtccgtacccgaaggccgtacggtttcgaacggttcggacgtagggttcgggtacgtacgggtaactaacggtacctttacacccgtttccaccgtaacccgtacgtaacgaccgtaaccggtacccgttaaacggaaccgtaccggttagtaaaacggtttacgttttttacggtaacccggtttttaacgtaccgttaggtaccgtacggccgttaacgggttcccgtacccgttccggtaccggtacccggttaccggtttaaaccgggggtttcccgggggaaccggggggtaccggttaagggggtaacggggaacgggtaacgggtaacgggaaaaccgggtaggtttaacggggccgtacgttccggaaccctacgttacgtccgtttcggtttaccttcccgtaacctttcccgtcccgtacccg

SEQ ID NO: 98076 - DNA, 665 bp, Homo sapiens
  misc_feature: GYAE6OF01A2BJL.24.67.G01.1.454.CMB.1.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
  modified_base (328)..(328): a, c, t, g, unknown or other
  misc_feature (328)..(328): n is a, c, g, or t
  modified_base (476)..(476): a, c, t, g, unknown or other
  misc_feature (476)..(476): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatgtgatgacgcagtctccagcccacctgtctgtgtctcgaggggaancgcccacctctcctgcgagggccagtcaagtagtaataagaacgcaactacttagcctaggtacacaanacgaacctggacctaggcctacccgaggtccctcctacgacttctaagtggtaacttacncccgaggcgacgggccctagtgggtacctacccgagccctaagggttcacggtcggacgtagggtcgggtacgtagggaactaggtacgtttccactcgaccaaccgatacacgtactacgtctacggtctagtacgtagaacgtttntttcgtacttagtttaacgtacgtcgaccgtacgacgtacaaccgtacgtaggtaccgtacggtccggtcccgtacgttaccggtaccggttaccggggacggtaaccgggtaccgtaacggggtacgaacggtaacgtaaccgaaacgggtacgtacgggtacgtcggtacaccgtacgttagttccg

SEQ ID NO: 98077 - DNA, 574 bp, Homo sapiens
  misc_feature: GYAE6OF01C35R7.24.67.G01.1.454.CMB.1.raw
  modified_base (95)..(95): a, c, t, g, unknown or other
  misc_feature (95)..(95): n is a, c, g, or t
  modified_base (202)..(202): a, c, t, g, unknown or other
  misc_feature (202)..(202): n is a, c, g, or t
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (439)..(439): a, c, t, g, unknown or other
  misc_feature (439)..(439): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
tcagactactatgtcacgaccggtgctcgatttagagtatacatagttgggtttgggggaactgctcagttaggacccagacggaaccatggaancccagcgcagcttctcttcctctgctactctggctcccagataccactggataatagtgatgacgcagtctccagccaccctgtctgtcgtctaccgaggggaaaancgtcccaaccctgtcctgccgacgggccaggtccagagtataagaagctaatacttgcctggatcaacngaactgaccagctccgaggctcgtnatctatggtatatccgagcgaagggccctagtggtctccagtccaaggttcagtcggcgtaggtcgggtctagggaacctagtcgttacacgttctccaaacncgttaccaggtacacggtntacggcagtcgtagaacgttntttagtctagtttataccgtgaccngacgtcgactancgttacggntcgctacgtctacgttacggccggaaacggtccgaaggtcggaagtacctacgaaacgacgttgccggtacagtcgaaccctgttacgg

SEQ ID NO: 98078 - DNA, 861 bp, Homo sapiens
  misc_feature: GYAE6OF01C4WXJ.24.67.G01.1.454.CMB.1.raw
  modified_base (234)..(234): a, c, t, g, unknown or other
  misc_feature (234)..(234): n is a, c, g, or t
tcagactactatgtcacgaccggtgctcgatttagagtatacatattgggtttggggggaactgctcagttaggacccagacggaaccatggaagccccagcgcagcttctcttcctcctgcttactctggcctacccagactaccacgtggaagaaatagtgatgacgcagtctccacgccacccttgtctgtcgtcctaccggaaggggaaaacgcgccctaccctcgtccnggcgtacgggccagtacaagtagtaaacgtaaacgaacgacctaaaaccttacgttacgaccgttaggtactaacgaaacgaacgaaaaccgtcggaccgacgggtaccctacccggacggtcctccgtactacgttactaagttcgtacttcgtacctaaccgaacggtaacggggtacctaccggtccgggaccccggtacccccggtacgggtacgggtttaccgaaggggttccgggacggttacggggttcggggttacggttaacgggggaacctaacggggttaaccctttaccgtaccgttaccggtaccgtacccggtacgacggtaccgtaacgtacccgtaagtaacgggtaccgtaagggttaacgttttaacgttttaacgggtttaccgtttaacgtaccgttacggttaccggaacgaccgtaacgggttcccgttaccccgtcggtaccgtaccgtaaccggttacggttaccggggggaccgggggtacgaacggggtaggaacggacgggaagaacgggtacgtcgggtcgtacgggtaccacggtaccgttacgttacgtttcccggttacctttaccgtaagtttacccccgttcgaaccgttaacc

SEQ ID NO: 98079 - DNA, 727 bp, Homo sapiens
  misc_feature: GYAE6OF01E1GFJ.24.67.G01.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
tcagactactatgtcacgaccggtgctcgatttagagtatacatattgggtttgggggggaactgctcagttaggacccagacggaaccatggaagcccccagcgcagcttctcttcctcctgctactctggctcccagataccactggagaaatagtgatgacgcagtctccagccaccctgtctgtgtctccgaggggaaancgcccaccctntcctgcgagggccagtcagatataagancaactacttacgcctaggtatcaaacagaacctggccaggcctccgaggcctcctcatctagtgtatactccagcgacgggccacgttgggtcctacccagccgttacggttcaggtcggcgagggttcgggtcgtgggaaccaggtacgttccacgtcctacgacctagtcacgcgtacgtcgtcgtcgtagtacgttaggtaacgtttagtttttacggttacggttttaacttaccgtacgtaccgacgtaccgacgtaccgtaagtacggttccgtaaccgggtcccggtaccggttcccgttaccggttaaccgggttttacccgggggaacgggggtaaaccggggtaaacccgggttaaagggggtacgggtaaacggtaacccgttaaacccgggaaaaaccgggttaaccggttacggggtacggggtacccggtaccggtaacccgaacccgttaacggttcccggttttaccg

SEQ ID NO: 98080 - DNA, 793 bp, Homo sapiens
  misc_feature: GYAE6OF01CQAO9.24.67.G01.1.454.CMB.1.raw
  modified_base (720)..(720): a, c, t, g, unknown or other
  misc_feature (720)..(720): n is a, c, g, or t
tcagactactatgtcacgaccggtgctcgatttagagtatacatattggggtttggggggaactgctcagttaggacccagacggaaccatggaagcccagcgcagcttctcttcctcctgctactctggcctcccagccatccaccgggaggaatttggtgttgacgcagtctccaggcctaccctgttctttgtctccgaggggagagacgcccaccctctccgtcgcgacgggccaggtcaggtacgttgttacgcgagcacgacttacgttacggccgttacggtaccaggaccaacggtaaaacccttcgggacccgtgggtccctccccggaacgggtcccttcccctactacgtttaccgttaggttcgggtaccgtccgtacccaaccggtacgggccctaggttcggacccgtccgggacggtacgtagggttacgtagggtcggcgttaggggtcgggttaccgggttttaggggaaacctaccgggttacctttacccgtacgtttaccctacggtaacttacccgtagttaccggaacgtacgggtaaccgtcgggaaccggtaaccccggtaagtttacgtttcggactttaaggtagtttaccttacgtcggtacgttacgtcttttacgggttcgttccccttcttccgttactttacgttacgttaccgttttacggtttcggtaccggtttccgggttaccgngggttccgtaagggtacgtacgttaacgacgggtaccgtagtcgggtcgtacgtacgtacctaccgtgttccg

SEQ ID NO: 98081 - DNA, 665 bp, Homo sapiens
  misc_feature: GYAE6OF01AKO2G.24.67.G01.1.454.CMB.1.raw
  modified_base (149)..(149): a, c, t, g, unknown or other
  misc_feature (149)..(149): n is a, c, g, or t
  modified_base (250)..(250): a, c, t, g, unknown or other
  misc_feature (250)..(250): n is a, c, g, or t
  modified_base (536)..(536): a, c, t, g, unknown or other
  misc_feature (536)..(536): n is a, c, g, or t
  modified_base (637)..(637): a, c, t, g, unknown or other
  misc_feature (637)..(637): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactgganaaattttttaggatgacgcagtctccagccaccctgtctgtgtctaccagggggaaacagcccaccctctcctgcacgggcctagtcagagtataaggaanccaatacttagcctaggtaccagcaagaacctggcctcggactcccgaggccttccctccattcctagtggtcgaccgtccaccgtacgggcccacgtcgggccggtcggcggacgtaggttccaggtcggcgtaggtcgggtccgtttaggggactagtaccgtttcaccgtttcctaccgaccggttacgacgtcgacggtcctacggactcccgtaggtaaacgttggtttttacgaccgggttttactacgttaggtccttagccgtaccgtccggttcccnccgtacgggcccgtaccgttacggtttcccggggggcggggttaccgaggggtacggtaggaggtccgaggtacgtgggtacgcgtacacgtctaggttcncgttccacgttactccgtcccgtcctag

SEQ ID NO: 98082 - DNA, 766 bp, Homo sapiens
  misc_feature: GYAE6OF01CM93N.24.67.G01.1.454.CMB.1.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (485)..(485): a, c, t, g, unknown or other
  misc_feature (485)..(485): n is a, c, g, or t
  modified_base (539)..(539): a, c, t, g, unknown or other
  misc_feature (539)..(539): n is a, c, g, or t
tcagactactatgtcacgaccggtgctcgatttagagtatacatattggggtttggggggaactgctcagttaggacccagacggaaccatggaacgccccagcgcagcttctcttcctcctgctactctggctcccagataccactggaagaaatagtcaatgaccgctagtcctccaacgcccacccttgtctggtacgtccgtaccgaagggggaaaacncgtacccctaccctcgtccnggaccgaggggccaggtagaagtagttggtacgcaagactaaacgttagccgtacggtaaccagaccgaacggtaaaccgtcggaccgtaaggcccgtacccgaaggtcccttacccgtacccttacgtagtccgtccttcgtaccctacccgaacggtcccgggtccctagggtccgtaccccgaagtcccggttagggttccggtgggtcggtcggtacgagggactacgttcgttaccncgttccaactaccgagccgtaggcccgtacctcgaacgtacgttagaacggttnttttacggacttttacttttacttacgacgtaacctataacgtgttacggacgtacgtcggtaccccttacggttaccgttacggttccggaaacccgtacggggtaaacccaagggttacggacaaccgttaaagtaaccgtacggtttaggaccggactacccggctaaacccttacgttaacgttcgttaccttacctaccgtttccccgtacccgtcgtaacg

SEQ ID NO: 98083 - DNA, 709 bp, Homo sapiens
  misc_feature: GYAE6OF01AO284.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtataagagcaactactagcctgtatacaacagaacctggaccagcctcccgaggcctcctcatctatggtatactccgagcgagggcctacgtgggtcgtaccccaggccgtaaggttccaggtcggctagggttcggggtacgtggggaacctagtaaccggtttccaaccgttcctaaccgacctatccgtaacggccttaagttccgtagtaccgtaggttacgtagggtaaactttagttttacggtactttagtttttaacgttacgtcggtaccctagaccgtagtaccgaacgttaggtacgttaaccgtccgggtacccttccggttacccgttacgggttttacggggacccggggtaacggggtaaaccggtaacggggtaacgggtaaccgtaacgtaaccgggaaaaaccggtaggttaccggtcggttacccgtaccgacccggtaaacccgttgttaccccgg

SEQ ID NO: 98084 - DNA, 812 bp, Homo sapiens
  misc_feature: GYAE6OF01DR769.24.67.G01.1.454.CMB.1.raw
  modified_base (204)..(204): a, c, t, g, unknown or other
  misc_feature (204)..(204): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggaagaaatagtgatgacgcagtctccagccaccctgtctgtgtcctacgaggggaaanagcccaccgtctcctgcgagggccagtcagagtaataagaacgactaactacgttagccgtaggtatacaacacgaaaccgtggaccaggcctccgacggcctacctcacttacgtagttaggtaactagtcccgagacgacgggcctacgttcgggtccgtaccccgaggaccgttaggtaccgaggtcggacgtacgggtcggggttcggttacggggaactaacgggtaaccgttccgtaaacctttccgtaacccgtacctaacggtttaccaacggtaccgtacggtttacgttaccggtaccgttaacggtttacgttaaagggtaaacgtttaacgtttttacggttacgttttaacggtttttaacgtttacccgttacgtaacgtaaccgtaccgtaaccgtaacacggttaacggtccgtaaccggtaccgggtacccgttacccgtacgttaaccgggttaccggggtaacgggtaaaccggggtaaccgggtaacgggtaacgggttaaggtaaccggttaacccggtaaaaaccggtacgttaccgggttacgggttacccggtacggtaacccgtaaccggtacgttaacccgg

SEQ ID NO: 98085 - DNA, 820 bp, Homo sapiens
  misc_feature: GYAE6OF01CQTPO.24.67.G01.1.454.CMB.1.raw
  modified_base (203)..(203): a, c, t, g, unknown or other
  misc_feature (203)..(203): n is a, c, g, or t
  modified_base (548)..(548): a, c, t, g, unknown or other
  misc_feature (548)..(548): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggaagaaatagtgatgacgcagtctccaggccaccctgtctttgtctccgaggggganagacgcccaccctctcctgcacgggccagtcagagtgtagcagcagctactagccgttggtaccagcaacgaaccgtcggcctacggcctccgacgtcctctacactctagtggtcgccgtacccgacgcgggacctacgtcggcgtccggcggtacgtacggttcgaggtcggcgtaggttcgggtcggtttacgggaacacgttacttccgacttcgactacgtcgtaacgtaccggtacaacggtaacggtacgggaaccggtaaccccggtaaaaggtttacgtttttacgggaccgttaagggtttaccgtttaaagtttaaacccgttcgggtttaacncggggttttaccgtttttcggggtttttacccgttacccccgttttcccttttaaccccggtttccgttaacggtttttaacccgttaccccggtttttacggttttacccgggtaacccggggttttaacccggggttacccgtaacgggggttccggttaaggggaaccggttaaccggtaaaccgttaaaccgggttaacccggttaaacccggttttggggttaaccttttccggtaaccggtaaccccgttaaccggtttaacccgg

SEQ ID NO: 98086 - DNA, 761 bp, Homo sapiens
  misc_feature: GYAE6OF01CTICO.24.67.G01.1.454.CMB.1.raw
  modified_base (524)..(524): a, c, t, g, unknown or other
  misc_feature (524)..(524): n is a, c, g, or t
tcagactactatgtcacgaccggtgctcgatttagagtatacatattggggtttgggggaactgctcagttaggacccagacggaaccatggaagcccagcgcagcttctcttcctctgctactctggctcccagactaccactggaagaaatagtgatgacgcagtctccacgccaccctgtctgtcgtcctaccggaaaggggaacacgccctaccctctccgtagccgaacggggccagtacgaaggtaagtaaagtaaaacggaacgtaccaaacgttactacgtaccgtaggttaacctacaaaacgtaacgaaaccgtcggaccaacgggtccctcccgaaggtccttacctacgtaaactttcgtaaggtagttactaaccgttaccgacggaccggtacgggacccttaaacggttcgggtaccctacccggacgtaccgtagggttccgaggtacgcgtacgggggtcgttacgaacggggactaggtacgttaccacggttaccacaaaccgtntaacggacgtacgtagtcgtacgtacgtacgtacgttaaggttacgtttacgttagttacgtttaacgtttacgtacgtcgtacgtagaacgtagacgaacgtaggtacgtacgtaccgtaccgttacgtaccggtacggttacgggaccgggtaacgggtacggtaacgggacggtaacggtaacgtaacggtaacggtacgtaggtccgtaacgtaccgtactaccgtacgtacg

SEQ ID NO: 98087 - DNA, 745 bp, Homo sapiens
  misc_feature: GYAE6OF01B07YI.24.67.G01.1.454.CMB.1.raw
  modified_base (221)..(221): a, c, t, g, unknown or other
  misc_feature (221)..(221): n is a, c, g, or t
  modified_base (272)..(272): a, c, t, g, unknown or other
  misc_feature (272)..(272): n is a, c, g, or t
  modified_base (437)..(437): a, c, t, g, unknown or other
  misc_feature (437)..(437): n is a, c, g, or t
  modified_base (691)..(691): a, c, t, g, unknown or other
  misc_feature (691)..(691): n is a, c, g, or t
tcagactactatgtcacgaccggtgctcgatttagagtatacatatttgggggtttgggggggaactagctcagttaggacccacgacggaaccatggaagccccacgcgcagcttctcttcctcctgctactctggctcccagataccactggagtaaatgtggatgacgcagtctcacgccctaccctggtctcgtacgttcgtaccgggagggaaacncgcccgtaccctctccgtgcgcgggtccaggtcaggagtaacgaagtaacnctacttacctaggccttggtactaccgaacgtaacggaaccgtgggacccaaggtccctacccgacggtcctcctacacgttcgtaacgtacgtaattaccgtaccgaggtccgacggggtcctaaccgtcggtccgtaccgacggtcgtggtaccgagggtcgngttaagggttcgggtcttcgggtaacgacgtacggtacctacgttacaccgtaccacttcgaacgtcgtaacggttcgtacgacccggttagttaccgttacggtttaaacgttcggtttaccggttaacgtttacggttttaaccgtttaccgtaccggtacggtacctacgggaccgtaacgtaaccggtacgtccgggtaccgtcggtacccgtcggttacccgtacggttaccgggccgggtaaaccggngttaacggccggtaatccgtaacgaccgtagtcgtacgcgtacgctagtcgtcg

SEQ ID NO: 98088 - DNA, 800 bp, Homo sapiens
  misc_feature: GYAE6OF01A20A3.24.67.G01.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (783)..(783): a, c, t, g, unknown or other
  misc_feature (783)..(783): n is a, c, g, or t
tcagactactatgtcacgaccggtgctcgatttagagtatacatattgggtttggggggaactgctcagttaggacccagacggaaccatggaagccccagcgcagcttctcttcctcctgcctactctcggctcccagactaccactggaagaaatagtgatgacgcagtcctaccacgccaccctgtctgtntctccgaagggaacncgccctaccctctccgtgccgacgggccagtccaagtagtaataagaacgtctaaaccgtttacttaagcccgttaggtaactaccaaacgtaacgtaaaacccgtggaccgaacggtacctacccggaaggtcccttaccgttacacgttacgttaagttacggttacttaaccgtaccgacgaccggtaccgggcctaacggtcggtaccgacccgagtacggtacggttacgaggtcgacgtaggtcgggtacgtcgggaactacggtacgtttccaaccgtttcgtaacccgacgttaacgttacccgagggtaccttagggttcctacggtacggtaagttacgttaacggtaaagttttccgggttttacacgtttttaaaggtttacccttaacgtaccgtacccgtaggtaccgtaaccgggtaaccttaacgtagggtacccgttaccgggtaccgtaacccgtccgtttaccggttaccgggtacggggaccgggtaacgggtaaccgagggttaggaaccgtaacgttaaccggaacggtacggttggtccggacgttaaccncctaaacgtgtttccgg

SEQ ID NO: 98089 - DNA, 797 bp, Homo sapiens
  misc_feature: GYAE6OF01CGR3R.24.67.G01.1.454.CMB.1.raw
  modified_base (151)..(151): a, c, t, g, unknown or other
  misc_feature (151)..(151): n is a, c, g, or t
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
  modified_base (510)..(510): a, c, t, g, unknown or other
  misc_feature (510)..(510): n is a, c, g, or t
tcagactactatgtcacgaccggtgctcgatttagagtatacatattgggtttgggggaactgctcagttaggacccagacggaaccatggaagccccagcgcagcttctcttcctcctgctactcgtggcctcccagactaccagtgganaaatgtgatgacgcacgtctccacgcccaccctgtctggttctaccgtcggaaaggggaaacnccgtcccctaccctctccgtacgaccggtaacggggcctaaggttaccgaggtaagttaanaaacggaacgtaccctaacgttacctttagaccgttaggtaactaccgtaaacgaaccgtaaccggtaggacccgtacggtacccgccccgtaaggtccctaccttacacttacgtatacggtaatccgtacacggtcgaccggtccgagttccggaacttcccggacgtacgtcggtcaggtcggacgtgggtccggtggacgtacgattcctttacaccgtctacaccgttanccgacgtccgtacctccgtacgtacgttaagtagttaccgtttcgtacgtttactttacgttacgttaccgtactaacgttacgttacgttacggtacggtaccgttaccgttccccgttacggttaacccgtttccgggttacgggtaccccggtaaccggggtaaccctaaaggtttaccggaacgtaaccgttaaacccgggaacgttaccggtacggaccggttaccgtaccgtacccgttaaaccgtccgtttacgtaccttcggttcccctttaaccccgg

SEQ ID NO: 98090 - DNA, 859 bp, Homo sapiens
  misc_feature: GYAE6OF01ASVVT.24.67.G01.1.454.CMB.1.raw
  modified_base (219)..(219): a, c, t, g, unknown or other
  misc_feature (219)..(219): n is a, c, g, or t
tcagactactatgtcacgaccggtgctcgatttagagtatacatattggggtttgggggggaactgctcagttaggacccagacggaaccatggaagccccagcgcagtcttctcttcctcctgctacctctggcctcccagactaccactggaagaaatagtgagtgacgcagtctccacgcccacccgtgtctgtcgtcctaccggaaggggaaacncgcccctaccgtctcccgtgcggaggcccagtcaggtagtgtacgcgacgacgacgtaccttaacgttacgccgtacggtacctacggaccgtaaaccggtaacccggtcgggtccgttaccgggccctccccggacggtcccttccctacgttacgtaccgttaggtcgggtaccggtcccggtacccgaaccggaccgggtacccgttacgggtaccgggtccggggtccggaaccgggtaacggtacggttcggtacgggtcggtacggtacgggttcgggtaccgggtttacggggaaccttaccggtacccttacggtccctactaccgttacgtaactacgtaccgtacggtaccggtacggaaccgggtaccgtaacggttattcggtaacgttgttaacgttagttacttacggtgttaccggtcgtttaccgggtttaccgtttccccgtacctttcccgttaccgtttaccggttaaccgttaccggttttacccgtttccggggtaaccgggttccgttaaccgggttacgggtacccggttcgggtaaaggttacccgtaacggtaccggtaaaccggttcgtaccgggtacggtacccgtaccgttaccgaccgtttccgttacccg

SEQ ID NO: 98091 - DNA, 793 bp, Homo sapiens
  misc_feature: GYAE6OF01CGU4I.24.67.G01.1.454.CMB.1.raw
  modified_base (155)..(155): a, c, t, g, unknown or other
  misc_feature (155)..(155): n is a, c, g, or t
  modified_base (228)..(228): a, c, t, g, unknown or other
  misc_feature (228)..(228): n is a, c, g, or t
  modified_base (380)..(380): a, c, t, g, unknown or other
  misc_feature (380)..(380): n is a, c, g, or t
tcagactactatgtcacgaccggtgctcgatttagagtatacatattgggtttgggggaactgctcagttaggacccagacggaaccatggaacgccccagcgcagtcttctcttcctcctgcctactctggcctcccagactaccacgtggaanaaatgagatcgacgctacgtcctacccacgcccctacccgttgttcgtgtcgtaccgtacggaaggggaaacnccgtcccctaccgtcctcgacgcggacggtaccagtacgtaaggagttaaacgtaacggaacgtaacctaacgttaccttaggtccgttaagtaactaacaaaaccgtacggaaccggtcgacccgacggccctaccgacgtcctccgtacngttactaggttagtatcacgacggcgaccgtccacgttcggctacccgagtaccgtagttccgaggtacgcggtagggttccggtaggtacggtaaccgtagtccgtttacacgttccactaaccgtctacgacgtctaccgttagcccgtaaggtcgttaaggtacgttagttcgttttagacgttttaagttaccgtacgtacgaaccgtcgtaaccgctaacggtaacgtcgggttaaccgtccgttcccggtacccgttccggtttaacccggtccgggttaaaccggggaccggttaaacgggacccggggtttaaaagggaccggtaacctaacccgggtaaaacgtaaccgggggtcgttccggtaacggtaaccgacccgttaccgtaaccgttcgtttaccccg

SEQ ID NO: 98092 - DNA, 700 bp, Homo sapiens
  misc_feature: GYAE6OF01AYZY8.24.67.G01.1.454.CMB.1.raw
  modified_base (95)..(95): a, c, t, g, unknown or other
  misc_feature (95)..(95): n is a, c, g, or t
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
tcagactactatgtcacgaccggtgctcgatttagagtatacatattgggtttggggggaactgctcagttaggacccagacggaaccatggaanccccagcgcagcttctcttcctcctgctactctggctcccagataccactggagaaatagtnatgacgcagtctcacnccacctgtctgtgtctcgagggaacncgcccacctctcngcgagggccagtcagagtanaagaacgctaactactacgtcctaggtactacaacaacgtaaccgtcggccacggcctacccgacgccctcctcactcgtagtggttatactccgagccggacgggcctaggtcggtcctcccgagtcccgtaggttcgagtcgggactcgggttagggttcgtaggaccgtagttcgtaccgtaaccgtcctaccacccgtacttccgacgtccgacgttcgtacgactacggttaacgtaacgggttaatttagtttagtaaccgttttaagtttaccttacgtaccgacgttaacgaccgtaccctagtaaccggtaacgtcgtaccgggcccgtaacccgttccgttacccggttacggttacccggggaagggtaccggaaccgggtaagggtacggttaaggaaacgtaccggtaaaacgggagttccggtaggtaccgaccggtacccttcgtagttcccg

SEQ ID NO: 98093 - DNA, 702 bp, Homo sapiens
  misc_feature: GYAE6OF01BQTXR.24.67.G01.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (590)..(590): a, c, t, g, unknown or other
  misc_feature (590)..(590): n is a, c, g, or t
  modified_base (596)..(596): a, c, t, g, unknown or other
  misc_feature (596)..(596): n is a, c, g, or t
  modified_base (688)..(688): a, c, t, g, unknown or other
  misc_feature (688)..(688): n is a, c, g, or t
  modified_base (695)..(695): a, c, t, g, unknown or other
  misc_feature (695)..(695): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggaagaaatagtgatgacgcagtctccagccacctgtctgtntctcgaggggaanacgccaccctntccgtgacacggggccagtccgagaacgttaataaaggaacgcctaaacgttacgtttacgccgttggtaactaccaaaacgtaacggaaacccgtgggaccgaacggtcctacccggaggtccttccctacgtacttacgttaacggttggttaacttaccgtccgaaggtaccggacggggtccctaacggttcgggtaccgtacccgtacggtacccggtaggtttccgaaggttcgggaccgtaggggttcggccgttacggggaactaggttaacgtttccacgttcctacgaccgtagttacacgtctacgtcctacgacttacgtacgttagaagtttacgtttgacgtttagtttaactcgtacgcggaancgaacncgacgtaggcgtcgtccggactctaccgtggtccgggacggtacggaacggtagtccggaataacgttacgaactaggttcgacgtcgtacnccgtacncgttacg

SEQ ID NO: 98094 - DNA, 830 bp, Homo sapiens
  misc_feature: GYAE6OF01EQ21X.24.67.G01.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (378)..(378): a, c, t, g, unknown or other
  misc_feature (378)..(378): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctccagccatcacggagattgtgttgacgcagtctccaggcacctgttctttgtctcgagggganagacgccacctctcctgcaggccagtcaagngttgtacgcagcagtacttacgtacgcctggtaccagacaacgtaacctggccgttaggcctaccgacggccttccgtacagttctacgttggtcgccgtaccacggtacggcctaggtcgtacgtcgcggacgtcggttaccgaggtccgngtagggtttcggtaccggttttagggaacccgttaagttcccgtttaccgaacctttccgtacgtaacgttaccctaacggttccggaaaccgtaacgggtacgttacgggtaacccgggttaccccgttaaaaggtttcggttttacggaaccggttaggtttacggtttaacttttaccgttacggttacctaacgggttttccggtttaccgggtttttacccggtacccttttcccgtttacccgtttaacccgtttaacggtttcccgtttaaaccggttttaccgggtttttaacccgggccgggtttaacccggggtttccggtaaccggggttaccggttaacggggtaaccgtttaacgaaccggttaacccggtaacgggttaacccggttacgggttacggtacccggtacgtaaccccgttaacgttacgttttaccccg

SEQ ID NO: 98095 - DNA, 699 bp, Homo sapiens
  misc_feature: GYAE6OF01B8614.24.67.G01.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagcccatcgaccggaggaattgtgttgacgcagtctccaggcaccctgtctttgtctccgagggganagagccaccctctcctgcagggccagtcagngtgtagcagcagctacgtagcctaggtacagacaacgtaaacctggcctggcctcctaggctcctagtatctagtggtgccgtccaccgagggcctacgnggtcgtacgcggtactaggttccaggtcggactaggttcggtacttttacggggaacctaggtaacccgtttcgaaccgttacgtacgtaacgttacgaacttaccggaactaacgggtaccgttacgggaaccgtaccccggttaaagttacgttttcgacgttaagttggtttaacttacggttagtacgtacgttacgtttcgggtttacgttccccttacgttacccgttaccttacgtttacgttaccgtttaccggttttcggacccggtttacgggttcctaacggtcgttaagggtaacgttataaccggtagtaccgtaagtcgggttacgacccgtagtacccgtatcgtttaacg

SEQ ID NO: 98096 - DNA, 967 bp, Homo sapiens
  misc_feature: GYAE6OF01B2H09.24.67.G01.1.454.CMB.1.raw
tcagactactatgtcacgaccggtgctcgatttagagtatacatattgggtttgggggggaactgctcagttaggacccagacggaaccatggaagccccagcgcagcttctcttcctcctgctactctggctcccagataccactggagaaatagtgatgacgcagtctccacgccaccctggtcctgtcgtactaccgaaggggaaacgtcgacccacccctcgtcctgaccgacgggacccaagtacgaacggtaagtaaactaaaaggaaacgacctaaaaccgtttaaccttacggtaccgttaggttaactaaccaaaaccgaaacggtaaaaacccgttcgggaaccccgtaacgggtacccgtaccccggtaacgggtaccccttaccccgtaccgtaaactttaccgttaaggttacgggttaaacttaaccttacccggaacggtaaccgggtaacggtaccccgtaacgggttcggttaccgttaaccccgaacggtaaccggttacgggtttaccgtacgggttacgggaccgtaagggggttcgggttccgggtaacggggtaaacccttgggaaaccgtttccggtaaccttaccggtaccctaacccgtaacgttccgtaacgtacgtaacggttaccgtaggaacggttacgttacggtaagtaaacggtttacttttacgggtacggtttaaacttttacggtttaaccgtccgtaaccgtaacggggactaacggtaaccgaaccgttaagggttaacccgttccggtaccgggtaccgtacccgtttacggttaacccgggttaccggggtaacccggggtaaacggggtaaccgttaaacggggtcgggtaaacaacgggtttaaaacccaaacccggggtttaacggttacgggttacgggtaaccccttacgggtaaccctaaaccccggtagtttaaccccggg

SEQ ID NO: 98097 - DNA, 682 bp, Homo sapiens
  misc_feature: GYAE6OF01EECTU.24.67.G01.1.454.CMB.1.raw
tcagactactatgtcacgaccggtgctcgatttagagtatacatattgggtttgggggggaactgctcagttaggacccagacggaaccatggaagccccagcgcagcttctcttcctcctgctactctggctcccagataccactggagaagtagtcatgacgcagtctccagccaccctgtctgtgtctccgaggggaaagacgcccaccctctcctgcagggccagtgagaatgttggcagctaacgttacgccgtggtaccagtcaacgaaacctggaccaggcctacccacgggccttcccgtcctcgtatcgtctcgtcctcccaccgacgggcccctgggtcgtccccgacgtccgtacgggtttcggttcgggtcgggttcgggtcgtcgggactagtactttcacttctacaccactcgacgccggcctaccagtctagagttactttcgacttactttactttctgttaccaactactagttcggtcgtacgtcggtcccttaccgtaccttacgtttcggacccgtaacggggtaacccaagtacgggtaacaacgttaaccgaaaacggtaccgttacggttaccgggtaccttagaccccgtaaccttacgttccggttacctttccgttacccttacctttccccggtttaccccgtcgttaaacccg

SEQ ID NO: 98098 - DNA, 255 bp, Homo sapiens
  misc_feature: GYAE6OF02I7OHW.24.67.G01.1.454.CMB.1.raw
  modified_base (253)..(255): a, c, t, g, unknown or other
  misc_feature (253)..(255): n is a, c, g, or t
tcagactactatgtcacgaccggtgctcgatttagagtatacatattgggtctgggacagagttcactctcaccatcagcagtctgcagtctgaagattttgcagtttattactgccagcagcacagtgactggccgctcactttcggcggagggaccaaggtggagatcaaacgaactgtggctgcaccatctgtcttcatcttcccgccatctgaacatagtagtctgagcgggctggcaaggcgcatagnnn

SEQ ID NO: 98099 - DNA, 497 bp, Homo sapiens
  misc_feature: GYAE6OF02IYRVY.24.67.G01.1.454.CMB.1.raw
  modified_base (200)..(200): a, c, t, g, unknown or other
  misc_feature (200)..(200): n is a, c, g, or t
  modified_base (425)..(425): a, c, t, g, unknown or other
  misc_feature (425)..(425): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtataagaagcaactacttagcctggtatcaacagaaacctggccaggctcccaggctcctcatctatggtatatccagcagggccactggtgtcccagccaggttcagtggcagtggtctgggacagagttcactctcacctatcacgcagtctgctagtctgaagtattttgactagtttattactgccagcanccacagtcgacgtggccgctcactttcggcgaggacaggtggagatcaaacgactgtcggctgctaccatcg

SEQ ID NO: 98100 - DNA, 520 bp, Homo sapiens
  misc_feature: GYAE6OF02GQPEG.24.67.G01.1.454.CMB.1.raw
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtataagaagcaactacttagcctggtatcaacagaaacctggccaggctcccaggctcctcctctatgctgtctccaccagggcccctggtcgtcccagccaggttcgtggcggtggtctggggacagatttcactctcaccatcagcgcctcagtctgaagtatttgctactttatttctgtcaactactatggtgactggcctccgtactacgttttcggccaggggaccaaacgtggagatacgaaacgactgtggctgcaccatctgtcttcatccttcccgctac

SEQ ID NO: 98101 - DNA, 491 bp, Homo sapiens
  misc_feature: GYAE6OF02F80HA.24.67.G01.1.454.CMB.1.raw
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtataagaagcaactacttagcctggtatcaacagaaacctggccaggctcccaggctcctcatctatggtatatccagcagggccactggtgtcccagccaggttcagtggcagtggtctgggacagagttcactctcaccatcagcagtctgcagtctgaagtattttgctagtttattactgccagcagcacagtgactggccgctcactttcggcggagggaccaagggtggagatacaacgatgtggctgcacatcg

SEQ ID NO: 98102 - DNA, 256 bp, Homo sapiens
  misc_feature: GYAE6OF02G8JAH.24.67.G01.1.454.CMB.1.raw
  modified_base (253)..(256): a, c, t, g, unknown or other
  misc_feature (253)..(256): n is a, c, g, or t
tcagactactatgtcacgaccggtgctcgatttagagtatacatattgggtctgggacagagttcactctcaccatcagcagtctgcagtctgaagattttgcagtttattactgccagcagcacagtgactggccgctcactttcggcggagggaccaaggtggagatcaaacgaactgtggctgcaccatctgtcttcatcttcccgccatctgaacatagtagtctgagcgggctggcaaggcgcatagnnnn

SEQ ID NO: 98103 - DNA, 509 bp, Homo sapiens
  misc_feature: GYAE6OF02HGRKE.24.67.G01.1.454.CMB.1.raw
  modified_base (198)..(198): a, c, t, g, unknown or other
  misc_feature (198)..(198): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagccatcaccggaggaattgtgttgacgcagtctccaggcaccctgtctttgtctccagggganagagcccaccctctcctgcagggccagtcagagtgttagcagcagctacttagcctggtaccagcagaaacctggcctggctcccaggctcctcatctatggtgcgtccaccagggccacgtggcgtcgcggacaggttcagtggcagtggctttgggacagacttcactctcatcatcgacagactggacgccgaagatttgctagtgttattactgtcagtctgtttcgtccctctcctctatctactactttcggcctaggttccaggtctggagatcgaacgtcgagtcgtcgcgtcgacgactatc

SEQ ID NO: 98104 - DNA, 509 bp, Homo sapiens
  misc_feature: GYAE6OF02H4G76.24.67.G01.1.454.CMB.1.raw
  modified_base (201)..(201): a, c, t, g, unknown or other
  misc_feature (201)..(201): n is a, c, g, or t
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagcccaccctgtctgtgtctccaggggaaanagccaccctctcctgcagggccagtcagagtataagaagcaactacttagcctggtatcaacagaaacctggccaggctcccaggctcctcatctatggtatatccagcagggccacgtggtcgtcccagccaggttcagtggcagtggtctgggacagngttcactctcacatcagcagtctgcagtctagaagtattttgctagttttatactgcagcagcanagtgacgtcggccgtctctacgtttcgggacggagggaccgtagggtggagatacgaaacgtacgtggtcggctgcaccatcg

SEQ ID NO: 98105 - DNA, 499 bp, Homo sapiens
  misc_feature: GYAE6OF02I0GSX.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagaagcaactacttagcctggtatcaacagaaacctggccaggctcccaggctctcatctatggtatatccagcagggccactggtgtcccagccaggttcagtggcaggtgggtctgggacagagttcactctcaccatcagcagtctgctagtctagaagtatttgctagtttattactgccagcagcacagtgctcggccgctctacgttcggcggaggaccgaagggtggagactacgaacgacgtgtcggctgcacatcg

SEQ ID NO: 98106 - DNA, 256 bp, Homo sapiens; identical to SEQ ID NO: 98102
  misc_feature: GYAE6OF02FWO6Q.24.67.G01.1.454.CMB.1.raw
  modified_base (253)..(256): a, c, t, g, unknown or other
  misc_feature (253)..(256): n is a, c, g, or t

SEQ ID NO: 98107 - DNA, 523 bp, Homo sapiens
  misc_feature: GYAE6OF02H1VGR.24.67.G01.1.454.CMB.1.raw
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagccggagtgttagtaagtacttaggctggtaccaacagaaacctggccaggctcccaggctcctcatctatgatgtctccaacagggtcactggcgtccccgcaggttcagtggcagtgggtctgggacagacttcactctcaccgtcagcagcctagagcctgaagtattttgcggtttactactgtcagcagcgttccgcctggccgctaacgtttcgggcgggggaccgaggggtggagagggacgacgaacgtgtggctgcacgatctgtcttcatccttccgcctatctgactag

SEQ ID NO: 98108 - DNA, 523 bp, Homo sapiens
  misc_feature: GYAE6OF02GCNTU.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagaagcaactacttagcctggtatcaacagaaacctggccaggctcccaggctcctcatctatggtatatccagcagggccatggtgtcccagccaggttcagtggcagtgggtctgggacagagttcactctcaccatcagcagtctgcagtctagaagtattttgctagtttattactgcagcagcacagtgacgtcggccgtctcgtacgtttcgggacgggacgggaccgaagggtggaaggtacgtacgaaacgaacgtaggtcggcgtgacgtaccagttccg

SEQ ID NO: 98109 - DNA, 732 bp, Homo sapiens
  misc_feature: GYAE6OF02I8DNY.24.67.G01.1.454.CMB.1.raw
  modified_base (495)..(495): a, c, t, g, unknown or other
  misc_feature (495)..(495): n is a, c, g, or t
tcagactactatgtcacgaccggtgctcgatttagagtatacatatttggggttttggggggaacctgctccaggtttaggaccccagagggaacctatggaagtccccagctcagcttctcttcctcctgctactctggctcccagagaccaccggagaaattgtgttgacgtacctagttctccaggtacaccctgtctttgtctccgaggggagaggagcccgacccttcggtcctgtcagggccaggccgggagttcgttagaagtaccttaggccttgggtaccaacagtaaaccctgggacccaggtccttcccgaagggtcccttcctcgaattcctaattgagttcgtacctacccaaacgaggggttaccgaccgttgggccgtcccccggcctagggttccaagttcggactacggttggggtctggggacaggtactttacaacttctcaccggtcaggcgaggcctaagcgccgtagtaagtnttttcggacggttttacctacgttcgtacaagcgtacgtccgtttcccgcgttcggaccgtacgttaaccgtttccgggaccgggggtaccgaggggtaggaggacgggaacggaacggtaacgtggttacggtccgtacgtacctaccgtatttccggttggttcctttccgtacgtttcccgtttaccccggcccgttaacgttccgttacggaaccgttacgttacggttacgg

SEQ ID NO: 98110 - DNA, 509 bp, Homo sapiens
  misc_feature: GYAE6OF02GCXGP.24.67.G01.1.454.CMB.1.raw
  modified_base (200)..(200): a, c, t, g, unknown or other
  misc_feature (200)..(200): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtataagaagcaactacttagcctggtatcaacagaaacctggccaggctcccaggctcctcatctatgtatatccagcagggccacgtggtcgtcccagccaggttcagtggcagtgggtctgggacagattcactctcaccatcagcagtctgcagtctgaagtattttgctagtttattactgtcagcagcacgagtgacgtggccgtctctacgttcggcggaggaccgagggtcggaagacgtacgaaacgtacgtggtcggcgtgctacattcg

SEQ ID NO: 98111 - DNA, 594 bp, Homo sapiens
  misc_feature: GYAE6OF02GE3EQ.24.67.G01.1.454.CMB.1.raw
  modified_base (202)..(202): a, c, t, g, unknown or other
  misc_feature (202)..(202): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtataagaagcaactacttagcctggtatcaacagaacctggccaggctcccgaggctcctcctctatgctcgtcctccaccgacgggcccctggtcgtcccagccgtagggttcgttgggcggttcgggtcgtggggactaggtacttttcaccttctaccacctacttcgacggccggtccctccgacgttctagtaagtacttttcgcttacttttatttctgtactaactactagttggtgtacgttcgtccgttacgttactacgtttcggaccgtacgggacctaacgtgacgtatacgaaacgtacgtggtcggtctcgaccactagtcgtcgtccttactactcccttccgctac

SEQ ID NO: 98112 - DNA, 502 bp, Homo sapiens
  misc_feature: GYAE6OF02JEXZY.24.67.G01.1.454.CMB.1.raw
  modified_base (200)..(200): a, c, t, g, unknown or other
  misc_feature (200)..(200): n is a, c, g, or t
  modified_base (322)..(322): a, c, t, g, unknown or other
  misc_feature (322)..(322): n is a, c, g, or t
  modified_base (396)..(396): a, c, t, g, unknown or other
  misc_feature (396)..(396): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtataagaagcaactacttagcctggtatcaacagaaacctggccaggctcccaggctcctcatctatggtatatccagcagggccactggtntcccagccaggttcagtggcagtgggtctgggacagagttcactctcaccatcagcagtctgcagtctgaagtnttttgcttagtttattactgccagcagcacagtgacgtcggccnctctacgtttcgggcggagggaccagggtggagagtacaacgactggtcggctgcaccntcg

SEQ ID NO: 98113 - DNA, 551 bp, Homo sapiens
  misc_feature: GYAE6OF02F0DBM.24.67.G01.1.454.CMB.1.raw
  modified_base (199)..(199): a, c, t, g, unknown or other
  misc_feature (199)..(199): n is a, c, g, or t
  modified_base (370)..(370): a, c, t, g, unknown or other
  misc_feature (370)..(370): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtataagagcaactacttagcctggtatcaacagaaacctggccaggctcccgaggctcctcatctatggtatatccagcagggccagtggtctcccagcctaggttcaggtggcaggtggtctgggacaggacgttcactcncaccatcagcagtctgctagtcgtagaagtatttcgacttagtttattacgtcgtacctagcagccacgtacgtcgacgtcggccgtctaccgtacgtttccgggacggtacgggaccgtaagggtcgggacgtacgtaaccgaaacgtacgttaggtcggcctcggacctaccgtatccg

SEQ ID NO: 98114 - DNA, 519 bp, Homo sapiens
  misc_feature: GYAE6OF02IAJQJ.24.67.G01.1.454.CMB.1.raw
  modified_base (200)..(200): a, c, t, g, unknown or other
  misc_feature (200)..(200): n is a, c, g, or t
  modified_base (473)..(473): a, c, t, g, unknown or other
  misc_feature (473)..(473): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgaagggccagccggagtgttagtaagtacttaggctggtaccaacagaaacctggccaggctcccaggctcctcatctatgatgtctccaaacagggtcactggcgtccccgcaggttcagtggcagtgggtctgggacagacttcactctcacgtcagcagcctagagcctgaagattttgcggtttactatgtcagcagcgttccgcctggccgctaaactttcggcgggggaccaggggtggagaggagacgaacngtgctgcaccatctgtcttctatcttcccgccatctgaacataacg

SEQ ID NO: 98115 - DNA, 584 bp, Homo sapiens
  misc_feature: GYAE6OF02IE005.24.67.G01.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtataagagcaactattagcctggtatcaacagaaacctggccaggctcccaggctctcatctatgatgtctccaacgngggtcacgtggccgtccccgcaggttcagtggcagtgggctgggacagaccttcactctcgaccgtcagcagcctagacgcctagaagttagtttgacggttttactactgttacagtcacggtcgttccgccgtcggcccgtacgttaaccgttcggggaccgggggtaccgtagggggtcggaaggagggacgacgtacgtcggtcgggcgtacggccgtaacccgtagttccgttcgttcctttaccgtacgttcccgtttccccgcctacg

SEQ ID NO: 98116 - DNA, 554 bp, Homo sapiens
  misc_feature: GYAE6OF02HT7IQ.24.67.G01.1.454.CMB.1.raw
  modified_base (395)..(395): a, c, t, g, unknown or other
  misc_feature (395)..(395): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccaggccaggttcgttggcggtggtcgtgggacagagttcactctcacatcagcagtctgcagtctgaagtnttttgctagttttattacttcggtaccagcacgcaacgtagtcgacgttcggccgtctcgtaccgtttcgggcgggacgggaccgaagggtggaggaataccgaaacggtaacttggtacggacgttgacctaccgaagttcctcggttcttactaccg

SEQ ID NO: 98117 - DNA, 555 bp, Homo sapiens
  misc_feature: GYAE6OF02GUPTT.24.67.G01.1.454.CMB.1.raw
  modified_base (201)..(201): a, c, t, g, unknown or other
  misc_feature (201)..(201): n is a, c, g, or t
  modified_base (413)..(413): a, c, t, g, unknown or other
  misc_feature (413)..(413): n is a, c, g, or t
  modified_base (550)..(550): a, c, t, g, unknown or other
  misc_feature (550)..(550): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtataagagcaactacttagcctggtatcaacagaaacctggaccaggcctcccgaggtcctcctcatctatggtatatccagcagggccacgtggtcgtcccagccaggttcaggtcggctaggtgggtctgggacaggacttcacttctcgaccatcagcagtctgctagtctagaagtntttgactagtttacttactcgctagacagacacgagtgacgtcggccgtctccgtaccgtttcgggcgggtacgggtaccgaaggggtcggaacggactaacgaaacgtacgtcggtacggcgtacggacctacctnttccg

SEQ ID NO: 98118 - DNA, 516 bp, Homo sapiens
  misc_feature: GYAE6OF02IIJRR.24.67.G01.1.454.CMB.1.raw
  modified_base (200)..(200): a, c, t, g, unknown or other
  misc_feature (200)..(200): n is a, c, g, or t
  modified_base (430)..(430): a, c, t, g, unknown or other
  misc_feature (430)..(430): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaagtagtcatgacgcagtctccagccaccctgtctgtgtctccaggggaaanagccaccctctcctgcagggccagtgagaatgttggcagcaacttagcctggtaccagcagaaacctggccaggctcccaggctcctcctctatgctgtcctccaccagggcccctggtcgtcccagccaggttcgttggcggtggtctggggacagatttcactctcaccatcagccggcctcagtctagaagtattttgcttactttattctgtcaactactatggtnactggccttcgtactacttttggccgagggaccaacgtgagatacaacgactgtggctgcaccatctgtcttcactctcccgctac

SEQ ID NO: 98119 - DNA, 256 bp, Homo sapiens
  misc_feature: GYAE6OF02FPORO.24.67.G01.1.454.CMB.1.raw
  modified_base (252)..(256): a, c, t, g, unknown or other
  misc_feature (252)..(256): n is a, c, g, or t
tcagactactatgtcacgaccggtgctcgatttagagtatacatattgggtctgggacagagttcactctcaccatcagcagtctgcagtctgaagattttgcagtttattactgccagcagcacagtgactggccgctcactttcggcggagggaccaaggtggagatcaaacgaactgtggctgcaccatctgtcttcatcttcccgcatctgaacatagtagtctgagcgggctggcaaggcgcatagnnnnn

SEQ ID NO: 98120 - DNA, 554 bp, Homo sapiens
  misc_feature: GYAE6OF02HH518.24.67.G01.1.454.CMB.1.raw
  modified_base (198)..(198): a, c, t, g, unknown or other
  misc_feature (198)..(198): n is a, c, g, or t
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagagaccaccggagaaattgtgttgacgcagtctccaggcaccctgtcttgtctccagggganagagccaccctctcctgcacgggccagtcagagtgttagcagcagctacttagcctggaccagcagaaacctggcctggcctcccgaggcctcctcactctagtcggtgccgtccaccgagggccacgtggcgtcgcggacgaggttcaggtcgctaggtcgtcgttagggcagacttcactctacatcagtcgacagctggacgaccgtaagtnttagctagtagtattacgtgtcagtcttgttcgtccctgtcctctntcgtactcgtttcggactacggtccaggtcgtaggtacgtacgtcgaacgtacgtaacgtggttacggcgtacgaccgtaaccgtacgtcttcgg

SEQ ID NO: 98121 - DNA, 583 bp, Homo sapiens
  misc_feature: GYAE6OF02GLICU.24.67.G01.1.454.CMB.1.raw
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
  modified_base (380)..(380): a, c, t, g, unknown or other
  misc_feature (380)..(380): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagagaccaccggagaaattgtgttgacacagtctccaggcaccctgtctttgtctccaggggagagagcccaccctctcctgcagggccagccggagtgttagtaagtacttaggctggtaccaacagaacctggccaggcctccaggcctcctcatctatgatgtctccaacgngggtcacgtggccgtccccgcaggttcaggtggctaggtgggtcngggacagtacttcactctcaccgtnagcagcctagcgcctagagtatttgtcggttttactactgtcagcgagtccgttccgccgtcggccgtcgttaaccgtttcgggccggggggtaccgagggggtcggacggagggagacggtaacgtggtcggcgtgaccaccgtagtccgtggtcctttcaccttccgttccccgcgtactccgtagaactatacggttacg

SEQ ID NO: 98122 - DNA, 600 bp, Homo sapiens
  misc_feature: GYAE6OF02G28IF.24.67.G01.1.454.CMB.1.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtataagaagcaactacttagcctaggtatcaaacagaaactggaccaggcctcccgaggctcctcactctatggtatactccagcgagggcccagtcggtcgtcccaggacctaggttcaggtcggctaggtgggtcgtgggacagtgttaccnctctacacctatcgacgtacgcgttctcgcagttacgtagtaagtacgtttttgacgttaagtttttacgttaacgttcgtaccgtacgtcctagacctacgtaggtcgtacggtcggcccgtcttcgtaccgtttcgggcgggtacggaccggtaacgggtaggtacgacgtaacgtaaaccgtgtacggtcggacgtcggacctacgagtcg

SEQ ID NO: 98123 - DNA, 631 bp, Homo sapiens
  misc_feature: GYAE6OF02JKB2C.24.67.G01.1.454.CMB.1.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagactactatgtcacgaccggtgctcgatttagagtatacatattgggtttgggggaggaactgctcagttaggacccagagggaaccatggaagccccagctcagcttctcttcctcctgctactctggctcccagatgccaccggagacattgtgttgacacagtctccagccaccctgtctttgtctccaggggaanagccacctctcctgcagggccagtgacaagtgttaggaagttgtagcctggtatcaacacaaacngtggccaggccnccgtcccgtctactctactactatgactcactactacgaacgtacgctacgtgacctacctaccgaagtacgtacggtacgaggtcgacgtagggtcgggtacgaggactacgtaccttcaccttccgacactcacgagacgtagacgtagcgtacgtaagttaagttcgttacgtaactttagtttacgtacgtcgtagtaccgtacgtacggtacaaccggtacctaccgtaccgttaccgtccgggtacccgtacggtaaccagggttccgacgtaccgtaccgtaaccgaacgttcggttcgaccgtacgtaccgtactaccgtagtttacccgtcgttaccgttccg

SEQ ID NO: 98124 - DNA, 511 bp, Homo sapiens
  misc_feature: GYAE6OF02FE3PZ.24.67.G01.1.454.CMB.1.raw
  modified_base (201)..(201): a, c, t, g, unknown or other
  misc_feature (201)..(201): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagagcaactacttagcctggtatcaacagaaacctggccaggctcccaggctcctcatctatgtatatccagcagggccacgtggtcgtcccagccaggttcaggtggcagtgggtctgggacnggagttcacgtctcaccatcagcagtctgcagtctgaagtntttgctagtttattactcgcagcagcacgagtgacgtcggccgctcgtacgtttcggacggtaggaccgagggtggagacgtacgaacgacgtggtcggcgtgccacactcg

SEQ ID NO: 98125 - DNA, 260 bp, Homo sapiens
  misc_feature: GYAE6OF02JJETG.24.67.G01.1.454.CMB.1.raw
  modified_base (193)..(193): a, c, t, g, unknown or other
  misc_feature (193)..(193): n is a, c, g, or t
  modified_base (226)..(226): a, c, t, g, unknown or other
  misc_feature (226)..(226): n is a, c, g, or t
  modified_base (249)..(260): a, c, t, g, unknown or other
  misc_feature (249)..(260): n is a, c, g, or t
tcagactactatgtcacgaccggtgctcgatttagagtatacatattgggtctgggacagagttcactctcaccatcagcagtctgcagtctgaagatttgcagtttattactgccagcagcacagtgactggccgctcactttcggcggagggaccaaggtggagatcaaacgaactgtggctgcaccatcngtcttcatcttcccgcatctgaacatagtgtcngagcggctggcaaggcgcatagnnnnnnnnnnnn

SEQ ID NO: 98126 - DNA, 507 bp, Homo sapiens
  misc_feature: GYAE6OF02HFRUA.24.67.G01.1.454.CMB.1.raw
  modified_base (200)..(200): a, c, t, g, unknown or other
  misc_feature (200)..(200): n is a, c, g, or t
  modified_base (322)..(322): a, c, t, g, unknown or other
  misc_feature (322)..(322): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtataagaagcaactacttagcctggtatcaacagaaacctggccaggctcccaggctcctcatctatggtatatccagcagggccactggtntcccagccaggttcagtggcagtgggtctgggacagagttcactctcaccatcagcagtctgcagtctgaagtattttgctagtttattactgccagcagcacagtgacgtggccgctctacgttcggacggacgggaccgagggtggagtacgtacgaaacgacgtggtcggcgtgcacagtcg

SEQ ID NO: 98127 - DNA, 581 bp, Homo sapiens
  misc_feature: GYAE6OF02I5E0D.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagaagcaaactcttagtctggtatcaacagaaacctggccaggctcccaggctcctcatctatggtatatccagcagggccacgtggtctccagccaggttcagtggcagtgggtctgggacagagttcactctcaccatcagcagtctgcagtctgtaagtattttcgcttagttttacttacgtgtaccgtagtccagtccaacgtagtacgtacgtacgggcccgtcgtaccgtaccgtttcgggaccgggtacgggtaacccggtaagggtacgggtaacgtacgtaaccgaaacggtaacgttggtacgggaccgttacggaccgtaacccgtagttaccgg

SEQ ID NO: 98128 - DNA, 595 bp, Homo sapiens
  misc_feature: GYAE6OF02HUFF0.24.67.G01.1.454.CMB.1.raw
  modified_base (201)..(201): a, c, t, g, unknown or other
  misc_feature (201)..(201): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggcagtcagagtataagaagctaactacttagcctagtatcaacagaaacctggaccaggcctcccgaggcctcctcattctattggtactagtccagcagggccacgtggtcgtccagccaggttcagtcggcaggtgggtctgggacaggtagttccgtactctccgaaccntacagctagtctgntatctgtaatgtttgcttagttttattagtcgaccagacgacgtacgtaactaggtacgtacgtcggtacccgtcgttcgttaacgtttccgggacggtaacggggacccgtaagggtcggaacgtacggtaacgtaaaccggtaacgttcggttacggccgttacggtaccgtaccctacgttcccg

SEQ ID NO: 98129 - DNA, 576 bp, Homo sapiens
  misc_feature: GYAE6OF02JD70Y.24.67.G01.1.454.CMB.1.raw
  modified_base (308)..(308): a, c, t, g, unknown or other
  misc_feature (308)..(308): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagagaccaccggagaaattgtgttgacacagtctccaggcaccctgtctttgtctccaggggagagagcccaccctctcctgcagggccaggccggagtgttagtaagtacttaggctggtaccaacagaacctggccaggctcccaggctcctcatctatgatgtctccaacngggtcacgtggccgtccccgcaggttcagtggcaggtgggctgggacagacttcactctcacgtcagcagcctagcgcctagaagtatttgtcgtttactacgtgtcagtcgagtcgttccgccgtcggccgtccgttaacgtttccgggcggggggtaccgaggggtaggaggagggacgacggaacgtcggtcggcgtagccacgtagtcgtgttccttctacgttcccgttcccgcctacgttccgtacgaacgtacgtagtacg

SEQ ID NO: 98130 - DNA, 563 bp, Homo sapiens
  misc_feature: GYAE6OF02IKGNG.24.67.G01.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtaataagaagcaacttacttagcctggtatcaacagaaacctggccaggcctcccgagcctcctcatctatggtatanccagcagggccagtggtcgtcccagtccaggttcaggtggctaggtgggtctgggacagngttcactctcacatcagctagtctgcagttctagaagttnttttcgacgtttaagttttatacgttgaccgtagtccagccagtagtgaccgtggcccgtctccgtacgttcgggacgggacggtaccgagggtcggaagtaacgtaaccgaaacgtaacgtcggtacggtacctcggacctaccgattccgg

SEQ ID NO: 98131 - DNA, 605 bp, Homo sapiens
  misc_feature: GYAE6OF02H47UZ.24.67.G01.1.454.CMB.1.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagcccacctgtctgtgtctccgaggggaaangccaccctctcctgcagggccagtcagagtaataagaagcaaactacttagccttaggtatcaacagaaacctggaccaggcctcccaggctctcatctatgatgcataccaagtacgggccatggcactcccagacnggttacaggtgcaggtgggtcgtgggacagtacttcactctcacatcagctagtgtagagtcctaggaagtatttgcttaagtttagtttacttcgtacgacgtctaaccggttagaacgtaaccgttccggacccgttaaccgtttccgggacccgttacgggtacccgaaggtaccgtacgggtaactacgtaacccgtaaccggtaacgttacggtacgggtaccgttacggaccctaaccggtacttaccggttattcccg

SEQ ID NO: 98132 - DNA, 662 bp, Homo sapiens
  misc_feature: GYAE6OF02GAA1M.24.67.G01.1.454.CMB.1.raw
  modified_base (198)..(198): a, c, t, g, unknown or other
  misc_feature (198)..(198): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccacctgtctgtgtctccaggggaanagccaccctctcctgcagggccagtcagagtataagagcaactacttagcctggtatcaacagaaacctggccaggctcccgaggcctccgtcatctatggtatactccagcagggccacgtggtctcccagccaggttcagtcgctaggtcgggtactgggacaggtactttacgaccttcgttaccaaccctatccgagacgtaagttccgtgtaccagttccgtaggtaacgttatttttcggacgtttaagttttacgtttacgttacggttacctaaaccgttaccgttagttacggtacgtaaccgttcggtacccgttaccggttaccttaccgttttcggacccgtaacggggaacccttaaacggtcggtaacggtaaccgtaaccgtaaacggtaaaccgttcggtacggtaccgtacggtacccgtaaccgtacgttacccgtcgttaacccg

SEQ ID NO: 98133 - DNA, 499 bp, Homo sapiens
  misc_feature: GYAE6OF02F8KTB.24.67.G01.1.454.CMB.1.raw
  modified_base (200)..(200): a, c, t, g, unknown or other
  misc_feature (200)..(200): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtataagaagcaactacttagcctggtatcaacagaaacctggccaggctcccaggctcctcatctatggtatatccagcagggccactggtgtcccagccaggttcagtggcagtgggtctgggacagagttcactctcaccatcagcagtctgcagtctgaagtattttgctagtttattactgaccagcagcacgagtgactggccgctcactttcggcggacgggacaagggtggagagtacgaaacgacgtgtggctgcaccatcg

SEQ ID NO: 98134 - DNA, 557 bp, Homo sapiens
  misc_feature: GYAE6OF02F8B1P.24.67.G01.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (382)..(382): a, c, t, g, unknown or other
  misc_feature (382)..(382): n is a, c, g, or t
  modified_base (415)..(415): a, c, t, g, unknown or other
  misc_feature (415)..(415): n is a, c, g, or t
  modified_base (468)..(468): a, c, t, g, unknown or other
  misc_feature (468)..(468): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtataagaagcaactactagcctggtatcaacagaaacctggccaggctcccaggctccncatctatggtatactccagcagggccacgtggtctccccaacgtaggttcaggtggcagggttgggtctggggacaggtacgttcacttcncacctatcagctagtctgcgtagtcagtaattnttttcgatttagtttacttactcgaccagcagacactaggtacgacgtggccncttaccgtaccgttggggacggacgggaccgtaagggtggaacgactaaccgaaacgtacgtggtcggctggaccaccgtacttcgtcg

SEQ ID NO: 98135 - DNA, 1073 bp, Homo sapiens
  misc_feature: GYAE6OF02HS8NS.24.67.G01.1.454.CMB.1.raw
  modified_base (233)..(233): a, c, t, g, unknown or other
  misc_feature (233)..(233): n is a, c, g, or t
tcagactactatgtcacgaccggtgctcgatttagagtatacatattggggtttggggggaactgctcagttaggacccagacggaaccatcggaagccccgtagccgccaggccttcgtcgttcctcctgcctactctgggcctcccagataccactaggagaaataggtgacgtcgacgctaggtctccgacgtcccgaccctcgttctcgtcgtcctccgaggggaaacncgtcccacccttcgtccgtcgaccgacgggcccaaggttcgtaggtacgttaagtaaagggacgtaccgtaaacctacgttacggcccttagggtaagtaaccggaacgtaacggtaaaaacccttacgggaccgtaacggggacccttccccggtaacgggtcccttacccgtacgtaacgttaccggttaaggtttaccgggttaattaaccgttacccggtaacggtaccgtaaccgggggtaaccctaaaccgggttcggggttaccggttacccccgtaacggtaccccgttaacggggtttacctaaccgggtttcgggaaccggtaacgggttcgggggttacccgtagggggtaaaccaaaggggttacgttttacccgtaacccgttaccgtaacccgtaaaccgttacgttaccgtacggtaccgtaaccggtttacccggtcggtaacccgttacgggttacccgggttaacgggtaaaccggtttttaacggttttttacggtaccgttttaacggtttttaaacggttaaccggtttacgggtaaacccgtaacggtaaccgttacgggttaacccgttaaaccgggttttacgggtaacggtttaccgggtttaccgggttacccggttaacccgttaaccggtttaaccgggttttaccggggggacccggggttaaccggggggttaaccccgtaaccggggggtttaaccggggaaccgggtaacccggttaaaccgggtaaaaacccggtttaccggttaccggggttaccgggttacccgttaccgggtaacccgtaaccccggttaccgtttaccccggg

SEQ ID NO: 98136 - DNA, 525 bp, Homo sapiens
  misc_feature: GYAE6OF02GCVF4.24.67.G01.1.454.CMB.1.raw
  modified_base (201)..(201): a, c, t, g, unknown or other
  misc_feature (201)..(201): n is a, c, g, or t
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
  modified_base (520)..(520): a, c, t, g, unknown or other
  misc_feature (520)..(520): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtataagaagcaactacttagcctggtatcaacagaaacctggccaggctcccaggctcctcatctatggtatatccagcagggccacgtggtcgtcccagccaggttcagtggcagtgggtctgggacagagttcactcncacatcagcagtctgcagtctagaagtntttgcttagtttattactgtccagcagcanaggtcacgtcggcctctctacgttcgggcggtaggaccgaagggtcggagtacgtaacgaaacgtacgtggtacggtcgtcgactaccgtnttccg

SEQ ID NO: 98137 - DNA, 561 bp, Homo sapiens
  misc_feature: GYAE6OF02JUFPO.24.67.G01.1.454.CMB.1.raw
  modified_base (259)..(259): a, c, t, g, unknown or other
  misc_feature (259)..(259): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccaccggagaaattgtgttgacacagtctccaggcaccctgtctttgtctccaggggagagagccaccctctcctgcagggccagccggagtgttagtaagtacttaggctggtaccaanagaaacctggccaggctcccaggctcctcatcatgatgtctccaacgaggtcactggcctccccgcaggttcagtggcagtcgggtctgggacagacttcacgtcctcgacccgtnagccagcctaagcgctgaatntttcgcgtttactactgtnacgcgacgtcgttccgccgtggcccgcttaacgtttccgggcggggtaccgaggtcgggagacggagaccgtaacgtggtcgctgacaccagtcctgttacgtcaacgttccgttcccgccttacgtacctagaactagtacgtag

SEQ ID NO: 98138 - DNA, 566 bp, Homo sapiens
  misc_feature: GYAE6OF02FHKKF.24.67.G01.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (561)..(561): a, c, t, g, unknown or other
  misc_feature (561)..(561): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtataagagcaactacttagcctggtatcaacagaaacctggccaggcctcccgaggcctcctnattctagtgtatatccagcagggccagtggtcgtcccagccaggttcaggtggcaggtgggtctgggacaggcgtttcacttctacaccatcagcagtctgcagtctagaagtattttgcttagtttacttactagccagtaccagtaccacgtagtcgacgttcgggacctccttccgtacgtttccggggcgggtacgggtaccgtaaggggtcggagtaacgtaaccgaaacggtaacgtggtacggtacgtcggacctaccgtnttccg

SEQ ID NO: 98139 - DNA, 565 bp, Homo sapiens
  misc_feature: GYAE6OF02HB88O.24.67.G01.1.454.CMB.1.raw
  modified_base (202)..(202): a, c, t, g, unknown or other
  misc_feature (202)..(202): n is a, c, g, or t
  modified_base (390)..(390): a, c, t, g, unknown or other
  misc_feature (390)..(390): n is a, c, g, or t
  modified_base (561)..(561): a, c, t, g, unknown or other
  misc_feature (561)..(561): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtataagagcaactacttagcctggtatcaacagaaacctggccaggcctcccaggctcctcattctatggtatactccagcgagggcctacgtggtcgtcccaggcctaggttcaggtcggctagggtgggtctgggacagtagttccactctcaccntacagctacgtctcgcgtagtcgtagtaagtattttagacttagtttacttacgtgtacctagcagtcacgtagtgacgtcggccgtctacgtaccgtttcgggacgggtacgggacgtaagggtggaacgtacgtaacgaaacgtacgtggtacggcgtacgcctacgtnttcg

SEQ ID NO: 98140 - DNA, 624 bp, Homo sapiens
  misc_feature: GYAE6OF02H5CJ7.24.67.G01.1.454.CMB.1.raw
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagccacctctcctgcgagggccagtcagataagtaagaagacaactactagccttaggtatacaacagaaaacctggaccaacggcctacccgaggcctctcatctatgtatancctagcgaggcctacgtcggtcgccacgaccgtaggttcaggtcggacgtaggtcgggtacgagggtaacaggtacgtttaccactccgtaccactacgtacgtaagcgtacgtctagtacgtagtcgtaagtaagtagttttgaacgttagttttaatacgtagcgtagacagacgtacgtgtacgcgtccggaccgtctacgttacggttcgggaccgggtacgggacccggttaagggcgggtaaacgtacgtaaccgtaaacgtacggtcggtacgtaccgtacgtaccgtacctagttaccg

SEQ ID NO: 98141 - DNA, 564 bp, Homo sapiens
  misc_feature: GYAE6OF02JZJCZ.24.67.G01.1.454.CMB.1.raw
  modified_base (202)..(202): a, c, t, g, unknown or other
  misc_feature (202)..(202): n is a, c, g, or t
  modified_base (420)..(420): a, c, t, g, unknown or other
  misc_feature (420)..(420): n is a, c, g, or t
  modified_base (560)..(560): a, c, t, g, unknown or other
  misc_feature (560)..(560): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtataagagcaactacttagcctggtatcaacagaacctggaccaggcctcccgaggcctcctcatctagtggtatactccagccgacgggccacgtggtctcccagccgtaggttcagtcggcaggtcgggtctgggactagtagttcactcacacctatcagtcagtctgcacgttctagaagttntttcgacttagtttattacgcgtacgagacagtactacgtagtacgaccgtcggacctcgtcgtaacgttcgggacggacggaccgtagggtggaacgtactaaccgaacgtaccgttggccgtacgtacgactaccgtnttcg

SEQ ID NO: 98142 - DNA, 631 bp, Homo sapiens
  misc_feature: GYAE6OF02H18PG.24.67.G01.1.454.CMB.1.raw
  modified_base (200)..(200): a, c, t, g, unknown or other
  misc_feature (200)..(200): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaagtagtcatgacgcagtctccagccaccctgtctgtgtctccgaggggaangccaccctctcctgcagggccagtgagatgttggcagcaacttagcctggtaccagcagaaacctggccaggcctccaggcctcctcctctactgcttgtctcccaccgtacggcccccgttggtcgtccccagccgtaggttccggttggccgggttgggtccgtgggtacacgtatttcactctcacattcgaggccgtaccctccgagtcctgaagttattttacggcttactttatttctacgtacctaactacttagttcggtacgtacgtccgggtacccttccgtaacgtttaccgtttgggacccgtacggggtaccctaaagtcgggaacaacgtaacgtaaaccggtacgttggtacggtctacggaccctaccgtaactccggttagttccgtttactacctttccttccccggactacg

SEQ ID NO: 98143 - DNA, 680 bp, Homo sapiens
  misc_feature: GYAE6OF02IBOH8.24.67.G01.1.454.CMB.1.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcgagggccagtcagagtataagagcaactactacgctaggtatacaaacgaacgaaacctggaccacggcctacccgaggcctcctacatctagtgtatacncagcgaggcctagtggtcgtacccagtccgtaggttcaggtcggactagggttcggggtcgtaggggaacagggttcgttaccacgttccgtacacctacgtcgagtcgtacgtctcgacgtagttacgtagtaagttagttttagacgtttagttttacttacgtcgtacgacgtaccgacgtacgtaacgtgtacgtacggttcggcccgttcgttacggttaccggtttacggggaccggggtaaccggggtaaccggtaagggggtacggtaacggtaaacgttaacccggtaaaacggttaccggttacgggttaacgggtcccttaacgggaccctaaccgttagtttacccgg

SEQ ID NO: 98144 - DNA, 671 bp, Homo sapiens
  misc_feature: GYAE6OF02GHHAD.24.67.G01.1.454.CMB.1.raw
  modified_base (199)..(199): a, c, t, g, unknown or other
  misc_feature (199)..(199): n is a, c, g, or t
  modified_base (449)..(449): a, c, t, g, unknown or other
  misc_feature (449)..(449): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccacctgtctgtgtctccgagggaaangccacctctcctgcagggccagtcagacgtataagaagcaactacttagcccttaggtactacaacacgaaaccgtggaccaggcctacccgaggtccctccgtcactcgtagttcggtaatacgtccaggccgaacgggcctaacgtcggtcgtacccacggtaccgtacggttcaaggtcggcgtaggttcgggttccgtagggacaggttacgttcaccgttctacaccctatcgacgcgtagtccngaccgtagttcgtaaggtaacttagtttcgattaacgttttacgttaccgcgtaccgtcgactacggtaacctaggtacgtacggtaccgtcggtacccgtcttaccggttacggtttaccgggggacggtaccgggtaacccggtaagggtggaaaccgtaccgtaaccgtaaacggaccggtttgggaccggttaccgccgttaccgtaccgtagttccg

SEQ ID NO: 98145 - DNA, 564 bp, Homo sapiens
  misc_feature: GYAE6OF02GCCUX.24.67.G01.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaancgccaccctntcctgcagggccagtcagagtataagagcaacgtacttagcctggtatcaacagaaacctggccaggctccccaggctcctcatctatggtatatccagcagggccacgtggtgtcccagccaggttcagtggcaggtgggtctgggacagagttcactctcaccgatcagtcagtcngcngtctgtaagtattttgcttagtttatttctgtacaactacttagtcggtatacgtgcccttccgtactacgttttcggaccgtaggggaccctaacgtggaacgtaacgtaccgtaaaacggtaaccgttcggttacggtcgtcggtaaccacccgtagttcctgtttacccg

SEQ ID NO: 98146 - DNA, 719 bp, Homo sapiens
  misc_feature: GYAE6OF02GGWBU.24.67.G01.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagcccaccctgtctgtgtctccaggggaaangcccaccctctcctgcagggccagtcagatanaagancaactacttagcctggtatcaacagaaacctggccaggcctcccgaggcctccctcctctatcgctgtcctccgaccgacgggtccccctggtcgtccccgaagtcccgtaggtttccggttgggccgggttgggtcgtcggggaactaggtacttttcgacttcctcgaaccctattccgacggtcccgggtacccttaccgtacggtaccgttacggtaaacgttacgtttttcggtaccgtttactttttaacgttttccgttacggttacctaaaccttaacgtttaacggttcgggtacgttaccgttccggtacccgtttacccggtttacgttacccgtttttcgggacccgtacggggtaaccctaaaccgtcgggtaacgtaaccgtaccgaaaccgtacgttcggtacggtcgtacgtacctaacctacgttcgttacgttccttactaccgtcccttaccccgctaaccg

SEQ ID NO: 98147 - DNA, 814 bp, Homo sapiens
  misc_feature: GYAE6OF02FYAWM.24.67.G01.1.454.CMB.1.raw
  modified_base (204)..(204): a, c, t, g, unknown or other
  misc_feature (204)..(204): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtataagaagcaactacttagcctggtactcaacagaaacctggaccaggcctcccgaggtcctcctcatctagtggtatactaccgaggccgaagggtccccaagttcgggtaccgttccccgaacggcccgttaagggtttaccgagggttcggggccgttaagggggttgggggttaccgttgggggaaaccgtaggttaacggtttccgtaaccttcttacccgaaccctagttaccgaacggtccgtaaggttccccgtggtacccgtacggttactacgggtaaaagtttcgtttttaggacgtttaagtttttaacgttaaccgttcggtacccggtaggaccgtacgtccgtaaacggttacggtaccggtacccggttacggggtccccgtaactttaccccggtttaacgggttttaccccggggggaacgggttaaccgggggaaaccccggttaagggggttaacggaaacgggttaaccgttaaaacccggggtaaaacccggttaaccgggtttcggttaaccgggggtaccttaaccgggaacccgttaacctccgggtttaacccg

SEQ ID NO: 98148 - DNA, 516 bp, Homo sapiens
  misc_feature: GYAE6OF02HV22U.24.67.G01.1.454.CMB.1.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (466)..(466): a, c, t, g, unknown or other
  misc_feature (466)..(466): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtgacaatgttaggaagttgttagcctggtatcaacacaaanatggccaggcctccccggctcctnatcatgatgcatccaagtacgggccacgtggcatcccagactaggttcagtggcagtcgggtctggggactaggacttcacgtctacgaccatcagcagtgtancgctagaagtntttggcgtttactatgtcagtcagtccgttcgcctggcctacttacgttcgggcggggtacngggtgagaggacgacgagnggtcgntgcacntctgtcctnacttctcccg

SEQ ID NO: 98149 - DNA, 603 bp, Homo sapiens
  misc_feature: GYAE6OF02GGYLQ.24.67.G01.1.454.CMB.1.raw
  modified_base (204)..(204): a, c, t, g, unknown or other
  misc_feature (204)..(204): n is a, c, g, or t
  modified_base (446)..(446): a, c, t, g, unknown or other
  misc_feature (446)..(446): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagataccactggagaaatagtgatgacgcagtctccagccaccctgtctgtgtctccgaaggggaaangcccaccctctcctgcagggccagtcagagtaataagaagcaactacttagcctggtatcaacagaaacctggaccaggcctcccgaggtcctcccgtacacttctagtggtaactactcccgagccgacgggccacgtgggtcctcccagcctaggttcaggtggcgtaggtcgggtacgtgggacaggtacgttcactcctccacctatcgacgtcagtctgctagtacgtagtaagttntttcgcttaagtttacttacgctaccgtagccagacctacgtagtcgtacgtcggacctcttcgtaccgttcgggacggtacggacggtaagggtcggaagaacgtaaccgtaaaccggtagtacgggtccggtcgaccgtaccgacctagttcccg

SEQ ID NO: 98150 - DNA, 650 bp, Homo sapiens
  misc_feature: GYAE6OF02IQ6CQ.24.67.G01.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (411)..(411): a, c, t, g, unknown or other
  misc_feature (411)..(411): n is a, c, g, or t
tcagactactatgtcacgaccggtgctcgatttagagtatacatattgggtttggggggaactgctcagttaggacccagacggaaccatggaagcccccagcgcagcttctcttcctcctgctactctggctcccagataccactggagaaatagtgatgacgcagtctccagccaccctgtctgtgtcctccgaggggaaangcccaccctctcctgcagggccagtcagagtanaagaagcaactacttagcctaggtatcaacagaaacctggccaggcctacccgaggtccttcctcatctagtggtaatactccgagcgacgggccacgtggtcgtaccagtcccgtaggttcaggtggcgtaggtgggtctagggacaggtacgttccgacttctaccaacgtntaccgagcctaacggtcctgctacgttacgtgggtaacttacgtttcggacgttacgttttacgttaaccgtcggtacctaggactacggtccacgtaggtccggtaacgtcgggacccttccgtactaccgggttccgggaccggggtacggtaacggtacggggtaggaaacgtacgtaaaccgaaaccggttacgttgggtaccgggtactaccggaccctaccgtcgttacccgg

SEQ ID NO: 98151 - DNA, 656 bp, Homo sapiens
  misc_feature: GYAE6OF02IKTOK.24.67.G01.1.454.CMB.1.raw
  modified_base (202)..(202): a, c, t, g, unknown or other
  misc_feature (202)..(202): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcgagggcccagtcagagtataagaagcaactactagcctggtatcaaacagaaacctggaccaggcctcccaggcctccctacgacttctattggtatacgtccgaggaccgacgggcccagtcgggtctaccccgagtcccgtaagggttccaggttggaccgtagggttcggggtccgtggggtaacaagggtacgttaccaacttccgtacccaaccgtagttccgaacggtcctaggttactcggactaggttctaggtaagttgttttacggacttaaggttttatacgtcacctaggcctacgcgaactggtacgtacgtcggacccgtctcgttaaccggttcggggaacggacgggacctaaggggcgtaacggaagttaacccggaaacgttaggttcgacgggtaccgtaggacccgtactacgttcgg

SEQ ID NO: 98152 - DNA, 852 bp, Homo sapiens
  misc_feature: GYAE6OF02I76HU.24.67.G01.1.454.CMB.1.raw
  modified_base (158)..(158): a, c, t, g, unknown or other
  misc_feature (158)..(158): n is a, c, g, or t
  modified_base (209)..(209): a, c, t, g, unknown or other
  misc_feature (209)..(209): n is a, c, g, or t
tcagactactatgtcacgaccggtgctcgatttagagtatacatattgggtttgggggaactgctcagttaggacccagacggaaccatggaagccccagcgcagcttctcttcctcctgctactcgtggctccagactaccactggaagaaatagtnagtgacgcagtcctccacgcccacctgtctgtcgtcctcggaaggggaacncgcccacccgtctccgtgacgacgggcctacggtcaaggtataagtaaacggaacgacctaaacttacgtacgtccgttaggtactaacctaaacgaacgtaaaacccgtcggacccgtaggtacccctcccgaacggtcccttccgtactaccttacgttaagttcggttaattactaccgacgtacggaccgggtaccctacggtcggttaccgtacccgacggtaccgtacggttacgacggtcggtacgtagggtcggggttacggacgggtacgtaacggtcgttacccgtaacgttcccgtacgaaccgtactaccgtaacggtacgttacgttccgtacgtaccgttaggttaccgtaaggttaagtttacgttttacgtaacgttttacgttttactttacgtacggtaccttaggccgtaaccggtacgtacggttacggtacggttaaccggtccgggtacccgtttaccttcccggtttaacccggggttcccgggtaacgggggtaacccggttaaccggggtaacggggtaacggggttaaaccgtaacgttaaaccccgggtaaaggttccggtttaccgggttacgggttacccggtaccgaccccggttacgtttaccgtttacccg

SEQ ID NO: 98153 - DNA, 579 bp, Homo sapiens
  misc_feature: GYAE6OF02H65ZX.24.67.G01.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtanaagaagcaactacttagcctggtatcaaacagaaacctggaccaggcctcccgaggcctcctcatctatggtatactccagccagggccacgttggtcgtcccaggcctagggttccaggtcggctaggtcgggtctgggactaggacgttcacttctaccaccatcagtctagtctgcgagtctgaagtagttttgacttagtttacttacgtcgtcacgtcagtcacgtagtcgtacgtcggccgtctaccgtacgtttcgggaccgggtacgggaaccggtagggtggagtacgtaaccgaaacggtaacgttggtacggtcgtcggtacctaccgtattccg

SEQ ID NO: 98154 - DNA, 795 bp, Homo sapiens
  misc_feature: GYAE6OF02H8K4Q.24.67.G01.1.454.CMB.1.raw
  modified_base (215)..(215): a, c, t, g, unknown or other
  misc_feature (215)..(215): n is a, c, g, or t
  modified_base (456)..(456): a, c, t, g, unknown or other
  misc_feature (456)..(456): n is a, c, g, or t
tcagactactatgtcacgaccggtgctcgatttagagtatacatattgggtttggggggaactgctcagttaggacccagacggaaccatggaagcccagcgcagcttctcttcctcctgctactcgtggctcccagataccacgtggagaaataggtgaatgacgcagtcctccagccctaccctgtctggttcgtcctaccggaaggggaaancgcccctaccctcgtcctgacgacgggccaggtccaaggtagtaaagaaaggaaacgccttaaccgttatttacgccgttaggtaactaccgaaacgaacgaaaaccgtggaccgacggtcctaccccgaggcccttacctacagtttccttagtacggtaacttagacccgtagtccggacgggacctacggtacggtccgtaaccccgcgtaccggtaagggtttcacggtcggtacgngggttcgggtctagggactaggtacgtaccgtacctccgtacccaacgttacgtacgaccgttacgaccggttcttaccggaccgttaggttacccgttaagggttaaacttttcgtttttacgtaaccgtttttaacgttttaacgtttaccgtaccgtaccgttacggaccgttacgacctaacggtacggttacccgtcggtccgttccgtaccggttacttacccgggttacgggaccggggtaccgggtacggtacggggtacggtaaactacccgtaaacggtaaccgtggttaacggacgggtcctacccggtacttacccgtgtttaccgg

SEQ ID NO: 98155 - DNA, 662 bp, Homo sapiens
  misc_feature: GYAE6OF02G3332.24.67.G01.1.454.CMB.1.raw
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaaatagtgatgacgcagtctccagccaccctgtctgtgctccgagggaanacgccaccctctccgtgcgacgggccagtcagagtaataagaagcaaacgttactacgccttggtaatacaacaacgtaaaccnggaccaaggtcctcccgaaggtcctactcattctagtggtaanctccagcacgggccctagtcggctcccgagccgtagttccgagtcggctagggtcggttcgtgggaccgtaggtacgttcctacttccgacctacgacgttcgaacgtcgtaacgttcgcggtcacgttacgtaagtaaggttatttcgaccgttagtttttacaacgttcgaacgttcacgttaacgactaaccggttgtaccggtacgccgggttcctcgttaccgtaacggttccgggacgggacggtaaccggtagggtacggtaacgtaccgtaaaccgaaagggtacgtacgggttccggaacctttccgggaacctacccgtagttcccg

SEQ ID NO: 98156 - DNA, 612 bp, Homo sapiens
  misc_feature: GYAE6OF02FNGTR.24.67.G01.1.454.CMB.1.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtaataagaagcaactactagcctggtancaacagaaacctggccaggcctcccaggcctcctnatctagtggtatactccagcagggccagtggtcncccagcctaggttcagtggcgaggtgggtacgtgggacaggtagttcactctacaccatccgagcagtctcgtcgtagtctagaacgttgttttcgactttaagtttattaccgtagtaccgtacgtacgacgtcctaacgtaggtacgtcggtacgggtcccgtcttaccgttaccggtttccgggaccgggtacgggtaccggtagggtacggaagttaccgtaaaccggtaaacgtaacggttacggtcgggtaccgttacggaaccgtacccgtagttaccg

SEQ ID NO: 98157 - DNA, 713 bp, Homo sapiens
  misc_feature: GYAE6OF02H1QY8.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatattgggtttgggggaactgctcagttaggacccagacggaaccatggaagccccagcgcagctctcttcctcctgctactctggctcccagataccactggagaagtagtcatgacgcagtctccagccaccctgtctgtgtcctccgaggggaaanacgccaccctctcctgcagggcagtgagaatgtgcagcaattgctggtaccagcagaaacctggccaggctacccgaggcctcctcctctatgctgtctcccaccgacgggcccctggtctcccacgcctacgggttcgtgggtcggtacggtctggggacagtagttttcacgtctcgaacctagtaccacggccgggtaccccttaccgaggtttaccttaggtaacggttttaactttttacggacctttaaccgttttttactttccgttacgtttaccctaaaccttaacgtttacgtttagggtacttacgtcgggtccctttaccggtaccgtttacgtttttccgggacccgttaacgggggtaaccctaaaacggtcggggtaaagtaaccgttaacgaaaccgttaacgtcggtttaccggacttacgggacctaaccctacgtttcccgttaggtttacccgttacttacccgttacccgtttacccccgatttaacccgg

SEQ ID NO: 98158 - DNA, 661 bp, Homo sapiens
  misc_feature: GYAE6OF02GZTZJ.24.67.G01.1.454.CMB.1.raw
tcagactactatgtcacgaccggtgctcgatttagagtatacatattgggtttgggggggaactgctcagttaggacccagacggaaccatggaagccccagcgcagcttctcttcctcctgctactctggctcccagataccactggagaagtagtcatgacgcagtctccagccaccctgtctgtgtctcgaggggaaagagccaccctctcctgcagggccagtgagaatgttggcagcaacttgccgtaggtaccagacaagaaacctggaccaggcctcccgaggtcctcctcctctatcgctacgtcctccgacgacggccctagtcggccggtcgacggtacgtagggttcacggtggctaggtggtcgtttagggactagtaccttcgaccttctactactctacgtcgacgacgtacgtagggacgacccggtaagtgtttcgacgttaggttagttattacgttgtaccgtagttcgttcggtttcggtccccttccgtttacccgttaccgtttattaccggtttaccgttaccgttttccgggtaccgtttaccgggttacccgtagggtacgttacgggtacgttaacgaccgtaacggcgttaacgttcggtacggtaccgtagcccgtacgtaccgttcgttaccg

SEQ ID NO: 98159 - DNA, 627 bp, Homo sapiens
  misc_feature: GYAE6OF02IYZGS.24.67.G01.1.454.CMB.1.raw
  modified_base (203)..(203): a, c, t, g, unknown or other
  misc_feature (203)..(203): n is a, c, g, or t
  modified_base (492)..(492): a, c, t, g, unknown or other
  misc_feature (492)..(492): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcgagggccagtcagagtaataagaacgacaactacttagcgtggtatcaacagaacctggccaggcctccccgaggtcctacctctactcgtagtaggtatactccgagacgacgggcctacgtcggtacgtcccgacgccgtagggttcaggtcggcgtacgggtgggtcgtagggacgagtacgttccactctaccaccatcgacgcctagtcgtacgtctacgttcgtaggtaacttcgtttacgtacgtttagtttacttcgtcgtaccgngaccgtagacctacgtggtacgcggtaccgccgttaccgtcgttaacggttcgggaccgggtacgggacgtaaggggtgtaacgtactaacggaacggtacgttcggtacggaccggtacacctacgtcgttccg

SEQ ID NO: 98160 - DNA, 622 bp, Homo sapiens
  misc_feature: GYAE6OF02HNNJP.24.67.G01.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (400)..(400): a, c, t, g, unknown or other
  misc_feature (400)..(400): n is a, c, g, or t
  modified_base (468)..(468): a, c, t, g, unknown or other
  misc_feature (468)..(468): n is a, c, g, or t
tcagactactatgtcacgaccggtgctcgatttagagtatacatattgggtttggggggaactgctcagttaggaccccagatggaaccatggaagccccagcgcagcttctcttcctcctgctactctggctcccagatacccactggagaaatagtgatgacgcagtctccagcccaccctgtctgtgtctccgaggggaaangcccaccctctcctgcagggcccagtcaagatataagancaactacttagccttggatcaacagaacctggccagctcccaggcctccncatctatggtatactccagccgaggcccacgtgggtctcccgagcctaggttccaggtggactaggttcgggtcgtgggaacagggtacgttaccactcgtaaccnccattcacgcgtagtctacgacctaactagtaacgttactttcgaaccttaactttactattacctanaacgtcgtaacgttaccgttaccgttccccggtacttaccggttaccgggaccgggtaacgggaccggtaaaggtacgacggtataccgaacgtaaccggtacgtcgggtacgtaccgtcgaacgacctacgtcccgtacggttcctacgtacc

SEQ ID NO: 98161 - DNA, 747 bp, Homo sapiens
  misc_feature: GYAE6OF02GN819.24.67.G01.1.454.CMB.1.raw
  modified_base (201)..(201): a, c, t, g, unknown or other
  misc_feature (201)..(201): n is a, c, g, or t
tcagactactatgtcacgaccggtgctcgatttagagtatacatactgggtttgggggaactgctcagttaggacccagagggaaccatggaagccccagctcagcttctcttcctcctgctactctggctcccagatgccaccggagacattgtgttgacacagtcctccagccaccctgtctttgtctcgaggggaaancgcccaccctctccgtgcgacgggtccagtgaactaagtggttaaggaagttgttagccttaggtactaccaaacaacaaaacagtcggacctacgggtcccctccccccggctccctctaacttcctatgatcgactactaccgaaagtcgggaccctacgtcggaccaccgtccccgaacggtacgtaaccggtttcgaggttcggaccgtaggggttcggggtccgtagggaaccctaacgttaccttccgtaacttccgtacccgtaactacgtaccgtaagtaccgtaggttacgtaacggacgtaccggttaaggtaagtttacgttttagacgtttaagtttttacgttacgttacgttaaccgtacgttaccaaccggttacgaacccgttaaccgtcccggtacccgttaccgtttacccgggccgttacgggaacccgtacgtacgtacggaaccttacgaaccgtaaccgtcgttacggtcggacctacggacctaccttgttaccgtccgtttacgttccctacccgttccccg

SEQ ID NO: 98162 - DNA, 788 bp, Homo sapiens
  misc_feature: GYAE6OF02ICL23.24.67.G01.1.454.CMB.1.raw
  modified_base (117)..(117): a, c, t, g, unknown or other
  misc_feature (117)..(117): n is a, c, g, or t
  modified_base (164)..(164): a, c, t, g, unknown or other
  misc_feature (164)..(164): n is a, c, g, or t
  modified_base (208)..(208): a, c, t, g, unknown or other
  misc_feature (208)..(208): n is a, c, g, or t
tcagactactatgtcacgaccggtgctcgatttagagtatacatattgggtttggggggaactgctcagttaggacccagacggaaccatggaagccccagcgcagcttctcttccnctgctactctggctcccagactaccacgtggagaaatgtgatgacgnagtctccagcccacctgtctgtactccgtaccgaaggggaaacncgccctacccgttctcccgtggcgaacgggccaggttaccagtaagttaacgaagacgcctaaactacgttacgccgttaggactacgaaacacgaaaccgtcggaccacggtcctacccgacggtcctaccgtacacgttacctagttcggtaactaccgtaccgaagtaccgtaccgggtacccgtacgtacgggttaccggtacccgacggtaccgttaacggttcgacggtacggtcggtaacgggttcggtacgtacgggtaacgtagggtaccttaccgaacctccgttacccggaaaactcgtaccggtacgaccgttaacggtcccgtagtaccgtacggttccgtaaagggtttacgttaacgttttcgggaacccgttttaaggtttaccgttaaccggtcgtaaccggtacgtaccggacggtaccgtaacggtcgttaccggtacggtaccggtacccgttccgttacggttaaccgggtttaccgggacgggaccggaacggtaacggaacggtaccgtacgtaaacccgaacggtacgtggtccgattcgtaccactttcgtaccg

SEQ ID NO: 98163 - DNA, 963 bp, Homo sapiens
  misc_feature: GYAE6OF02GUW04.24.67.G01.1.454.CMB.1.raw
tcagactactatgtcacgaccggtgctcgatttagagtatacatattgggtttggggggaactgctcagttaggacccagacggaaccatggaagccccagcgcagcttctccttcctcctgctactctggcctcccagataccactaggaagaaatagtgatcgacgcagtcctccgacgcccacccgtcgtcgttgtcgtccgtaccggtaaggggaaacgaccgacccctaccccttcctccgtcgcgacgggtaccacggggggggggtacaaggtaagtaaagtaaacgaaacgtacctaaaccgttaaccgttaaccgtaccgttaacggttaacttaaaccctaaaaccgtaaacggtaaaaaccccgtacgggtaaccccgaaccgggtacccctaccccggtaaccgggtcccttaccccgttacctaacgttaacccgtttaggttaacggttaacttaacctaccggtaacggaccggaaccgggtacccgtaaccgttccgggttaccgtacccgtaccggtacccggtacggttaccggtacggtacggtacggtacgggttcgggggttaccggtacgggtaacgtaacgggttaaccggtttacccttaccgttacctaacccgtaacctacggtttaacccacggtacgtttacgtacccgtttgaacccggtttagttaccgtaaaggggtacgtttttaacgtttaccgttaacgttttaacgggtttttaactaccgttccggtaaccgttacggaaccgtaacgccgttaacggttaacggtcgtaccgggttaccggcccgttacccttttaccggaaccggggtttccgggaacgggtacgggtaacccgggttaaggtaccgggaacctaaacgggtaacccgtaaaacgggtcggtaacggttccgggtacctacccggaacgttacctagtttccccg

SEQ ID NO: 98164 - DNA, 639 bp, Homo sapiens
  misc_feature: GYAE6OF02GP7MX.24.67.G01.1.454.CMB.1.raw
  modified_base (471)..(471): a, c, t, g, unknown or other
  misc_feature (471)..(471): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctcccagataccactggagaagtagtcatgacgcagtctccagccaccctgtctgtcgtctccgaggggaaagacgccaccctctcctgcacgggccagtgagatgtgcagcaacgtgcctggaccagcagaaacctggccaggcctcccgaggcctaccctctctagtcgctcgtcctccgtacccgacgggccccttgggtctccccgaaggtcccgtaggggttccggttgggtcccggggtgggttccgtaggggaactacggtattttacgaccttcgtaccaccagtccgagccgcccgtcacgtctagagtttcttggtcgttactcgtgtacgntcgtcgtcgttccgccgtcggccgtacgttaccggtcggggtccggggaccgtggggtagggtacgagggaacgtacggaagtcggtaggtctacggacgtaccgtacgttaccgtcggttcctttagacccgttccttccccggtcaacgtttccgtaattaaccgg

SEQ ID NO: 98165 - DNA, 796 bp, Homo sapiens
  misc_feature: GYAE6OF02H6XNI.24.67.G01.1.454.CMB.1.raw
  modified_base (206)..(206): a, c, t, g, unknown or other
  misc_feature (206)..(206): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtcctccagcccacctgtctgtcgtctaccgaaggggaaanacgccctaccctcctcctgccgagggccagtcagagtaataagaacgcaactattacgccgttagtactacgaaacaacgtaaaccgtcggaccgacggacctacccgaggtcctcctacattacctaagtcggttaactacgtacctaggaccgtacgggtaccctacgttcgggtaccgtaccccacggtccgtacggtttacgaggttccggtacgtacgggttcgggttccggtacggggaactacgggttacgttaccctaccgttaccctacccgtaccgtaaccttaccgaaggtacccgtaccggtttaccgtacggaccgttaacggttaccggttagggtaaaacgtttagtttttacggtaaccgttttaaacggttttttaaaccgttacgttacccggaccgtaacggtaaccgtaccgtacgtaaccggtaggttaacgtccggttaccgggtaccttacccggtacgttacccgggtttacgggaccgggtacgggtaccgttaagggcggtaacgtaaacgtaacgtaaaccggtacgtcgtacggttccacggtaccttacccgtattaccgg

SEQ ID NO: 98166 - DNA, 811 bp, Homo sapiens
  misc_feature: GYAE6OF02FRSCE.24.67.G01.1.454.CMB.1.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (662)..(662): a, c, t, g, unknown or other
  misc_feature (662)..(662): n is a, c, g, or t
tcagactactatgtcacgaccggtgctcgatttagagtatacatattgggtttgggggaactgctcagttaggacccagacggaaccatggaagccccagcgcagcttctcttcctcctgctactctggctccagatacactgganaaatagtgatacgagctagtcctcagccacctgtctgtgtctcgagggaancnccaccctctacctggaccgacgggtaccaggtcgaagacgtaagaaaggtaacgccgttaaacgttacttaaccgtccgttaggtaacctacgaaaacgtacgaaacccgttgggaccctaagggtacccctaccccggacggttacccttaccctttaccgaacgttaccgttaacgtttggggttaactaaccgttaccccgaacggccgggttaaaccggcccgtttaaaccggtcgggttactacccccgggtagttaccggtaccggttacgtaacggtgggtaaccgtagggttaccgggggttaccgtaaacgggtaccgtaaggttaaccggtttcccgtaaacgttccccggtttaaaccggaccctttagggttaaccgacggtttaccgtaaccgtttcgtaccgtacggttaccgttagtacgtaagtttccgttagtattacgttttacncgtagtaccacgtctagaccgtagacggttagaccgtcgcctaacggttccgtcgttacgggaccggtagtaacggtaggacgttaaggaccttaaccggacgtttacggccgttacggttcccgtataccccggtaacgtcgttaccg

SEQ ID NO: 98167 - DNA, 796 bp, Homo sapiens
  misc_feature: GYAE6OF02HT41F.24.67.G01.1.454.CMB.1.raw
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
  modified_base (410)..(410): a, c, t, g, unknown or other
  misc_feature (410)..(410): n is a, c, g, or t
  modified_base (492)..(492): a, c, t, g, unknown or other
  misc_feature (492)..(492): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctccagatacactggaanaaatgtgatgacgcagtctccagcccacctgtctgtgtctacgaagggaaancgtccccacctcttccgtagccgagggccctaggtacaaggtacgtaaagtaaaggaacgtacctaaaccgttacgttaggccttaaggtactaccgaaacgaacgtaaaccgtcggaccgacgggtcctaccccgaggtcccttaccgtacaactttccgtaagtcggttaactaacgtccgagtccggaacggcctacggtggtaccnccgacggcgtaaggttcgaaggtgggacgtagggtcgggttcggtacgggtactagtcgtttacgacttccggactaccgtntaccgacgtcctaaggtcgtgaccgtagttcgtaaggttaagtttgttttacgcgtttaaacggtttttactaccggttacgaccctaggtacacggtactaacgggttacgtacgtaccggttccgggtacccttcgtttaaaccggttccggttaccgggggtaaccgggggaacggttaaccccgggtaaaggggtaccgggtaaacgttaacccggtaaaaccggttaaaccgggttaccgggttagggtaccgggtaccgttacccgggtaaacctttacccggttaacgtttacccgg

SEQ ID NO: 98168 - DNA, 735 bp, Homo sapiens
  misc_feature: GYAE6OF02F4DY8.24.67.G01.1.454.CMB.1.raw
  modified_base (182)..(182): a, c, t, g, unknown or other
  misc_feature (182)..(182): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (589)..(589): a, c, t, g, unknown or other
  misc_feature (589)..(589): n is a, c, g, or t
tcagactactatgtcacgaccggtgctcgatttagagtatacatattgggtttggggggaactgctcagttaggacccagacggaaccatggaagccccagcgcagcttcgtcttcctcctgctactctggcctcccagactaccacgtggaagaaatgtacgatggacgtcgagtctaccngcctacctgtctgtcgtacctcggagggtaancgccaccgttcnctgcgtcggccagtnacggtagtaataacggcaacgtaactacgttaacgccgttagtactacgtaacctaacgaaaactccggtaccgaacgtcccctaaccgcggtaccttaccgtacctacgtacgttacggtggtaacttaccgaccggtaacggtaccggaaacggtccctaacggttccggtactaccgccgtccgtacggttcgacggttggacggtttggtacggtcggacggtaaccgtaaggttctactaccctacgtacctccgtacgtacgacgtacgtcctgtacgtctacggttactaggttactacgtttacgttaacgttaacgtttccttaacgtccgttaaccgngtacgtaacgctaacggtcaaccgtccggttacgcccgtcttacgtccgggttacggtcggtaccgggagttaccggataacccggtagtaaaccggtacgttaccggtggtcccgttcggaactcccgttaacctgtttacccgg

SEQ ID NO: 98169 - DNA, 763 bp, Homo sapiens
  misc_feature: GYAE6OF02HRDZE.24.67.G01.1.454.CMB.1.raw
  modified_base (667)..(667): a, c, t, g, unknown or other
  misc_feature (667)..(667): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctccagataccactggagaaatagtgatgacgctagtctccagccaccctgtctgtgtctccgagggaaagcgcccaccctcgtcctgacgacgggccagtcagagtaagtaaaggaacgacaaactacgttacgccgttaggtaataccgaaacgaacggtaaaaccgtcgggaccacggcccttaccccgaacgggtccttcctactaacttctaagttcgatttaccgttacctaacccgtaaacggacgggtttacctacccggtcgggacccccgttcccccggaccggtagggtttacccgaggttccggacgttaagggtcggggttacggtacgggacgtaacgttaccgttacctaccgttccgtaacccgtccgtacgacggtccgaacgtcccgtaggaaccgtccgtaaggtaacggtttctttagggtacccggttttactacgtcgtacgcggtctaccggtccgtccgtaccgggtcgtcccgttaacggttaccggggttccgggggccgggggtaaccgnggggttacggaacggacggttaacgtaccggtagtggtacggctccgtaccaccgtgttacgtccgttacacccgttgtttcccctccgcttaacg

SEQ ID NO: 98170 - DNA, 747 bp, Homo sapiens
  misc_feature: GYAE6OF02GZQLB.24.67.G01.1.454.CMB.1.raw
  modified_base (204)..(204): a, c, t, g, unknown or other
  misc_feature (204)..(204): n is a, c, g, or t
tcagactactatgtcacgaccggtgctcgatttagagtatacatattgggtttggggggaactgctcagttaggacccagacggaaccatggaagccccagcgcagcttctcttcctcctgctactctggcctcccagactaccactggagaaatagtgatgacgcagtctccacgccacctgtctgtcgtctccgaggggaanacgcccacctcgtcctgcgacgggccagtcaagagtaactaagaacgctaactacttacgccgttagtactacaaacgtaacgtaaaccgtcggtaccacgggtacctccccgtaagggtccctaccctaccgtacgttctagttacggttactacctacgaacggtcgaccgggtacctaaggttcggtcgaccccgtacgacccggtaggttaccgaaggttccggacgttgggttacgggtccggtaagggacgtacggtacgtttaccgtacctccgtacctaaccgtagtccgtaacggtacgtacgttaccgtcggtacgtacgttacgtaagttaacggttaacttttcggtaacgtttaacgtttttaacgttaccggtcgttaaccgtacgtaccgacggtacaacggtacgtagcccgtacggccgttaccggttcctacgggttaccggacgggtacgggtaccgtaagggtacggaagttaacgaaccgtaacgtacggtacgtacggtaccgacgtacctccgtatccgg

SEQ ID NO: 98171 - DNA, 788 bp, Homo sapiens
  misc_feature: GYAE6OF02I71UR.24.67.G01.1.454.CMB.1.raw
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
tcagactactatgtcacgaccggtgctcgatttagagtatacatattgggtttgggggaactgctcagttaggacccagacggaaccatggaagccccagcgcagcttctcttcctcctgctactctggcctcccagactaccactggaagaatagtgatgacgcagtcctccagcctaccctgtctgtcgtctccgagggaaancgccacctctcctgcngggccagtcagtataataagagctaactacttagcctaggtactcaactacgaacctggacctacggcctaccacggtcctcctactacttctaacgttggtaataccgtccaacggcaacgggtccctaacgtcggtcgtcccgtaacggtccgtaaggttcgaggttacggccgttaaggttcgggtaccgtagggaacttcggtacgtaccttaaccgccggtttacccaaaccgtcgtttacccgaacggtaccggtacggttaccgttaccgggtaccgttaacggtccggttaaacggttaacgggtttaacgttttccggtaacggtttaacgttttttacgtaaccggttaccggtaccttaacggggaccttacggtaaccgtacggttaccgtacgtacgttaccgggacccttccgttaaaccggtccgggtttaccggacgggggtaccggttaaaagggtccggggtaacggttaacggtaacggttaaccgaaaccgggttaacggtaacggttcggtttaacgacccggtaactaccggttacgtttaccgg

SEQ ID NO: 98172 - DNA, 654 bp, Homo sapiens
  misc_feature: GYAE6OF02H67PB.24.67.G01.1.454.CMB.1.raw
  modified_base (405)..(405): a, c, t, g, unknown or other
  misc_feature (405)..(405): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatggacgcagtcctccagccctaccctgtctgtcgtctccgaggggaaagacgcccaccctctcctgcgagggccagtacagagtaataaagacacaacgttactagtccgttaggtactacaaacgaggaaacctggaccaggccctacccgaggtccctccgtacacttaccgttagttaggtatacctccgaacgccgaccgggacctaagtcggtacgtcccacgccgtaggtcgaggtacggngtacgggtggtacgtaggaacgtaggtcgttaccaccgttactcccgaactcgagtacgctacgtgtcgacgtagttacgtaaggtacttagttttcgagtttacgtttacttacgacgaccagactacgctaacgcgtacgtcgtcgcccgttcgtccggtacgtcggggacggtaccggaaccgtaaggggtgaaccgtaacgaacgtaaaggccgtggtaccgaccgtacgaacttcgtaacttcg

SEQ ID NO: 98173 - DNA, 747 bp, Homo sapiens
  misc_feature: GYAE6OF02GHELL.24.67.G01.1.454.CMB.1.raw
  modified_base (336)..(336): a, c, t, g, unknown or other
  misc_feature (336)..(336): n is a, c, g, or t
  modified_base (386)..(386): a, c, t, g, unknown or other
  misc_feature (386)..(386): n is a, c, g, or t
  modified_base (530)..(530): a, c, t, g, unknown or other
  misc_feature (530)..(530): n is a, c, g, or t
  modified_base (611)..(611): a, c, t, g, unknown or other
  misc_feature (611)..(611): n is a, c, g, or t
  modified_base (722)..(722): a, c, t, g, unknown or other
  misc_feature (722)..(722): n is a, c, g, or t
  modified_base (735)..(735): a, c, t, g, unknown or other
  misc_feature (735)..(735): n is a, c, g, or t
tcagactactatgtcacgaccggtgctcgatttagagtatacatattgggtttgggggggaactgctcagttaggacccagacggaaccatggaagccccagcgcagcttctcttcctcctgctactctggctcccagactaccactggagaaatagtgatgacgcagtctccagcccaccctgtctgtcgtctaccgaaggggaaacgagcccaacccttctccgtggaacgggccagtcgaagatagtaaacgacgacctaacttaacttacgccgttaggtactaccgtaaacaaccggtaaacccgtcggacccgtaggtcccttaccccgngggtacccttccgttaccgtattaccgttaaggttacggttaacttaccncccgagacgggaaccgggccgtaacgttcgggtcccggttacccgacggttccggtaacggtttcgaagggttccggacgtggggttacggtacggtagggaacctagggttacgttcccacgttacccgtacgtaacccgtanccggtaacgcttacggtctacggtggtaaccttggttaagtaaacgtttcgtttacgaccttttaggtttaaaccttaccncggtaacccgacgcgttaacccggtagacgttacggtaccgtgtaccggtcctacttacgtcgggttacgggacggacgtacggaggtacgacgtaacctagaccgttggngtagcgtacgacncgttacgtgtcc

SEQ ID NO: 98174 - DNA, 731 bp, Homo sapiens
  misc_feature: GYAE6OF02FW05M.24.67.G01.1.454.CMB.1.raw
  modified_base (206)..(206): a, c, t, g, unknown or other
  misc_feature (206)..(206): n is a, c, g, or t
tcagactactatgtcacgaccggtgctcgatttagagtatacatattggggtttggggggaactgctcagttaggacccagacggaaccatggaagccccagcgcagcttctcttcctcctgctactctggcctcccagataccactggagaaatgtgatggacgcagtcaccagcccaccctgtctgtcgtctacgaggggaacngccctaccctcgtcctggcgacgggccagtcaggaagtaagtaaagaacgactaacgtacttagccgtaggtactacaacgtagaaccgtggaccaggtcctacccgaggtcctcctacattcgtacgttggtatactccgagccgtacgcccagtcgtaccgtcccaggtccgtaggtcgaggtgacggttaggtcgggtgacgggactagggtaacttcacctccaccgtaacctggacctaggacctacggttcgacggttacgtgtttacgtaacggttacgtttacggtttcgtaacgttttaaggttttacttcggttaccggacttaacggtaccacggttaccaacgggttacgtacgggtaccgttccggtaacccgttaccgtttccggttaacccgggttaccggggtcggaaaccggggttcggtaacgggttaagaaccggtaaacggttaacccggtaaacggttacggttcgggttacggaccttccggaaccctttaggccgttttacg

SEQ ID NO: 98175 - DNA, 659 bp, Homo sapiens
  misc_feature: GYAE6OF02HH830.24.67.G01.1.454.CMB.1.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
  modified_base (423)..(423): a, c, t, g, unknown or other
  misc_feature (423)..(423): n is a, c, g, or t
tcagactactatgtcacgaccggtgctcgatttagagtatacatattgggtttggggggaactgctcagttaggacccagacggaaccatggaagccccagcgcagcttctcttcctcctgctactctggctcccagataccactggagaaatagtgatgacgcagtctccagccaccctgtctgtcgtctccgaggggaaancgccctaccctctcctgacgagggcctagtcagagtaataagacgcaactagtacgccgtaggtanacaacagaacctggaccaggtcctcccgaggtctcctctacttctaagtcggtaactcgtaccaggtaccgacgggtccctaggtcggtctaccccgagtcccgtaggttcgagttcggacgtaggttcgggtcgtagggactaggtactttcnccgttctacgactatcgaagtcctaggttcctggccttaggtcgtaaggtacgtttagtttcggactttaacgttttattcgccgtcgtacgctaacgcgtacaggttcgccggcggtcctcgtaccgttacgggtttccgggaccggggtaagggtacccggtaaggggttacgacggtaacttaaacggaaccggtacgttggtaccgggctacggaccgtaccgtattcccgg

SEQ ID NO: 98176 - DNA, 817 bp, Homo sapiens
  misc_feature: GYAE6OF02GSKCM.24.67.G01.1.454.CMB.1.raw
  modified_base (158)..(158): a, c, t, g, unknown or other
  misc_feature (158)..(158): n is a, c, g, or t
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
tcagactactatgtcacgaccggtgctcgatttagagtatacatattgggtttggggggaactgctcagttaggacccagacggaaccatgggaagccccagcgcagcttctcttcctcctgctactctggctcccagataccactggagaaatagtnatgacgcagtctccagcccaccctgtctgtntacctccgaaggggaaagcgcccaccctntcctgccgagggccagtcagagtataagaagacaactacttagcctaggtactacgaacacggaacctggccgagccgtcccgaggtcctcctcactcgtagttaggtactacgtcgacggcgacgggacctagtcgggtcgtccgacgtaccgtaggttcctaaggtcggacgttagggtggtacgggtagggaacagtacgttccgaacttccgtacaaccgtagtaccgacgtaccgtaacggttcctacggtacgtacggttacggtagtaaacggttttacttttcggtaacgttttaacggttttaacgtttacgtaccggttaccgtaccggtacgtaaccggtaccgtaaacggttacgggtaccgtttaaccgggtacccgggttaccccggtttaccgttaacccggttacccggggtttacccgggggaaccgggggttacccggggttaaacgggttaaccggggtaacggtaaccgggtaaaccccgttaaaccgggttaaaaacccgggttacgggttaacggggtttaccggtaccggtttaaccggtaacccccgtttacggttaaccccgttttaacccggg

SEQ ID NO: 98177 - DNA, 548 bp, Homo sapiens
  misc_feature: GYAE6OF01D84TN.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaatgatttaggctaggtatacaaacaaaaacgtagggagacgacccctaaactcctagatctatgctgcatcctagtttgcagacgtcgggtaccatacgaaggttcagcgcagtgatcgtggcacagtatttcactctcaccatcagcacgcctgacacgtcctagaagttattttgacttaacttattactgtactaacgtaatacttacgtacttacccgtcggtacgttccggaccgtaaacgggaccgtaagggtagaacgtaactaaccgtaaacgaacgttggtacggtacctagacctaccgtacg

SEQ ID NO: 98178 - DNA, 509 bp, Homo sapiens
  misc_feature: GYAE6OF01BVOIS.17.1.A01.1.454.CMB.1.raw
  modified_base (504)..(504): a, c, t, g, unknown or other
  misc_feature (504)..(504): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaaacaaaaactagggagagcccctaaactcctgatctatgctgcatccagtttgcagactgggtcccatcaaggttcagcggcagtggatcgtggcacagtatttcactctcaccatcagcagcctgcagcctgaagtattttgactaactttattactgtactacaagtattaccgattacccgtggtaccgttcggaccgaagggaccgaagggtggagactacgaaacgtaactgtacggactgccncgtac

SEQ ID NO: 98179 - DNA, 504 bp, Homo sapiens
  misc_feature: GYAE6OF01CVH4Z.17.1.A01.1.454.CMB.1.raw
  modified_base (363)..(363): a, c, t, g, unknown or other
  misc_feature (363)..(363): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagcgtagactagcacgaccggtgctcgatttagacgtctcatcaggaggtcaggacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaaactagggagacgacccctaaactcctgatctatgctgcatccagtttgcagacgtgggtcccatcaaggttcagcggcagtggatctggcacagtatttcactcncaccatcagcagcctgcagcctagtaagtattttgacttaactttattactgtactaacaagtacttacgtacttacccgtcggacgttcggaccgtaagggaccaaggtgagatacaaacgactgngctgcacntcgtcg

SEQ ID NO: 98180 - DNA, 542 bp, Homo sapiens
  misc_feature: GYAE6OF01AYQ43.17.1.A01.1.454.CMB.1.raw
tcagcgtagactagcacgaccggtgctcgatttagacgtctcatcaggaggtcaggacccaacgtcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaaacgtagggagacgacccctaaactcctgatctatgctgcatccagtttgcagacgtcggggtcccatcaaggttcaggcggcaggtggatcgtggcacagtatttcactctcaccatcagcacgcctgcagcctagtaatcttttgactaactttattactgtactaacaagtattaccgtactttacccgtcgggtaccgttccggaccgaacgggtaccgaaagggtggaacgtacgtaacgaaacgtacgtgtcggtactacgacctaccagttcgtcg

SEQ ID NO: 98181 - DNA, 513 bp, Homo sapiens
  misc_feature: GYAE6OF01CBQEJ.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagcccctaaactcctgatctatgctgcatccagtttgcagactggggtcccatcaaggttcagcgcagtggatcgtggcacagatttcactctcaccatcagcagcctgcagcctgaagtattttgactaactttattactgttactaacgtaagtacttaacgactttaccctcggtaccgttcggaccaagggaccgaagggtggagatacgaaacgaacgtgtaggactcgcgacctacg

SEQ ID NO: 98182 - DNA, 718 bp, Homo sapiens
  misc_feature: GYAE6OF01C47J6.17.1.A01.1.454.CMB.1.raw
  modified_base (213)..(213): a, c, t, g, unknown or other
  misc_feature (213)..(213): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatccctccctgtctgcatctgtaggagacagagttaccatcacttgccgggnaagtcagggcattagaatgatttaggctggtatacaaacaaaaactagggagacgacccctaaaatcctgatctatgactgcatcctagtttgacaggacgtcggggtacccatacgaaggttcaggcggcgtaggtggaacgtcgtcgggacacgaagtactttcacttctaccacctaactccacggaccaggtccctggacctacggcccttaaggtaaacgtttacgttttacgtaaccttaaacgttttaacttaaccgtttaggttaacccttaaacgtaaacggttaacgtttttaacccgaaaccggtttttaacccccgtaccggggttaacccggtttaccggggaaccccggttaaaaacgggggtaaccccggtaaaaggggtaccgggtaaacggtaacgttaaacccggaaaaaccgggttaaaccgttcgggttaaaccgggtaccgttacccggaaccgtaaacccccgttagtttcccgtttaaccgg

SEQ ID NO: 98183 - DNA, 715 bp, Homo sapiens
  misc_feature: GYAE6OF01CCG9D.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatcgacccagtctccactccctccctgtctgcatctggtaggagacagtacgttaccatcacgttggccggggacaaggtcgaggggactaagtttaagaaagtgaagttttaagggcttgggtaataccaaaacgaaaaacgtaggggaacgaacggtaccccctaaactccctagatcctatgctgcatcctagtttgacagtaccgtcggggtacccagtaccgaaggttcgaggcggcgtagtggactcgtcggacacgtagttacttcaccttcctaccacctacgtaccacggtaccacgtcccgtcggaccgtaccggacccgttaggtaaagttacgtttttacggaacctttaaaccttttactttaaccgttcggttaaaccttaacgtaaagttaacgtttaacccgttaaccttaccccggttacgggtaccgttacccgggaacccgtaaacgggggtaacctaaacgggggtacggaacggttaagtaacccggtaaaacgtacgttacggttacgggtcgtacgtaccgaacccttagttcccgtttaaccgg

SEQ ID NO: 98184 - DNA, 525 bp, Homo sapiens
  misc_feature: GYAE6OF01D6CSN.17.1.A01.1.454.CMB.1.raw
  modified_base (392)..(392): a, c, t, g, unknown or other
  misc_feature (392)..(392): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaaacaaaaacgtaggagagacccctaaactcctgatctatgctgcatccagtttgcagactggggtcccatcgaaggtcagcggcaggtggatcgtggcacagtatttcactctcaccatcagcagcctgcacgcctagtaagtnttttgactaacttatttactgtacctaactaagtactttacgacttacccgtcggaccgttacggaccgaagggacccgaaagggtggagtatacgaaacgaacgtgtacggtctacgaccactatcgttacg

SEQ ID NO: 98185 - DNA, 726 bp, Homo sapiens
  misc_feature: GYAE6OF01B2A7N.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatcgacccagtcctccatccctccctgtctgcatctgaggagacagacgttaccatcacgttggccgggcaagtcagggcaagttaagaaatgatttaggctggtatacaaacaaaaacgtagggagacgacccctaaactcctgactctatcgctgctatcctagtttcgcaaggaccgttcggggtaccctagtacgtaacgggttcgaaggccggacagggtggacgtcgtcggactaacgagtactttaccgacttcctaccacctaatccgaacgtaccgtacgcccgttacgacgtacgtcccgtaaggtaaacgtttacgtttttacgaacctttaaaccttttacgtttaacgttacggtttaacccttaaacgtaaacgttaacgtttaacccggtaaaccttttaccccggtaacgggttaacccgggtttacccgggggaaacccgttaaaaccggggaaacccggttaacgggggtaagggaacggttaaacgtaaacccgtaaaacgggtaaacccggttggttaacgggtacctccggtaaccgtaaccgtttaaccg

SEQ ID NO: 98186 - DNA, 723 bp, Homo sapiens
  misc_feature: GYAE6OF01CVTLF.17.1.A01.1.454.CMB.1.raw
  modified_base (222)..(222): a, c, t, g, unknown or other
  misc_feature (222)..(222): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtcctccatcctccctgtctgcatctgtaggagacagtagttaccatcacttgccggganaagtcgaggctatagaatgatttaggctaggtatacaaactaaaacgtagggacgaacgacccctaaactcctagtactctatcgctgactactccgtagtttgacgtacgacgtcgggtacccagtacgaaggttcaggcggacgtaggtcggtatcgtggactaacgtagtactttcaaccttcctaccgtaacctactaccacgtccgaacgtcccgtggacctacggtacccgttaaggtaaacgtttacgtttttacgaaccgtttaaactttttaacgtttaaccttacgggttaaccttaaacgtaaacggtttaaactttaaccggtttaaccccgttttaccccgggtaaccgggttaacccggtttacccgggaaacccgggtaaaccgggggtaaacccgtaaagggggttacgggtaaacgtaacggttaaaccgtaaaaaccggtacgtttacgggtacggtaccttaacggccctaaccgttaaccg

SEQ ID NO: 98187 - DNA, 596 bp, Homo sapiens
  misc_feature: GYAE6OF01DLYQC.17.1.A01.1.454.CMB.1.raw
  modified_base (187)..(187): a, c, t, g, unknown or other
  misc_feature (187)..(187): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtagganacagagttaccatcacttgccgggacaagtcaggcaattagaaatgatttaggctggtatacaaacaaaacgtgggaagacgacccctaaactcctagatctatgctgcatcctagtttcgctagacgtcggggtccctaagtccgtaaggttccaaggtccgggcgtaggtcggatcgtggactacgagtatttcaccttctaccactatccgagtccgacgtcctggaccgtacgaccgttagtaagttagttttacgaacctttaactttatttacgtacgttacttaacaagtactttaccgaactttacccgtacggtaccggtacggtacccgtaagggaccgtaaggtggaagacgtaacgaaacgtacgtagtcggtactacggacctacctagtcttacg

SEQ ID NO: 98188 - DNA, 535 bp, Homo sapiens
  misc_feature: GYAE6OF01B8LA7.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaaactagggagagacccctaaactcctgatctatgctgcatccagtttgcagacgtggggtcccatcaaggttcagcggcagtggatcgtggcacagtatttcactctcaccatcagcagcctgcagcctagaagtattttgacttaacgtttattactgtactaacgaagtacttaacgtacttaccccgtcgggtaccgttccgggaccgtaacgggaccaaagggtggaacgtataccgaaacgacgttggtacggtctacgaccacctagtcttacg

SEQ ID NO: 98189 - DNA, 719 bp, Homo sapiens
  misc_feature: GYAE6OF01CQQLB.17.1.A01.1.454.CMB.1.raw
tcagcgtagactagcacgaccggtgctcgatttagacgtctcatcaggagtcagacccactcgaggacacagcatggacatcgacgggtccccgctcagctccgtggggcctcctgctgctcgtggcctcccgaggtcgccagatgtcgccataccaaatcgacccagtcctccactccctccctgtctgcatctgtaggagacagtacgttaccatctacgttcggccgggacaagtcgagggctaagttagaatgtagtttaggctaggtaatacaaaactaaaaacgtagggagaccgtacccctaaactcctagtatactagtgcgtcgacactccgtagtttcgacgtacgtacggttccggggtaccctagtaccgtaacggttcgacggtccgggacgtaggtggtactcgtacggaccacgtaacgttacttttaccaccttcctacccgtaacctagtaaccgacgaccgtacggtcccttacgggacccacggttacccgtaaggttaaacgtttaacgttttacggaaccttttaaacgtttacttaacgttcggtaacctaacgtaaacgttaacttaccgttaccgtttaaccccgtcgggtacccgttacggaacccgtaaaggggtaacccgtagggtaggaacgtaacgtaaccgtaaaacggtacgtggcggtacgtacgaccgtaacctgttcccgttacg

SEQ ID NO: 98190 - DNA, 578 bp, Homo sapiens
  misc_feature: GYAE6OF01CU46Q.17.1.A01.1.454.CMB.1.raw
  modified_base (219)..(219): a, c, t, g, unknown or other
  misc_feature (219)..(219): n is a, c, g, or t
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggnaagtcgagggcattagaaatgatttaggctggtatacaaacaaaaacgtagggagacgacccctaaactcctagatctatgctgcatcctagtttgcagacgtgggtcccagtacaaggttcaggcggcaggtggtatcgtaggcacagtactttcactctccactancagcacgtcctgccacgcctagaagttnttttacgacctaaactttacttacgtacgttactaaacgtaagtacttaacgtacctttacccgtaccggtaccgtttaccgggacccgaaacgggtaccggtaaggtacggtaaggacgtaacgtaaacgaacgtacggtagggtacctacgcgaccctacg

SEQ ID NO: 98191 - DNA, 597 bp, Homo sapiens
  misc_feature: GYAE6OF01DJ7LQ.17.1.A01.1.454.CMB.1.raw
  modified_base (275)..(275): a, c, t, g, unknown or other
  misc_feature (275)..(275): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttggccgggacaagtcgagggcaattagaaaatgtatttaggcttggtactacaaaacaaaacgtagggaanacgacccctaaatcctagatcatgctgcactctagtttgacaggtaccgtcggggtaccctagtaccgtaaggttccgacgcggacgtagggtcgtactcgtggacacgtagtactttcacttctacacctatcagcacgcctagcgtacgctagtaagttatttcgacttaacgtttactactagtactaactaagttacgttaccgtacttacccgttaccggacggttccggaaaccgagggtaaaccgtaagggtaggtaaacgactaaacgtaaaccgaggtcgtacggcctacgaactacccggtattccgttacg

SEQ ID NO: 98192 - DNA, 626 bp, Homo sapiens
  misc_feature: GYAE6OF01CC8YQ.17.1.A01.1.454.CMB.1.raw
tcagcgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttaccaacagaagcctggccaacgcccccaggacactgatttatgataacaaacaacaaacactcctcggacccctcgcccggttctcgacggcctcccgtcggttcgggggacaaacggctcgccctcgtaccccgttttcggggtgccggccacggcctaggacgggtagtggacggtcgttggaagttagttacgtgtcttacgcttccttacctagttacgggttcggttggtttcggggtggttccgggcgggtaacggacaggtctcggaccgttcgtacggtccgacggtcccgaaggtccgtccgcccccgtggtccctacgttccgttcccggttcccctcccgttcccgttacccg

SEQ ID NO: 98193 - DNA, 690 bp, Homo sapiens
  misc_feature: GYAE6OF01B94FT.17.1.A01.1.454.CMB.1.raw
  modified_base (680)..(680): a, c, t, g, unknown or other
  misc_feature (680)..(680): n is a, c, g, or t
tcagcgtagactagcacgaccggtgctcgatttagacgtctcatcaggagtcagacccactcaggacacagcatggacatcagggtccccgctcagctcctggggctcctgctgctctggcctcccaggtgccagatgtgccataccaaatcgacccagtctccatccctccctgtctgcatctgtaggagacagtagttaccatcacgttggccggacaagtcagggcattagaatgtatttaggctaggtatacaaaacgtaaaaacgtggggaacgtaccgaccccctaaactccgtagtacttcttagtcgacttgacctacttccgtagtttgacctacggtacggtcggggtaccctagttaccggtaacggttcgaacgggtccggacgtaggtacggtacgttcgtacgggacctaacgtagtacgttttaccgaccttacctaccaacctagttccgaacgtcgaacgtcctagaccgtacggtcctaagtaacgtttactttcgaaccttaactttattaccttacgtacctaaagtaacgtacttaaccggtaaccctttacccggacggttaccgtaccgggaacccgtaaacggggtaccgtaagggtacgaaacgtactaaacccggtaaacgtacggtgtacggtactaccggactaacccgttntcggttaccg

SEQ ID NO: 98194 - DNA, 787 bp, Homo sapiens
  misc_feature: GYAE6OF01A7Q6E.17.1.A01.1.454.CMB.1.raw
  modified_base (223)..(223): a, c, t, g, unknown or other
  misc_feature (223)..(223): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatcgacccagtcctccactccctcctgtctgctatctggtaggagacagtacgttaccatctacgttcggccgganaagtcgagggctaagttaagaagttgtatttagggcgttaggtaactaacgaaaacgtaaaaggtaggggaactacccggtaacccctaacttccgtagtacttaccgtagtcgtcgtacgtacctagttcccgttaagttcggaacgtacgggtacccggtaccggggtacctacgttacggtaacggttacggacgggtaccggtacggtacggttcggacgtttccggacggtacccgtaaggtttacgttaccctttaccgtaacccttccgttaacccaccgttacgtaccgtacggtacccgtaccgtcgtaccggaccgtaacggtacccgttaaggttaacgttctttacgaaccttactttactacgttaccgtaagtaaccgttaagttacccgttaccgttaaccgttacccgggttaccgggttacccggttaaccggaaccgggtaaccggggtaaaccgggttagggaaccggttaataaccgggttaaaccaaacggttacgggtcgtaacgggttcgacctaacccgtttacgcggtttcccgttacg

SEQ ID NO: 98195 - DNA, 696 bp, Homo sapiens
  misc_feature: GYAE6OF01DWEFN.17.1.A01.1.454.CMB.1.raw
  modified_base (243)..(243): a, c, t, g, unknown or other
  misc_feature (243)..(243): n is a, c, g, or t
  modified_base (491)..(491): a, c, t, g, unknown or other
  misc_feature (491)..(491): n is a, c, g, or t
  modified_base (656)..(656): a, c, t, g, unknown or other
  misc_feature (656)..(656): n is a, c, g, or t
tcagcgtagactagcacgaccggtgctcgatttagacgtctcatcagggggcaggagtcagacccactcaggacacagcatggacatggacgggtccccgctcagctccgtggggcctcctgctgctcgtggcctcccgaggtcgccagatgtcgccataccaaatcgaccctagtcctccactccctccctgtctgctatcgtggtaggacacgagtacttaccatctacgtcgggccgganaaggtcgagggtactaagttaagaagtcggtagtttaggacgtaggtaactaacgaaaacgaaaacggtagggaacgacccgtaacccttaaacgtcctagtacttactagtcgtctcgactacgttcgtagtcgacgtacggtaccggtacggtacctacgtacgtaacggtcgacggtcggacgtaggtcgtacgtccggacgacgtacgtacgttaccttaccgtacctccctaacacccgttanaccgtacgcccgtaacggcgttacgacccgtacgttacgtaaagggtttactttaacggtttactaacttaactttacgtacttacgtaactaagtaaacgttcctaacgttacccgttaccggtacgggtaccctacggtaacggaaggtacggagaccgtaanaacgtaacgtacgtaggttcgacgtcgaccacgtacttcg

SEQ ID NO: 98196 - DNA, 775 bp, Homo sapiens
  misc_feature: GYAE6OF01EMRTI.17.1.A01.1.454.CMB.1.raw
tcagcgtagactagcacgaccggtgctcgatttagacgtctcatcagggggcaggagtcagacccactcaggacacagcatggacatggacgggtccccgctcagctccgtggggctcctgctgctctggcctcccgaggtcgccagatgtgccataccaaatcgacccagtcctccactcctccctgtctgcatcgtaggtaggagacagtacgttaccatcctacgttcggccgggactaaggtcgagggtactaagttaaggaaattggttaattttacggcgttagggttaactaacctaaaaacaaaaaaaccggttagggggaacggtaacccgtaaccccccgtttaaaaaccttccccgttaaggtaacttacgtttaacgtcggtaccgtgtacccgtactttacccgtaggttttacgaccgtaacgggttaacccggttccgggggttacccctaaaggttaacggttaaacgggttccgacgggaaccccgggtgtaaggggttcgtaacgtttcgggacgggtaacctaacgtacggtttaacttttccgaacctttccgacctaactacgtacccgacgtaaccgacttccggagacccgttacgtacccgtaggttaaattccgttttagaccctttaatttacgtacgttacgtacctaagtaacttacttacgtaccttaccggtcggtacgttaccggacgtaacggtacgtagggagacaacgtaacgaaactacgtggtacgagacctgcttacg

SEQ ID NO: 98197 - DNA, 814 bp, Homo sapiens
  misc_feature: GYAE6OF01DHKVZ.17.1.A01.1.454.CMB.1.raw
tcagcgtagactagcacgaccggtgctcgatttagacgtctcatcagggggcaggagtcagacccactcaggacacagcatggacatgacgggtccccgctcagctcctggggctcctgctgctctcgggcctcccgaggtcgccagactggtcgccataccaaatcgacccagttcctccactccctcccttgtcctgctatcgtaggtaggacgactagtaacgttaccactaccgtacgttcggccgggtacaacgggtcgaggggtacttaaagttaaaggtaagttaggttaacggttttacggcgttaacgggttaacaaaaccgaaaaaacggtaaaacggtaggggaaccgaacccggtaacccccttaaacgttccccgtataccttacgttacgtcgtctacgtacttaccgttaccttagggttcaccggtaacggtaccggttcgggtaccaggttacggtacggttacgacggaccggtgtaacggtggtaacgttcggtacgaccgtactacgtttactttaccgactttaccaccacctagtccgtaactccggactccggtacggacctacggtacgttaagggtttaactttaccgttttaccggtaatttaaccgtttacttaaccgttaccttaaactaggttaaaccggttaccttaacccggttaacccggtttccgggttaacccgggccgttacgggtaaacccggtaaggggttaaccggagggtacggaaactacggttaaacccggaaagttaccgtagggtcccaacgttcaacccgtacgtttccg

SEQ ID NO: 98198 - DNA, 743 bp, Homo sapiens
  misc_feature: GYAE6OF01CCCAE.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccataccaaatcgacccagtctccatcctccctgtctgcatctgtaggagacagagttaccatcacgttggccgggacaagtcgagggctaagttagaaatgtaatttaggcgtaggtaatacaaaacgtaaaaacgtagggacgaaccgtacccctaaactccgtagtaacttctatcgtctagctacgtccgtagtttcgactaggtaccgttcggggtacccctagttaccgtaacggtttccgaacggtcgggacgtaaggttcgggaactccggtagggaccaacgtacgttacctttacgaccttcgtaaccctaacctactaccgaacgtaccgtacggtccctacggaccgtacggtacccgttaaggtaaacgttttacgttttaaccggaaccttttaaaccgttttaacttaccgttacgttaaccttaacgtaagttaccctttaacgtaaccgtttacccgtaccgggtaccgttaaccgggaaccggtaaacggggtacccgtaaaggggtacggtaaacgtaacctaaaccggtaaacgtccgggttagtccggtacgttacggaacctaccccgtgttccgttaccgg

SEQ ID NO: 98199 - DNA, 726 bp, Homo sapiens
  misc_feature: GYAE6OF01EJDXC.17.1.A01.1.454.CMB.1.raw
  modified_base (162)..(162): a, c, t, g, unknown or other
  misc_feature (162)..(162): n is a, c, g, or t
  modified_base (186)..(186): a, c, t, g, unknown or other
  misc_feature (186)..(186): n is a, c, g, or t
  modified_base (194)..(195): a, c, t, g, unknown or other
  misc_feature (194)..(195): n is a, c, g, or t
  modified_base (204)..(204): a, c, t, g, unknown or other
  misc_feature (204)..(204): n is a, c, g, or t
tcagcgtagactagcacgaccggtgctcgatttagacgtctcatcagggggcaggagtcagacccactcaggacacagcatggacatgagggtcccgctcagctccgtggggctcctgctgctctggctcccaggtgccagatgtgccatccaaatgacccngtctccatcctcctgtctgcatcnggtaggannagtactacntactcgtacggccggaatacgaggagtatagttaagagtggttaagtaggcgttaagtaactaaacgaaaaacgtaaacgggtgggaacaccccgtaaacccttaaccgtgtaacgtaacttcagttacacgtcccaagttttcccaagttttggcctaaccggggtacggtacggtaccggtacgtacgtaacggtacggtacggtacggtacggtacgtaggtacgtacgtacggtacggtacgtacgtaacgttacttacctaccttacctacctaacgtacgtacgaccgtacgaccgaccgtaccgtacgtaccgttacgttaacgtaacgtttacgtttacgttaacttaacgtttaacgttaacgttacgttaacgtaaacgtaacgtttaaccgttaaccgttacccgttaccggtaccggtaccggtaaccggtaacggaacggtaacggtaaggtaacggtaacgtaacgtaaacgtaacgtacggtacggtacgtacgtacgtaccgtacg

SEQ ID NO: 98200 - DNA, 750 bp, Homo sapiens
  misc_feature: GYAE6OF01CHX90.17.1.A01.1.454.CMB.1.raw
  modified_base (200)..(200): a, c, t, g, unknown or other
  misc_feature (200)..(200): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggcctcccaggtgccagatgtgccataccaaatcgacccagtctccatccctccctgtctgcatctaggtagganacaggtacttaccatccgtacttcggccgggacaagtcgagggtctaagttagaagtgtatttacggcttaggtaactaacaaaacgaaaagtacgggacgaccgtacccctaaactccgtagtactctagtgctcgtactagtaccgtagttcgactaggtaccggtcgggtaccctagtacgtaaggtcgaggcgtcaggtgtacgtcgtcgacacgtagtacttacgtacctacctaccaaccgttataccgacgcgtacgtcccgagtacccgacgttaccgttagtaaacgttttacgttttaccgaaaccttttaaccgttttaacgttaccgtttaacggttaaccctaaacggttaaccggtttaacgttaacccccggttaaccgtttaaccccggttaccgggttaaccccggttacccggggaaaccggtaaaccggggtaaaccggttaacggggtaacgggttaaacggtaaacgtaaacccggtaaaacggttcgtaacgggttaccgacctaaccggtcccttaaccgttaaccg

SEQ ID NO: 98201 - DNA, 772 bp, Homo sapiens
  misc_feature: GYAE6OF01ESFDE.17.1.A01.1.454.CMB.1.raw
  modified_base (171)..(171): a, c, t, g, unknown or other
  misc_feature (171)..(171): n is a, c, g, or t
tcagcgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggacnccctcactgactgtcgtacccaggagggacacgtcactctcgactggcgctccagcacgtggacgcgtgtccacctagtggttccatactccctacgtcggttaccaacacgaacgcctaggcccaaccgacccccaggtacactgtatttcgagtacaaacaaaccaaaacgaacaccctggaacccgtcctccgtaccgtctaacgccgtccgtccgtcggggtacggacgaacgtcgtccgtaccgtcccgttaccggttcgggtacgtccgccgtaccggtccgtaagggtacgtacggtaacgggtcgtaaccggtgtaacgttaccgttacgtccgggttcttccgtaccggttcccttaacggttcggttacggggtttacgggtttcggggttttaaccggggttcgggtttaccgggggaacgggtaccgggtaacggtacggtaaccggttaccgggaccggtttacccggtaacgggtcccgtacccggtacccggaacccggttcccggcccccggtttacccgtcccggtttccctacccgtttaccggttaccccccttacccggttcccctacccggtttaccccg

SEQ ID NO: 98202 - DNA, 733 bp, Homo sapiens
  misc_feature: GYAE6OF01EQTYY.17.1.A01.1.454.CMB.1.raw
  modified_base (316)..(316): a, c, t, g, unknown or other
  misc_feature (316)..(316): n is a, c, g, or t
tcagcgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggacgccctcactgactgtcgtcccagggaggacagtcactctcacctgtggcctccagcacgtggacgctgtccaccaagtggtacattatccctactcggttccaacagaagcctaggccaagccccccaggaccactcgtatttagngaataacaaactaaacaaacacctaccgtcggacccctgtcccggttctcgacggcctcccgtcggttcgggggacaaacgccgtacgtccccgtacggtaccccgtttcggggtcgccggaccgacggtcccgtagggaggtatcgggtaacggccgttagggtaagtttaacttacgttgttccgttacgtccgttccgtacctttagttacggttgggtttcggtttacgggggttcggttccggggtacggggtaacgggtaacccgtaacggtccggttacggtacccggttaccgttacgggtaccgaccgggaccccgtaaacgggtccctccccggtaccccccgttcgggtacccgtacccgttcccgttaccccggtttccccccgttcccttccccgttaccccgg

SEQ ID NO: 98203 - DNA, 627 bp, Homo sapiens
  misc_feature: GYAE6OF01BU9CJ.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatcgacccagtctccatcctccctgtctgcatctgtaggagacagtacgttaccatcacttcggccggacaagtcgagggctagttagaaatgtagttaggctaggtaactaacaaaacgaaaacgtagggacacgtacccctaaactcctgactctatgactgacctactccgtagtttcgacgtacggtacggtcgggtacccagttaccgaacggttcgacgggtcggacgtaggtacggtacgtccgtacgggacctaacgtagttacctttccgaccttccgtaccaacctcgtaaccgacgtaccgtaccgccgtacgacgacgtaccgtagtaacgttattttacgactttaacttacttacgtactaaccgtactaagttacgttaccgtacttaccgtacggtacgtacggacgtaacggacgaggtacgacactaacgtacgacgtcgacgtctacgacactgttcgtac

SEQ ID NO: 98204 - DNA, 774 bp, Homo sapiens
  misc_feature: GYAE6OF01B02NS.17.1.A01.1.454.CMB.1.raw
  modified_base (223)..(223): a, c, t, g, unknown or other
  misc_feature (223)..(223): n is a, c, g, or t
  modified_base (747)..(747): a, c, t, g, unknown or other
  misc_feature (747)..(747): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctccaggtgccagatgtgccatccaaatgacccagtctccactcctccctgtctgcactctggagagacagacgttaccatcacttcggccggtanaaggtcgacgggctaagtaagaattgtaagttacggactaggtaacttaaccgaaaaacgtaaaaaacgtacggggtaagaaaccggtaccccttaaaaaccttcccgtaggaaacctttcgtaagtccggtcttacggactacctacctaaggttttccgacgtaacggtaccgtcgggggtaccccagtaccgaaggggttacacggtcggcgtaaggtcgtattcgaggtacaacgtattacttccgacttacctacaacccctagacctaggtaacgtaaccgtccgttaacgccgtaaacggcccgtttaaggtaaacggttttacctttaggtaacctttaaagttttacgttaccgtacggttaaaccttaccgttaaaggtaaaaccgtttaccgttaaacccgttcccggtaaaccgggtacgtttaccccggggaaaccaaacgggggttaacccggtaaaggtaaccgggaaactaaacgtaaccggaaaacgttacgtacgggttacccggnttaacccggacgttattaaaccccggg

SEQ ID NO: 98205 - DNA, 702 bp, Homo sapiens
  misc_feature: GYAE6OF01AQAR9.17.1.A01.1.454.CMB.1.raw
  modified_base (425)..(425): a, c, t, g, unknown or other
  misc_feature (425)..(425): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagcgtagactagcacgaccggtgctcgatttagacgtctcatcagggggcaggagtcagacccactcaggacacagcatggacatgagggtccccgctcagctccgtggggcctcctgctgctctggcctcccgaggtcgccagatgtcgaccataccaaatcgacccagtcctccactcccgtcccttgtctcgctatcgtggtaaggacgacaagtacgttaccatcctacgttcggacccgggactaaggtcgagggtactaagttaagaattggtaagtttggcctaggtacaaccgaaaacgaaaggtcgggactacccgtaaccccttaacgtccgtagtacttaccgtagtcgacgtacgacctacgttccgtaagttcgacgaggtccggtcggacctagtacgagtcgaggcgngtaggtagactcgacgcaagtcttactacctctacnccctanaactcgacgacctaccgtcacgctacgtacgtaagttacttcgtttaacgacctttaacgtttacttcgtaacgttaaccaagttaacgttaccgttaacccgttccgtttaaccccggagggttacccggaaccgtaccggggtaaaacccgggtagtaacggggtggaaactaacccgggtaaacgtaaaccgtacgggttcggaaccctacgtaccacccgttaattcccgg

SEQ ID NO: 98206 - DNA, 878 bp, Homo sapiens
  misc_feature: GYAE6OF01A5J9B.17.1.A01.1.454.CMB.1.raw
  modified_base (173)..(173): a, c, t, g, unknown or other
  misc_feature (173)..(173): n is a, c, g, or t
  modified_base (358)..(358): a, c, t, g, unknown or other
  misc_feature (358)..(358): n is a, c, g, or t
tcagcgtagactagcacgaccggtgctcgatttagacgtctcatcaaggaaggaggaacagaaagagaggagtcccttccaatatcagcacatggcctggactcctctctttctcgttcctcctcacttgctcgcccaggtccaacttcccaggctgtggtgactcgaggacnccctcactgactgtcgtcccgagggacggacacgtcactctcctacgtgtcggcctccagcgacgtggacgtctcgtaccaacagttcggtactacttacgtcccttaagttcggtacctaaacgaggaaccgccgtacggacccgaaccgcccccggaagaccacgttagttaacttttaacgngttaaacaaacaaaaccctaaaactaaaccacccgttccgtaccggtaaccccgtttccggtaccccgttcaccggtaccggtcccgttacccggttacggggtacggggtaaccaaaccgggtccgttaccggtccccgttaaccgggtttccccgttttaaccgggggcctccgggtaccgtaccggtcggttacgggtaaggtacgggtacggtaggtaccgttaaggttacgtttaaccggttacgtttcgttcgtttcccggtactttaccgttacgtttacggtttagggtttcggggttcggtttacgggggttcggggtttaccggggcccggggttaaccgggtaacgtaccgggtacttacccgggtacccgttaaccgggtcgggttaacccgaacccggttcccggggtaacccgttccccggttccccggttaccccgttaccgttacccgtacccgtttacccgaccccccggttttacccctcccgggttaccctttaacccggg

SEQ ID NO: 98207 - DNA, 660 bp, Homo sapiens
  misc_feature: GYAE6OF01EU69V.17.1.A01.1.454.CMB.1.raw
tcagcgtagactagcacgaccggtgctcgatttagacgtctcatcaggagtcagacccactcaggacacagcatggacatcagggtccccgctcacgctcctgggctcctgctgctctggctcccaggtgccagatgtcgccagtaccaaatcgacccagtctccatccctccctgtctgctatctgtaggacgacagagttaccatctacgtcgaccaggacaagtcgagggcaattagaatgtattaggctaggtatacgaaacaaaacgtagggactacgacccctaaactccgtagatactagtgcgtacgctacttaccgtagtttcgacgacgtaccggtcgggtacccagtacgaaggtcgacggcgagagtgactcgtaggacacggtagttaacttccacttcacctactataccgagtaccgtacgtcctaggaccgtaacgtccgttaaagtacgttttaactttacgaaccttttaactttacgtttacgtacgttaacctaaaggtacttaacgtttaaccgttaacccttacccggtaacgggtacccgttacggaaccggtaaacgggaaccgttaaggggtcgaagtaacgtaaccgtaaaccggacggttacggtcggtacctaggacccttagtacttccgg

SEQ ID NO: 98208 - DNA, 754 bp, Homo sapiens
  misc_feature: GYAE6OF01CVJH8.17.1.A01.1.454.CMB.1.raw
  modified_base (121)..(121): a, c, t, g, unknown or other
  misc_feature (121)..(121): n is a, c, g, or t
  modified_base (143)..(143): a, c, t, g, unknown or other
  misc_feature (143)..(143): n is a, c, g, or t
  modified_base (148)..(148): a, c, t, g, unknown or other
  misc_feature (148)..(148): n is a, c, g, or t
tcagcgtagactagcacgaccggtgctcgatttagacgtctcatcgagggggcaggagtcagacccactcaggacacagcatggacatggacgggtccccgctcagctccgtggggctccngctgctctggcctccgaggtcnccagntgtcaccataccaagtcgaccctagtcctcacctccctccctgtctgctagtcgtggaaggacagagttactaccatccgtacggtcggaccgtagtagcggaggacttaagtagtaagtgttaagtggactaagtaactaaccaaaacgtaacggtaggaaccgtacaacccgttaactggtataactcgttatccggtctacgtaaccttacgttacggttaacggttaccggaacggtaaccggttcccgggttacggtaacccgtaaggttaacccggtaacggttacgacgggtacgtagggttaacgtcggttaagtaccggacggtaacttagtaccgttacctacaccttacgaacctagtacgacgatccgtacgtcccgtaaggccttaggtaacagttttaacgttccgtttaataaccttatttcgtaagttaccaaacgtttaacgacgtttaacgtacccgtttaacccgtccgggtttaacggaacccggttacgggaaaccggttaacggggtaacgaggggttactaaacggtaccgttaaacgaacgggtttcgtacggaaccgtcgtaaaccgccgttacgttaacg

SEQ ID NO: 98209 - DNA, 796 bp, Homo sapiens
  misc_feature: GYAE6OF01DSN39.17.1.A01.1.454.CMB.1.raw
  modified_base (197)..(197): a, c, t, g, unknown or other
  misc_feature (197)..(197): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccataccaaatgacccagtctccatccctccctgtctgtatctggtagganacagtagttaccatcacgttcgccgggacaacggtcgagggtacagttagaaatgtatttaggctggtaataacaaaacgtaaaacgtagggaacgacgtacccctaaattcccgtagtaactctaagtcgctgactacgtcctaagttcgagtacggtaccggtacggggtacccctaagttccggtaaagggtttccgacgggtaccgggtactaagggtacggtaacgttcggtacggaccctaacgtacggttaacttttaccgaaccttccctaacctaaccgttagaccgtaacgccgaaccggttccgtagcccgtaaggtaccccgttaaggtaaccgttttagttttaccgaaccgtttaaacctttttacgtttaccgttacttacccgttaaaacgttaaacgggtaaccgttttaaaccgttacccggttttaaccccgtacggggtttaaccggtttccccggggaaaaccggttaaaaccgggggaaccgtaaacggggttaacgggaacttaacggttaaaaccggaaacccggttaggttacggtacgggttaccctaggtaccctaaccgttacgttacccg

SEQ ID NO: 98210 - DNA, 741 bp, Homo sapiens
  misc_feature: GYAE6OF01A9Z62.17.1.A01.1.454.CMB.1.raw
tcagcgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggacgccctcacgtgactgtcgtcccgagggagggacagtcactcctcacctgtcggcctccgagcacgtggacgctgtccacaatcggtactacgtttactaccttacgtacgttaccaacgagaacgccgtcggacccgacgaccccgacggacctacgtgttagtttacacgtaactaacgaaaccaaacaaaaccgtaccttaccgtaccggaacccccgttccggtacccggttcctacgtaccggtcccttaccccgggttccgggttacggggaccgtaaacgtccgtaccggtcccgtacggtccccggtttcgggtaccggtcgaccgtacgtccggtagtacggagtcggacgtcggtagtacgttacttcgttacgtcgttacgtccttacctaccgttagttcgggttgggttcggtttcggggtcggtttaccgggaggggtaccggaacgtacgggtccgtaccgggttcctcggtaaccgccgggtaacgacccggtacgtcccggtccctaccccggtctaccgttccctccgttacccgtccccctacgttccctccg

SEQ ID NO: 98211 - DNA, 769 bp, Homo sapiens
  misc_feature: GYAE6OF01D30F9.17.1.A01.1.454.CMB.1.raw
  modified_base (184)..(184): a, c, t, g, unknown or other
  misc_feature (184)..(184): n is a, c, g, or t
tcagcgtagactagcacgaccggtgctcgatttagacgtctcatcaggagtcagacccactcaggacacagcatggacatcagggtccccgctcagctccgtggggctcctgctgctctggcctcccgaggtcgccagattgtcgaccataccaaagtcgaccctagtcctccactcctccctntcgtgcatcgtaggtaggagacagtaacgttacacttctacgttacggccggtacaacggtcgaagggactaagtaagtaattaggtaagtttacggacgttaaggtaacaaccggtaaaaacgaaaacgggtaggaacgaaccctaacccttaaacgtccgtagtaccttacgtacggccgtacgtcgtaacgtccgtaaccggttagttacgacggaacggtccggtaccggtaccctaaggtacgtacggtacggacgcggtaacgtggtaccgacgtcgacggtaacaggttacctaacgtttaacaccgttaccgtaacccaacgtaacgtacggaccgtaccgacgtccgtacgtaaccgacggtacgtaaggttaactttacgttaaccctacggtttaaatttaccgttaaccgttcgtaaactaacgtaaagttacccgttacgtaacccgtttaggacccgggtacggttaccggaaaccggaacgggtaaactacggggtaacggaactaaccgggaataaaaccggcggttacgaacggttccgaaacgaccgttaacttccgtccgtttaag

SEQ ID NO: 98212 - DNA, 756 bp, Homo sapiens
  misc_feature: GYAE6OF01BJYGM.17.1.A01.1.454.CMB.1.raw
tcagcgtagactagcacgaccggtgctcgatttagacgtctcatcagggagtcagacccactcaggacacagcatggacatcagggtccccgctcagctcctggggctcctgctgctctggcctcccaggtcgccagatgtgccatccaaatcgacccagtcctccactccctcctgtctgctatctggagagacagtacgttaccatctacgttcggccgggacaaggtcgagggctaagttaagaatgtattaggcttaggtacaacaaacgaaaaggtaggacgaaccgtacccctaaactcctagtacttacgttagtcgcgtcgactacttaccggtagtttcgaccgtacggtaccggttaccgggtacctaggttaaccggtaacggttcgaacgggtccggacgttaggtacggtacttcggaggacctaacgtagttacctttacaccgttcctaaccgtaccacgtacacggtcctacggtaccgttacggaccgtaacggttcccgttaaaggttacgtttaaccgttttacggaaccttttaaaccgtttaacgttaccgttaacgttaaaccttaaacgttaacggtttaacccgttaccgttaacccgttttaccccgggtaccggttaacccgggttaccgggaaaccggtaacgggtaccgggtaagggacgtaaacggaacttaaccggaaacgtacgttcgggactacgaccgttaaccaaccgtttgttcgttaccg

SEQ ID NO: 98213 - DNA, 530 bp, Homo sapiens
  misc_feature: GYAE6OF02HVB02.17.1.A01.1.454.CMB.1.raw
  modified_base (342)..(342): a, c, t, g, unknown or other
  misc_feature (342)..(342): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccaggcaagtcagggcattagaaatgatttaggctggtatcaacaaaaactagggagagcccctaaaactcctgatctatgctgcatccagtttgcagactggggtccatcaaggttcagcgcagtgatctggcanagatttcactctcaccatcagcagcctgcagcctagaagtattttgactaacttattactgtactacaagtacttacgacttaccctacggtaccgttcgacccgtaacgggaaccgtaacgggtaggacggtaagtaccgaaaaccgaacgtaggttacgggaccgtacggtactaccgattacccg

SEQ ID NO: 98214 - DNA, 563 bp, Homo sapiens
  misc_feature: GYAE6OF02ITPWM.17.1.A01.1.454.CMB.1.raw
tcagcgtagactagcacgaccggtgctcgatttagacgtctcatcagggggcaggagtcagacccactcaggacacagcatggacatgagggtcccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaaactagggagagcccctaaaactcctgatctatgctgcatccagtttgcagaccgtgggtcccatcaaggttcagcggcagtgatctggcacagtatttcactctcaccatcagcagcctgcagcctagtaagtattttgactaaactttattactgttactaacaaagtacttaaccgtaactttaccccgtacgggtaccgtttccggaccgtaaacggggtacccgtaaaggggtacggaaaggtaactaacgaaaaccggtaaccgttggttacggccgtacggtacctaccctaacg

SEQ ID NO: 98215 - DNA, 490 bp, Homo sapiens
  misc_feature: GYAE6OF02HSW3J.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagcccctaaactcctgatctatgctgcatccagtttgcagactggggtcccatcaaggttcagcggcagtggatctggcacagatttcactctcaccatcagcagcctgcagcctagaagtatttgactaacttattactgtactacaagtattacgattacccgtgtacgttcgacaaggacaaggtggagtatacgaacgtaactagtaggctgcacctatctcg

SEQ ID NO: 98216 - DNA, 536 bp, Homo sapiens
  misc_feature: GYAE6OF02I5PH3.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagccctaaactcctgatctatgctgcatccagtttgcagactggggtcccatcaaggttcagcggcagtggatctggcacagatttcactctcacatcagcagcctgccagccctagaagtattttgactaacttattacgtgttactacgtaagtattaccgtattaccccgtcgtaccggttcgaccgtaacgggaccgtaaagggtggaacggtaacgttacgaaaccgtaacgtacggtacggacgtacggacaccgtaacg

SEQ ID NO: 98217 - DNA, 584 bp, Homo sapiens
  misc_feature: GYAE6OF02JIBII.17.1.A01.1.454.CMB.1.raw
  modified_base (267)..(267): a, c, t, g, unknown or other
  misc_feature (267)..(267): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatccccctgtctgcatctgtaggagacagagttaccatcacttgccgggcaagtcagggcattagaatgatttaggctggtatcaacaaaactaggganagccctaaatcctgatctatgctgcatccagtttgcagacgtgggtcccatcgaaggttcagcgcagtggatctggcacgagtatttcgactctcacatcagtcagcctgcagcctagaacgtatttcgactaacgttattactgtactaacgtaagtagtttaaccgtaatttaccccgtagggtaaccgtttccgggaccctaaacgggggtacctaaacggggttcggtaaacggtacgttaacccgaaaacggtaaaaccgtttcgggttacgggacccgttacggtacccgtaaccccgtagtttaacccgg

SEQ ID NO: 98218 - DNA, 491 bp, Homo sapiens
  misc_feature: GYAE6OF02F8TRV.17.1.A01.1.454.CMB.1.raw
tcagcgtagactagcacgaccggtgctcgatttagacgtctcatcagggggcaggagtcagacccactcaggacacagcatggacatgagggtcccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagcccctaaactcctgatctatgctgcatccagtttgcagactggggtccatcaaggttcagcggcagtggatctggcacagatttcactctcaccatcagcagcctgcagcctgaagtatttgactaacttattactgtctacaagtattacgattacccgtcggtacgttcgccaagggaccgaaggtggagactacaaacgactggtggctagcactac

SEQ ID NO: 98219 - DNA, 495 bp, Homo sapiens
  misc_feature: GYAE6OF02HKHSR.17.1.A01.1.454.CMB.1.raw
  modified_base (345)..(345): a, c, t, g, unknown or other
  misc_feature (345)..(345): n is a, c, g, or t
  modified_base (428)..(428): a, c, t, g, unknown or other
  misc_feature (428)..(428): n is a, c, g, or t
  modified_base (478)..(478): a, c, t, g, unknown or other
  misc_feature (478)..(478): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaatgatttaggctggtatcaacaaaaactagggagagccccctaaactcctgatctatgctgcatccagtttgcagactggggtcccatcaaggttcagcggcagtggatctggcacngatttcactctcacatcagcagcctgcagcctggaatatttgactaacttattactgtctaacaagtattacgatttacccgnggtaccgttcgacctaagggaccaagggtggagtatacaaacgtactggngcgtgcaccagtcttcg

SEQ ID NO: 98220 - DNA, 536 bp, Homo sapiens
  misc_feature: GYAE6OF02JETXC.17.1.A01.1.454.CMB.1.raw
  modified_base (420)..(420): a, c, t, g, unknown or other
  misc_feature (420)..(420): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaactagggagagcccctaaactcctagatctatgctgcatccagtttgcagactgggtccatcaaggttcagtgcagtggatctggcacagtatttcactctacaccatcagtcacgtcctgcacgctagaagtatttgacaactttattactgtactaanaagtacttaacgtacttaaccctcggtaccgtttcgaccgtaacgggaacccgtaagggtacggaggtaactacgaaaacggtaacgttggtacggtacctaggtaccaccgtacg

SEQ ID NO: 98221 - DNA, 549 bp, Homo sapiens
  misc_feature: GYAE6OF02I50GE.17.1.A01.1.454.CMB.1.raw
  modified_base (219)..(219): a, c, t, g, unknown or other
  misc_feature (219)..(219): n is a, c, g, or t
  modified_base (404)..(404): a, c, t, g, unknown or other
  misc_feature (404)..(404): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggnaagtcagggcattagaaatgatttaggctggtatacaaacaaaaacgtagggagacgacccctaaactcctgatctatgctgcatccagtttgcagacgtgggtcccatcaaggttcagcggcaggtggatcgtggcacgagtactttcactctacacctatcagcagcctgcagctagaagttntttacgactaactttattactgttactaataagtacttaacgacttacccgtcggtacgttccggaccgtaaggacccgtaagggtagaagaacgttaacgaaaaccggttacgtacggtacgggtactacgtacctaacctacg

SEQ ID NO: 98222 - DNA, 627 bp, Homo sapiens
  misc_feature: GYAE6OF02F6RAN.17.1.A01.1.454.CMB.1.raw
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaactagggagacgacccctaaactcctagatctatgctgcatccagtttgcagacgtcggggtacccatacgaaggttcagcggcagtgatcgnggcanagtactttcactctacacctatcagcacgtcctcgacacgccttaggaacgttatttttacgaaccttaacgtttaactttacgttacgttacctaaacgtaagttaacgtttaaccgtaaccgttttaaccccggtacgggttaccggtttaccgggaccggtaaaccggggtaccgtaaaggggtacgggtaaacggtaacttaaccggtaaaaccggtacgttcgggtacggtaccgttacggaccctaacccgtacgttccgtttaccgg

SEQ ID NO: 98223 - DNA, 726 bp, Homo sapiens
  misc_feature: GYAE6OF02I2C4A.17.1.A01.1.454.CMB.1.raw
tcagcgtagactagcacgaccggtgctcgatttagacgtctcatcaggagtcagacccactcaggacacagcatggacatcagggtccccgctcagctcctggggcctcctgctgctctggcctcccaggtgccagatgtgccataccaaatcgacccagtctccatccctcctgtctgcatctggaggagacagacgttaccatctacgttcggccgggacaagtccgagggctaattaagaatgtattaggctaggtataccaaactaaaacgtagggacgacgaccccctaaactccgtagacttctatcgtctcgcaactccgtagtttcgcgagtacgtcggggtaccagtacgaaggttcaggcggcaggtggactcgtacggacacgtagtactttcgacctctaccaccatacagccacgtcctagacctacggtacctaggtaaacgttttacgtttacgaaccttaaacgttttacttaaccgttagttacctaaaccggtaaagttaccgtttaaaccggttaaccgttttaacccccgggttggggttaaaccccgggttacccggggtaacccgtaaaaccgggggtacccggtaaaggggttaccgggtaaacggttaaccgttaaacccgggtaaaaacccggttaccgggtttacgggttaccgggtaccggtacggtacccctaaccggttaccgttccgtttacccgg

SEQ ID NO: 98224 - DNA, 529 bp, Homo sapiens
  misc_feature: GYAE6OF02GR7WO.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagacccctaaactcctagatctatgctgcatccagtttgcagactggggtcccatcaaggttcagcggcagtggatctggcacagatttcactctcaccatcagcagcctgcagcctagaagtatttgactaacttattactgtactaacaagtattaacgtacttacccgtgtaccgttacggaccgtaagggaccgaagggtaggaacgtaagtaccgaaacggaaccgttaggtacggacgtacggaccaccgtac

SEQ ID NO: 98225 - DNA, 531 bp, Homo sapiens
  misc_feature: GYAE6OF02I4NRK.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaaacaaaaactagggagagcccctaaactcctgatctatgctgcatccagtttgcagactggggtccatcaaggttcagcggcagtggatcgtggcacagtatttcacttctcacatcagcagcctcgcagcctagaagtacttttcgactaactttatacttagttactaactaagtaattaccgtaactttacccgtcgggtaccgttcggaccgtaagggacctaagggtacggtaagactacggaaacgtacgtggtacggctagaccactactcgtacg

SEQ ID NO: 98226 - DNA, 598 bp, Homo sapiens
  misc_feature: GYAE6OF02HM2EY.17.1.A01.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (317)..(317): a, c, t, g, unknown or other
  misc_feature (317)..(317): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (469)..(469): a, c, t, g, unknown or other
  misc_feature (469)..(469): n is a, c, g, or t
  modified_base (570)..(570): a, c, t, g, unknown or other
  misc_feature (570)..(570): n is a, c, g, or t
  modified_base (592)..(592): a, c, t, g, unknown or other
  misc_feature (592)..(592): n is a, c, g, or t
tcagcgtagactagcacgaccggtgctcgatttagacgtctcatcaggagtcagacccactcaggacacagcatggacatcagggtccccgcctcacgctccgtggggctcctgctgctctggcctcccaggtcgccagatgtgccatccaaatgacccagtcctccatccctccctgtctgacattctagagagacngaattaccatcattcggccgganaaatcgaggcaagttagaaatgagtttagctaggtatacaaaanaaaacgtagggagaacgtaccccgtaaaacttcccgaatacgtactaagacnccgttagacctaactccgttaagtttcgacaagtaccggtggggtacccagttacaacggttcaggcggtacagggtacgatcgnggacagtagtacttacnccttcacctaacataccgancgtaagctacgcagtacctaggaaactttnttacgacttaaactttatcgattataaactaagttacttaagtaccttaacgcggtagtacgacgacggaacgtaggacgaagactaacgaaacgtaacgngtacggtgaaccaccgttacgntgttac

SEQ ID NO: 98227 - DNA, 695 bp, Homo sapiens
  misc_feature: GYAE6OF02IU2I9.17.1.A01.1.454.CMB.1.raw
  modified_base (304)..(304): a, c, t, g, unknown or other
  misc_feature (304)..(304): n is a, c, g, or t
tcagcgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactcctactggttccaacagaagcctggccaacgcccccaggacactgatttangatacaaacaacaaacactacctacggacccctcgtcccggttctcgacggcctccccgtcggttcgggggacctaaaaggccgtacgccctacgtacccgtttccggggtacgtcgccgacgccctaggacggtagtgggacggcgtacgtaggttattacgttaggtctttcgtcttcctaccgttatacggtttgggttacgggtttcgggggtttggtttccggggcggggtaacggggtaccggtaaaggtccgtacggtacccggttaccgtacggtaccgaccgggtaaccccgaacgggtccgttcccggtaccccccgttcgggtacccttaccgttcccgttcccggtttaccccctacccccgttcccctttaaccccgg

SEQ ID NO: 98228 - DNA, 507 bp, Homo sapiens
  misc_feature: GYAE6OF02HOS9L.17.1.A01.1.454.CMB.1.raw
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
tcagcgtagactagcacgaccggtgctcgatttagacgtctcatcagggggcaggagtcagacccactcaggacacagcatggacatgagggtcccgctcagctcctggggctcctgctgctctggctcccaggtgccagatgtgccatccaaatgacccagtctccatccctcctgtcctgcatctgtaggagaccagtacgttaccatcacttggcccggganaaggtcagggcaattagaaagtgatttaggctggtatcaacaaaaactagggaagacgacccctaaatccctagatctatgctgcatccagtttgcagactcgggtccagtcaagttcagcgnagtggatgtgcanagtntttcgactctcacatcagcacgcctgcagcctagagttntttgactaacttatactgtactanaagtattacgacttaccgngtacgtcggacaggtaccgaaggtcggagactacgaacgtactggtcgctcgtcactacg

SEQ ID NO: 98229 - DNA, 548 bp, Homo sapiens
  misc_feature: GYAE6OF02I4WLY.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcgagggcattagaaatgatttaggctggtatacaaacaaaaacgtagggagacgacccctaaactcctgatctatgctgcatcctagtttgcagacgtcggggtcccagtacgaaggttcagcggcgagtggatcgtggcacagtatttcactctaccaccatcagcacgtcctgactacgcctagaacgttatttcgacttaacttattacgtgtactaactaagtacttacgtacctttaccgtacggtacggttacgaccgtaacgggtacgagggtacggaaggtactacgaaacgtacgtggtacgcgtacgacacgtatcgttacg

SEQ ID NO: 98230 - DNA, 754 bp, Homo sapiens
  misc_feature: GYAE6OF02JM1BE.17.1.A01.1.454.CMB.1.raw
  modified_base (165)..(165): a, c, t, g, unknown or other
  misc_feature (165)..(165): n is a, c, g, or t
  modified_base (505)..(505): a, c, t, g, unknown or other
  misc_feature (505)..(505): n is a, c, g, or t
  modified_base (538)..(538): a, c, t, g, unknown or other
  misc_feature (538)..(538): n is a, c, g, or t
tcagcgtagactagcacgaccggtgctcgatttagacgtctcatcaggggcgaggagtcagaccactcaggacacagcatggacatgagggtcccgctcagctcctgggctcctgctgctctggctcccaggtgccagatgtgccataccaaatcgacccagtcncctatccctccctgtcctgccatctgtaggagacagagttaccatcacttcgccgggtcaagtcagggcattagaaattgtagtttaggcttggtaatactaaaaccgaaaaagtaggggaatacgacccccttaaaactccgtaggtaacttctaatcggtccttacggaccttacttaccgttaagttttacgaccgttaacggtaaccggttcggggtacccctaagtacggtaaacggtttcacgggacccggttcgacggtttagggaacttccggtcgggtaccaaacgtaaccgggttatttcccgtaaccgttccctacaaaccccgtttanacccgtaggtaaccctacgcccgttacggaccncggtaaccctaggttaaacggttaatttttccggaacttaacggtttactttacggtaacttaaccgttaacgtaaagttacctttaaccgggttacttaaaccccggtcggtaccgggttacgacctaacgggggtaacctaaacgggtagggtaaccgaattaacccggtaaagtacccgttaggttcccggtgtacccgtacggaaccctacg

SEQ ID NO: 98231 - DNA, 533 bp, Homo sapiens
  misc_feature: GYAE6OF02GE2D3.17.1.A01.1.454.CMB.1.raw
  modified_base (405)..(405): a, c, t, g, unknown or other
  misc_feature (405)..(405): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatacaaacaaaaacgtagggagacgaccccctaaaactcctagatctaatgctgcatcctagtttgcagtacgtgggggtcccatacgtaaggttcaggcggcaggtggtatctggcacagtattcactcacaccatcagcagcctgacagacctgaagtnttttgacctaaactttattacctgttactaacgagtacttacggtactttacccgtcggtacgttcggaccgtaaggaccgaaggtaggaagtactacgaaacgacgtgtcggctgacctacntntcg

SEQ ID NO: 98232 - DNA, 601 bp, Homo sapiens
  misc_feature: GYAE6OF02JY7XP.17.1.A01.1.454.CMB.1.raw
  modified_base (272)..(272): a, c, t, g, unknown or other
  misc_feature (272)..(272): n is a, c, g, or t
  modified_base (460)..(460): a, c, t, g, unknown or other
  misc_feature (460)..(460): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctcctgtctgcattctgtaggagacagagttaccatccacttggccgggtcaagtcaagggcattagaaattgatttaggctggtatacaaacaaaaacgtagggaanagacccctaaaactcctagaactctaatgctagctactcctagtttgcagtacgtgggtcccatcgaacggttcagtcggacagtggtatcgaggtcacgtagtagtttcaacttcgacaccgtatcgacgccgtagccttaggcacgtctaggtaaacttgtttcgaccttaaatttctaaccgttnttaccttaagaaacgtttacttaacgtaacttacccgtggttaacccggttcggaacccggaagggtaccaaggggttcggaacgtaacgtaaccaaaccgacggttagtcggtacacgtacctaaccctagtccgttacg

SEQ ID NO: 98233 - DNA, 623 bp, Homo sapiens
  misc_feature: GYAE6OF02HDDNF.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagtagttaccatcacttcggccgggacaagtcgagggctaagttaagaaatgtagtttaggctggtatacaaacaaaacgtagggagacgacccctaaactcctgatctatgctgcactccgtagtttgcgtagtacgtcgggtccagtacgtaaggttcaggcggacgaggtggtatcgtaggacacgagtactttcacttcctaccaccactcgacgccacgtcctacgccgacgtcctagtaacgttattttacgacttaaacctttattaaccgttacgtactaactaagttaacgttaaccgttaacctttacccggtacggttaccggttaccggaccgaacgggtaaccggtaagggtaggtaacgtaacgtaaccgtaaacggtacgttacgggtacggtacgtacgaccgaccttacg

SEQ ID NO: 98234 - DNA, 663 bp, Homo sapiens
  misc_feature: GYAE6OF02I27OY.17.1.A01.1.454.CMB.1.raw
  modified_base (198)..(198): a, c, t, g, unknown or other
  misc_feature (198)..(198): n is a, c, g, or t
  modified_base (506)..(506): a, c, t, g, unknown or other
  misc_feature (506)..(506): n is a, c, g, or t
tcagcgtagactagcacgaccggtgctcgatttagacgtctcatcagggggcaggagtcagacccactcaggacacagcatggacatgagggtccccgctcagctcctgggctcctgctgctctggctcccaggtgccagatgtgccatccaatgaccagtctccatcctccctgtctgcatctgtaggagacgtacngtacgttaccatacgtacgttcggccggacgtaacgtacgaggactagttaagtaagtgtaagttacgtacgtaacggaatacgaaaacgtaaaacgtacggtaacgtaccgtaaccctaaactccgtagtactactagtcgtactacgtactactacgtagttcgacgtacgtacgtacggtacctagtacgtacgtacgacggtcgacgtaggtagtacgtcgtacgtactacgtacgttactacgtactacgtactacctactacgtacgacgtacgtacgtacgacgtacgtacgtacgtaacngttacgttacgtacttaacgttaacgttacgttacgttaacgtaacgtaactacggaactttaacccgtacgtaaccgttaccggtaccgttaacggaccgtaacggtaccgtaacggtacgtacgtaacgtaacgtaacgtaacgtacgtagtacg

SEQ ID NO: 98235 - DNA, 538 bp, Homo sapiens
  misc_feature: GYAE6OF02G2R1M.17.1.A01.1.454.CMB.1.raw
  modified_base (353)..(353): a, c, t, g, unknown or other
  misc_feature (353)..(353): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaaacaaaaacctagggagagcccctaaactcctgagtctatgctgcatccagtttgcagactggggtcccatcgaagttcagcggcagtggatctgcanagtattcatctcacatcagcacgcctgcacgtcctagaagtatttcgactaactttattactagttactaacgaagtactttaccgaactttacccgtacggtaccgttccggaccgtaagggacccgtaagggtcggaacgaactaccgaaacgacttcggtaggtactcgtaccaccgtaacg

SEQ ID NO: 98236 - DNA, 690 bp, Homo sapiens
  misc_feature: GYAE6OF02F4L3N.17.1.A01.1.454.CMB.1.raw
  modified_base (211)..(211): a, c, t, g, unknown or other
  misc_feature (211)..(211): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccggnaagtcagggcatagaatgattaggctggtatcaaacaaaacgtagggagagtaccccgtaaaactcctagactctagtgctgcatcctagtttcgacacgtacgttcggggtcccaagtacgaaacggtttcaggccggcgaggttggtaactcgttgggacctaacgtaggtacttttaccaacttcctaccaacctaacttcgaacgccgtaaccggtcccttaggaccaacggtcccttaagggtaaacccgtttagttttttcggaaccttaaacgttttactttaaccgtttacgttacttaaaacgtaaccgttaagttttaacccgtaacgtttaaaccccggttcccggtaacggttttacccgggaccgtaacgggtaaccgtaacggggttaacggtaacgggtaacgtaaacgtaaaccggtaaccgttagggtacgtaccggtcgtaaccgaccgtacctagttccg

SEQ ID NO: 98237 - DNA, 642 bp, Homo sapiens
  misc_feature: GYAE6OF02HF7KB.17.1.A01.1.454.CMB.1.raw
tcagcgtagactagcacgaccggtgctcgatttagacgtctcatcagggggtcgaggagtcagacccactcaggacacagcatggacatgagggtccccgctcagctcctggggctcctgctgcgtctggcctcccgaggtgccctagatgtcgcccaatacccgaaaactcgaccccaggttccctccgaactcccctccctgtacctggccatcctggtaggagacagacgttacccgactcgacttcggaccgggcaaagtcgacgggctaagttaacgaaactgtaagtttacggtcgtaggtataccaaacaaaaacgtagggaagacgacccctaaactcctagactctatgctgcactcctagtttcgacagtacgtcgggtacccagttaccgtaaggttcaggtccggacgacggtaggatccgtggaccacgtagtattccgacctctaccacctatccacgcacgtcctagccacgtctagaagttactttgaccgtaacttacttacgtacgtactaacagtacttaaccgtacttacccgtacgtaccgttccgaccgaacggtaccgtaagggacgtaacgtagtaaccgaaaccgtacgtcggtacgacgtaccgtacgtactaacg

SEQ ID NO: 98238 - DNA, 599 bp, Homo sapiens
  misc_feature: GYAE6OF02JDIR3.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagacgcccctaaactcctagatctatgctgcatccagtttgcgtaggaccgttggggtcccaagttccgaaaggtttcaggtcgggcacggtggatcgtggcacgagtagtttcactctacaccaatcagcagcctgcacgtcctagaagtattttcgacctaacttttattacgtacttacgtaactaacgttactttaaccgtaactttaaccccgtacgggttaaccgttaccgggtacccgaaacgggtacccggtaaagggtacggaagtaaccgttaacgtaaaccggtaacgttggttacggacgttacgacctaccgtaaccg

SEQ ID NO: 98239 - DNA, 640 bp, Homo sapiens
  misc_feature: GYAE6OF02GPJQ0.17.1.A01.1.454.CMB.1.raw
  modified_base (194)..(194): a, c, t, g, unknown or other
  misc_feature (194)..(194): n is a, c, g, or t
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatgacccagtctccatccctcctgtctgcatctgtagganacagagttaccatctacgttggccgggactaaggtcgaagggctaattaagaaatggtaagtttaggcgtaggtaactacaaaacaaaaacgtagggaagaccgaccccttaaactcctagtactctatcgtctgactactcctagtttcgactaggtacgtcgggtccagtacgtaacggttcacggtcggactaggtaggtactcgtcggaccaacgtagtactttacaccttctacacctagtcagcacgtccagcacgtctaggttaatagttttacgacttaattacttacttacgttacctaacgtaacgttaacttaacgttaaccgttacccgttacgggtaccggttaccgaaccggtaacgggtaaccgtaagggtacggtaacgtaacgttaaccgaaacggtacgttggtacggtacgtacgtaccacgttacg

SEQ ID NO: 98240 - DNA, 780 bp, Homo sapiens
  misc_feature: GYAE6OF02G1ZAW.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagacgttaccatcacttgccaggcaagtcagggcattagaatgattaggctggtatacaaacaaaacgtagggagacgacccctaaactcctagactctaatgctcgctactctagtttgctaggaccgtcggggtaccctaagtcgtaaagggttccaggtccggacgtaggtacggtacgttcgtagggtacccaacgtaaggttaccttttaccgtaaccgttccgtacctaacccgtaacttaccgaacggtacccgacggtacccgttacggacccgtaaccgggttacccgttaaggggtaaaccgttttaacgttttttaccggaaccttaaacccgttttttaaacttaaccgtttaccggttaccttaaaacggtaaaccgttaaccgttttaaacccggtaaaccgttttaacccccggtaaccgggttaaacccggtttaccccggggaaccgggtaaacccggggtaaaccggttaaacgggggtacgggtaaaccggttaaccgtaaaccggaaaacccggttaaaccgttcgggttaacgggtccttaaccggaacctaacccgttagtttacccgg

SEQ ID NO: 98241 - DNA, 813 bp, Homo sapiens
  misc_feature: GYAE6OF02HQ7C1.17.1.A01.1.454.CMB.1.raw
  modified_base (172)..(172): a, c, t, g, unknown or other
  misc_feature (172)..(172): n is a, c, g, or t
  modified_base (201)..(201): a, c, t, g, unknown or other
  misc_feature (201)..(201): n is a, c, g, or t
tcagcgtagactagcacgaccggtgctcgatttagacgtctcatcagggggcaggagtcagacccactcaggacacagcatggacatgacgggtccccgctcagctcctggggctcctgctgctctggcctcccaggtcgccagatgtgccataccaaatcgacccagtccnccatcctccctgtctgcatctggtagganacagattaccatcacgttggaccgggacaaggtcagggactaagttaagaaatgtagtttaggctaggtaataacaaaacgtaaaaagtgggaagaacgaccccttaaaactccgtagtattacttagacgtctacgacacttccgttagtttcggacgtaacggtaaccgtcggggtaccctaagtacggttaaacggttccgaaggccgggacgtaacggggttaggtacgtaccggtcgggtaacctaaacggtagtttaccgtttttaccaaaccgttccgttacccaaacctaacgtaccggaacgtaccggaacggtacccctggaaccgtaacgcccgtttaaggaaagttttacgtttttaacgaaccgtttaaaactttcgttaaaccgttacgtttaaacgaaaacccgttaaagtttaccgtttaaaggttaaccccgttttaaccccggtacgggttaacccgggttaacccgtaacccgggggtaacgggggtaaacccggttaagggggtaaccgaaacggttaacctaaaacccggtaaaacggttaaccgttaacggggtcgtaaccgggtttacaccccgttaaacggttacccg

SEQ ID NO: 98242 - DNA, 806 bp, Homo sapiens
  misc_feature: GYAE6OF02JWGST.17.1.A01.1.454.CMB.1.raw
  modified_base (192)..(192): a, c, t, g, unknown or other
  misc_feature (192)..(192): n is a, c, g, or t
tcagcgtagactagcacgaccggtgctcgatttagacgtctcatcaggagtcagacccactcaggacacagcatggacatcagggtccccgctcagctccgtggggctcctgctgctctggctcccaggtgccagatgtgccatccaaatcgacccagtcctccatccctccctgtctgcatcgtgtagganacagtacgttaccatcacttcgaccaggacaagtcgaggacattaagaatgtaattagcgtaggtaactactaaacaaaacgtagggaacacgtaacccctaaactcctagacttacctacgtgtcgtacacctacttccgtaggtttcgaacgtacggtaccggtaccgggtaccgtaagttaccgtaacgggttaccgacgggaccggtacggtaacggtacggtagttaccggcggaacgtaacgtacggtttactttaccgtaccgttactaccctaaccgtaagtccgaacgtaccgtaacggtcctaacggacctaacgggtacccgttaaggtaaacgtttacgtttacggtaaccttttaaacgtttagttaacgttaaccttaacgtaaacgtaaacggtttaccgttaacccgttttaaaccggttaacccggttacccgggttaaaccgggtttaccgggtaaaccccgaacgggggttaaacccgttaagggggtaccggttaaaacggtaacccgggttaaaaccgttaaaccgggggttaccgttaacggggttcggtaaacccgtccggtaaaccccggtacgttaccgtttaacccgg

SEQ ID NO: 98243 - DNA, 621 bp, Homo sapiens
  misc_feature: GYAE6OF02IL6VK.17.1.A01.1.454.CMB.1.raw
  modified_base (98)..(98): a, c, t, g, unknown or other
  misc_feature (98)..(98): n is a, c, g, or t
  modified_base (141)..(141): a, c, t, g, unknown or other
  misc_feature (141)..(141): n is a, c, g, or t
  modified_base (180)..(180): a, c, t, g, unknown or other
  misc_feature (180)..(180): n is a, c, g, or t
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (375)..(375): a, c, t, g, unknown or other
  misc_feature (375)..(375): n is a, c, g, or t
  modified_base (450)..(450): a, c, t, g, unknown or other
  misc_feature (450)..(450): n is a, c, g, or t
tcagcgtagactagcacgaccggtgctcgatttagacgtctcatcagggggcaggagtcagacccactcaggacacagcatggacatgacgggtcccnctcagctcctgggctcctgctgctctcggcctcccgagggtcnccagattgtcgacccagtaccaaatcgaacccgagtccncccatccctccctgtctcgactatccgtggacgagaccgtagacttaccatcgaccttggcccgganaaggttcgaaggcctaagttagtaaactgtagttagcgtaggntacaaaactaaataggacgacgaccctaactcagactactagttncagtcaactccgttagtacgcaacgtcggacggttacccngttaccgaagttcggaacgtcgacgtagtaggactgttaccgggacaactagtactttacacgtcttcctaaacncgtcgacgacgtctacccgtgacgtacgtacgtatacgtttaacgtactacttaacttagtccgttacgtaccgtaacgtaagtaaccttacgttccgtaccgtacgtagtccgagtaacgtaggaacggtgaacgtaacaacgtaacgacgtatccgacgtctaccgatc

SEQ ID NO: 98244 - DNA, 795 bp, Homo sapiens
  misc_feature: GYAE6OF02F2MYV.17.1.A01.1.454.CMB.1.raw
  modified_base (190)..(190): a, c, t, g, unknown or other
  misc_feature (190)..(190): n is a, c, g, or t
tcagcgtagactagcacgaccggtgctcgatttagacgtctcatcagggagtcagacccactcaggacacagcatggacatcagggtccccgctcagctcctggggctcctgctgctctggctcccgaggtgccagatgtgccatccaaatgacccagtcctccatcctccctgtctgcatctgtagganacagagttaccatcacttggccggcaagtcgagggactaagttaagaaagttgtagtttaggcttaggtaactacaaaacgaaaaacgtagggagaacgtacccctaaactcctagactcgtactgcgtgctatccgtagtttcgacgtagaccgttacggggtacctacgtacgtaaggttcaacggcggtactagggtacggacgttcgtacgggactaacgtaagtacttttaccaacgtcctaccaacctataccgacgtacggacgtccgtacgaccgtaccgtaccgttaaggttaaacgtttactttttaaccggaaccctttaaacgtttttaacgttttaccgttacgtttaaaccgttaaacgtaaacggtttaacgttttaaaccccggttaacgttttaacccccgggtaccgggttttaaacccggggttacccgggttaaacccgaaacgggggtaacccgtaaacgggggttacgggaaaaccggttaaaccgttaaacccggtaaaaccgggttaacggtttacggtacccggggttactttaaaccccgggacccgttaaacccgttacggtttccttttaacccggg

SEQ ID NO: 98245 - DNA, 660 bp, Homo sapiens
  misc_feature: GYAE6OF02IB3PX.17.1.A01.1.454.CMB.1.raw
  modified_base (192)..(192): a, c, t, g, unknown or other
  misc_feature (192)..(192): n is a, c, g, or t
  modified_base (280)..(280): a, c, t, g, unknown or other
  misc_feature (280)..(280): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
  modified_base (646)..(646): a, c, t, g, unknown or other
  misc_feature (646)..(646): n is a, c, g, or t
tcagcgtagactagcacgaccggtgctcgatttagacgtctcatcaggagtcagacccactcaggacacagcatggacatcagggtccccgctcagctccgtggggctcctgctgctctggctcccaggtgccagatgtgccataccaaatcgacccagtcctccatccctcctgtcctgcatctgtagganacagtagttaccatcacttcggcggacagtcagggtctatagaaatgtagtttaggcttaggtaactacgaaacaaaaacgtaggganaaccgtaccctaaatcctaggtaactctaagtcgctgacctatccgttagtttcgaacgacggtaacgtccggggtcctaacggttacgaaacggttcaacggcggtacggtagtggtacgacgtcggaacacgagtactttacgcctacgtacacgtatcgaacncacgttccgngacgtacgacgtaagtaacgttactttagaacctttacgttattaccgtagtaaccgtaataaacgtacgtttacgaccggtttaaccccgttgggaaactttacccgggaaccgtaaagggtacccggtaaagggtccggtaaagaaccgttacccgaaagtaaccgttggacggtcaccgtaacccgnttacgttccgttcg

SEQ ID NO: 98246 - DNA, 715 bp, Homo sapiens
  misc_feature: GYAE6OF02GNAXF.17.1.A01.1.454.CMB.1.raw
  modified_base (213)..(213): a, c, t, g, unknown or other
  misc_feature (213)..(213): n is a, c, g, or t
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagacgttaccatcacttgccgganaagtcagggctattagaaatgaatttaggctggtatacaaacaaaaactagggaagacgaccctaaacctcctagacgtctatcgactgcacttccagtttgcacggtacgtcgggggtacccataccgtaaacggtttcgaacgccgggtacgaggtacggtattccgtgggtaccaacgtacggtaacttttaccgaccttaccttaccgaacccttaactaccacgtacgaccgtacctacgggacctacggtacccgttaagtaaacggttacttttacgggtaccttaaacgttttacgttaacttacggtaccttaaacgtaagttaacgttaaccgtaccgttttacccgttaacgggtaaccggtttaccgggaaccgggtaaccgggtaccgtaacggtacggggttaaccgtaagtaaacccgtaaaaccggttaaaccggttcggtacgggtccgttaaaccgcccgttaaccgtacgttcgtttaacccg

SEQ ID NO: 98247 - DNA, 706 bp, Homo sapiens
  misc_feature: GYAE6OF02GW99K.17.1.A01.1.454.CMB.1.raw
  modified_base (236)..(236): a, c, t, g, unknown or other
  misc_feature (236)..(236): n is a, c, g, or t
  modified_base (321)..(321): a, c, t, g, unknown or other
  misc_feature (321)..(321): n is a, c, g, or t
  modified_base (484)..(484): a, c, t, g, unknown or other
  misc_feature (484)..(484): n is a, c, g, or t
tcagcgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggagccctcactgactgtcgtccccgaggagggacagtcactctcacctggtgctccgagcacgtggacnctgtaccaccaatcggtactaattacgtccctactcggttaccaacagagcccgtggaccaaccgccccgagacactgatttagngtaacaacaaacaaacaaacactaccgtaccgacccctcggtcccgttctacgacgtcctccgtacggtcgggacaacgcgtccgtccgtcgtacccggttcggcgtccggacgtaccgtcgtacggaggacgtacgggaggtacgtcgtaaggttaccgttnttacggtctttacggtaccttccgttaaccgtaggtttacggttgggtttaccgggtttacggggttcggttacgggacgggtaacggtaccggaacggtccttacggacccggttcgttaacggtcggtacccggtaccggaacggtcccgtcccggtccccgtttccggaccgttacccgttcccgttcccggtacccccggtccctttacccgtacccg

SEQ ID NO: 98248 - DNA, 716 bp, Homo sapiens
  misc_feature: GYAE6OF02FR4X4.17.1.A01.1.454.CMB.1.raw
tcagcgtagactagcacgaccggtgctcgatttagacgtctcatcaaggaaggaggaacagaaagagaggagtcccttccaatatcagcaccatggcctggactcctctctttctgttcctcctcacttgctgcccagggtccaattcccaggctgtggtgactcaggagccctcactgactgtcgtccccaggacgggacagtcactctcacctgtcgctccagcactggagctgtcaccaatcggtctacttactcctactcggttaccaacacgaacgccgtcggaccaaccgtccccgacggactacgtgtactttactacgtaactaacaaaacaaaccaaaactaacctaccgtaccggtacccgtcgtcccggttctacgacggtcctccgtcggtcggggacgtaacgtcgtcgtcctaccggttacccggtttcgggtcgtccgtcgacggtccgtacggacggtacgtacggacggtcgtacggtaacgttacgttactcgttccttcgtccttcctcgttacgttacggttcgggttcggttcggggttcggttcggggtacgggtacgggtaaccgtaacgtccgtacgtaccgttaccgtacggtaccgtacggtaacccgtaacgggtcccgtaccggtcccccgttacggtcccgtaccgttccgttacccggtttacccccgtacccgttcccgttaccg

SEQ ID NO: 98249 - DNA, 787 bp, Homo sapiens
  misc_feature: GYAE6OF02IQKMC.17.1.A01.1.454.CMB.1.raw
  modified_base (212)..(212): a, c, t, g, unknown or other
  misc_feature (212)..(212): n is a, c, g, or t
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
tcagcgtagactagcacgaccggtgctcgatttagacgtctcatcaggagtcagacccactcaggacacagcatggacatcgacgggtccccgctcagcctccgtggggctcctgctgctctggctccgaggtcgccagtatgtcgaccactaccaatcgaccctagtctccactcctcctgctgctatcgtgtagacgacaggtacttacntcacgttggccggacacgtcgacggtctaagttaagaagttacgtaaggtttacgcgttaggtaactaaaccgtaaaacgtaaaaacggtgggtaaccgtaaacccggtaacccccttaaacgtcccgttaagtacttaacgtctacggcctactcctaacgtaccgtttagttacgacccgttaaggaccggtcggtaacccagttaaccgaggttaccgacgggacggtgtaaggtcgtacgtacgtcgtaacaacgttaccggtttnttaaccccncgtttaccgactaaccgtacgtaaccggacctacgtacccgtaccggtacggtacctaaccgggttaccgttaaaggttacgttaactttaacggtaacctttaaactttacggttaaaccttcgttaaacccgttaagaaccggtttaaattaaccccggttacgttacccgggttacgggttaccgaacccggtacgggtaaccgtaacgggtacgggtaacggaaccgttaaccgttaaacgaccggttaacgtcgggacgtacgtaccacggtaccaacggttgttaacccg

SEQ ID NO: 98250 - DNA, 740 bp, Homo sapiens
  misc_feature: GYAE6OF02IZ3G8.17.1.A01.1.454.CMB.1.raw
tcagcgtagactagcacgaccggtgctcgatttagacgtctcatcagggggcaggagtcagacccactcaggacacagcatggacatgagggtccccgctcagctcctggggctcctgctgctctggctcccaggtgccagatgtgccatccaaatcgacccagtctccatcctccctgtctgcatctgtaggagacagacgttaccatcacttcggccgggtacaagtcgaagggctaagtttaacgaaagttgtaagtttaggcgttaggtaactaactaaaacgaaaaaacgtaggggaacgaccgtacccccttaaaacgtccgtaggtaacttctaacgtacgcttacggactactaccgtaggtttacgacacggtacggtcgggtaccctaagtaccgtaaggtttaccgacggcggtaccgaaggttacggacgttcctacgggactaacgtaagtttactttcctaaccgttaccttaccgaactacgtccaaggtaccacgtacctcgacctacgacccgtaggtaattacgttttcgaaccttaaacgtttacttaactacgttaccgaaacgtaacgttacttaaaccgtaccttttacccggtacgggttaccgtaaccgggttacccggaaacgggtacccgtaaaggggttacggtaaactaacgtaacccgaaaacggttaccggttacggttaccgggcgttaccgtaccaccggtttaaccg

SEQ ID NO: 98251 - DNA, 821 bp, Homo sapiens
  misc_feature: GYAE6OF02IIQBY.17.1.A01.1.454.CMB.1.raw
tcagcgtagactagcacgaccggtgctcgatttagacgtctcatcaggagtcagacccactcaggacacagcatggacatcagggtccccgctcagctcctggggctcctgctgctctggctcccaggtgccagatgtgccatccaaatcgacccagtctccagtcctccctgtctgcattctgtaggagacaggtacgttaaccagtctacttcgggccgggtacaaacggttcgaggggtacctaagttaaggaaaagtgttaagttttaggacgttaggttaataaccgaaaactaaaaaacgtaggggaagtaaccgtaacccctaaaccgtcccttagacttacttaagtcgactacggtactactaccgttagtttacgaccgacggttaaccggttccgggggttaccctaacggttacgtaaccggtttaccggaagggtaccgggacgtaacgggttacggtagttaccggtacgggacctaaacgggtagtttaacctttacccgtaaccctttaccgtaaccctaacccgtaaactacccgtaaacggcgtacggtaccgtacggtaccgaccggtacgtaggttaaacgtttacgttttaccgaaactttaaaccgttttacttaacgttaccggttaacttaacgaaatttaccgtttaaccgttaccggtttaccccgttaccggtaacccggtttaccgggaaccggttaacggggaccgtttaacggagggtaacgtaaacgtaccggaaaaccgttgtaccggtcggtaaccgttcgtacccgtaacgttccgtatttacccgg

SEQ ID NO: 98252 - DNA, 669 bp, Homo sapiens
  misc_feature: GYAE6OF02H7FZ8.17.1.A01.1.454.CMB.1.raw
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (399)..(399): a, c, t, g, unknown or other
  misc_feature (399)..(399): n is a, c, g, or t
tcagcgtagactagcacgaccggtgctcgatttagacgtctcatcaggagtcagacccactcaggacacagcatggacatcagggtcccgctcagctcctggggctcctgctgctctggctcccaggtgccagatgtgcctatccaaatgacccagtctccatccctcctgtctcgcatctgtaggacgacagagttacatcacttgcaggcaagtcaggcattagaaatgattagctggtatacaaacaaaacgtaggaagacgactaaaacctctacgtatacgtatangtcnataccgtagttagacctagacctaggggtccaacgtaccgaaggttacacggacggcgtaagtcggaattccgtgacgtaactacggtattttaccaacttccnttaacccaacttcgacgaaccgactccgtaggacctacggaccctacggtaaattaagttttcgacttaaaccttaccggttattacgttaccgtaaccgaaagttaacgttaaccgttaacgttacccggtaagttaaccgggtcccgtaaggtaaccgggtaaaccggtaacccgggtaaaggtacgggtaacttaacccgtaaaacggaacccgggttaagtaaccgggtaccgggttaacctcccggaacggtccctttaacccgg

SEQ ID NO: 98253 - DNA, 937 bp, Homo sapiens
  misc_feature: GYAE6OF02FUH5A.17.1.A01.1.454.CMB.1.raw
  modified_base (235)..(235): a, c, t, g, unknown or other
  misc_feature (235)..(235): n is a, c, g, or t
tcagcgtagactagcacgaccggtgctcgatttagacgtctcatcaggagtcagacccactcaggacacagcatggacatcagggtccccgctcagctccgtggggctcctgctgctctggctccgaggtgccagatgtgccataccaaatcgaccagtcctccattccctcctgtctcgctatcgtagtacggacacaggtacgttaccagtcctacgttcggacccgggtaanaacggttaccgagggtcctaaagttaacggtaaagttggttaacgttacggtcgttaaggttaacctaaaccgtaaaaaccgtaaaaacgggttagggggaaccgtaaacccgtaacccccccgttttaaaacgtcccgttaaggtaacctttaccggttaaacgttcggggtaaccttaccggtactaccgtttaccggtttaaacgggtttgaacccgttaacgggtacccgggtttacccgggggtaacccttaacggtttaaccggtaaggtttacccggaacggggtaccggtaacggtttaacgggtacgggttacctttacgggaaccggtaccaaacgggtttaccgttacccttttaaccggacccttacccgtaacctaaacccgttacgaccccgtaacggacccggttacccgtaccggttaccggaacccgtttacggaacccgttaaagggtttaccttaaaccgttttcgaaacctttaacgttttacttaaccggtattttaaaccggaacgtttaacgtaacgtttaccgttaacccgtttacccggggtaacgtttaccgggtaccggaacccggtaagggtacccgtaacggggtaggtaacctaacggttaaaaccctacgggtttaaacggttcgggaccgtttcgtaaaccggacccttacgtaccggtttctttaccgg

SEQ ID NO: 98254 - DNA, 763 bp, Homo sapiens
  misc_feature: GYAE6OF02H146Y.17.1.A01.1.454.CMB.1.raw
  modified_base (98)..(98): a, c, t, g, unknown or other
  misc_feature (98)..(98): n is a, c, g, or t
  modified_base (215)..(215): a, c, t, g, unknown or other
  misc_feature (215)..(215): n is a, c, g, or t
  modified_base (643)..(643): a, c, t, g, unknown or other
  misc_feature (643)..(643): n is a, c, g, or t
tcagcgtagactagcacgaccggtgctcgatttagacgtctcatcagggggcaggagtcagacccactcaggacacagcatggacatgagggtccccnctcgagctccgtggggctcctgctgctctggctcccgaggtgccagtatcgtgaccagtccaaatgacccctagtcctccacttccgtccctgtacctgacctagtctaggtagganaccgtaggtacttacccatcgtacttcgggacccgggactaaaggttccgaagggacctaagttaacggtaaagtacggtagtttacggcttagggttaactaccgaaaaacgaaaacggttaggggaacgtaaccggtaaacccccttaaaccgttccgtacggtaacttaccgtaagtttccgacgtacggtacctacgttaccgtaaggtttcgtaaccgtaggtacccggttcggggtaccctacttacggtacggttacaacggtcggacgtacggtaggtacgttaccgtacggtaccaacggtacgtttaccttaccggacttcccggtactaaacccgtacgttacgaccgtccgacgttccaccgtacgttaaccgtctaaagggttactatttccgaactaacgttattcgtacttanaacgtaataccgttaacgtaccgtaccgtacggtacgttaccgaccggaggtaccggaacgggtacgacggttaacacccgtaacgtaggttacggcgttacgaccggccttacgtaacg

SEQ ID NO: 98255 - DNA, 262 bp, Homo sapiens
  misc_feature: GYAE6OF01AGAFI.29.81.H04.1.454.CMB.1.raw
  modified_base (258)..(262): a, c, t, g, unknown or other
  misc_feature (258)..(262): n is a, c, g, or t
tcagatagagtactcacgaccggtgctcgatttagtagtgtagattcgcgggaagatgaagacagattttactttcaccatcagcagcctgcagcctgaagatattgcaacatattactgtcaacagtatgataatgtccctccgtacacctttggccaggggaccaagctggagatcaaacgaactgtggctgcaccatctgtcttcatcttcccgcatctgaagtctctatctgagcggctggcaaggcgcatagnnnnn

SEQ ID NO: 98256 - DNA, 281 bp, Homo sapiens
  misc_feature: GYAE6OF01EGOI9.29.81.H04.1.454.CMB.1.raw
  modified_base (261)..(281): a, c, t, g, unknown or other
  misc_feature (261)..(281): n is a, c, g, or t
tcagatagagtactcacgaccggtgctcgatttagtagtgtagattcgcgggaaggatgaagacagattttactttcacctatcagtcagcctgcagcctgaagatattgcaacatattactgtcaacagtatgataatgttccctcgtacacctttggccaggggaccaagctggagatcaaacgactgtggctgcacgatctgtcttcagtcttccgcatctgaagtactctatctgagcggctggcaaggcgcatagnnnnnnnnnnnnnnnnnnnnn

SEQ ID NO: 98257 - DNA, 262 bp, Homo sapiens
  misc_feature: GYAE6OF01C2YWB.29.81.H04.1.454.CMB.1.raw
  modified_base (261)..(262): a, c, t, g, unknown or other
  misc_feature (261)..(262): n is a, c, g, or t
tcagatagagtactcacgaccggtgctcgatttagtagtgtagattcgcgggaagatgaagacagattttactttcaccatcagcagcctgcagcctgaagatattgcaacatattactgtcaacagtatgataatgtccctccgtacacctttggccaggggaccaagctggagatcaaacgaactgtggctgcaccatctgtcttcatcttcccgccatctgaagtactctatctgagcgggctggcaaggcgcatagnn

SEQ ID NO: 98258 - DNA, 243 bp, Homo sapiens
  misc_feature: GYAE6OF01AVLGX.29.81.H04.1.454.CMB.1.raw
  modified_base (241)..(243): a, c, t, g, unknown or other
  misc_feature (241)..(243): n is a, c, g, or t
tcagatagagtactcacgaccggtgctcgatttagtagtgtagattcgcgggaagatgaagacagatggtgcagcctgaagatattgcaacatattactgtcaacagtatgataatgtccctccgtacacctttggccaggggaccaagctggagatcaaacgaactgtggctgcaccatctgtcttcatcttcccgccatctgaagtactctatctgagcgggctggcaaggcgcatagnnn

SEQ ID NO: 98259 - DNA, 263 bp, Homo sapiens
  misc_feature: GYAE6OF01DUDZZ.29.81.H04.1.454.CMB.1.raw
  modified_base (260)..(263): a, c, t, g, unknown or other
  misc_feature (260)..(263): n is a, c, g, or t
tcagatagagtactcacgaccggtgctcgatttagtagtgtagattcgcgggaagatgaagacagattttactttcaccatcagcagcctgcagcctgaagatattgcaacatattactgtcaacagtatgataatgtccctccgtacacctttggccaggggaccaagctggagatcaaacgaactgtggctgcaccatctgtcttcatcttcccgcatctgaagtactctatctgagcgggctggcaaggcgcatagnnnn

SEQ ID NO: 98260 - DNA, 262 bp, Homo sapiens
  misc_feature: GYAE6OF01D25KN.29.81.H04.1.454.CMB.1.raw
  modified_base (260)..(262): a, c, t, g, unknown or other
  misc_feature (260)..(262): n is a, c, g, or t
tcagatagagtactcacgaccggtgctcgatttagtagtgtagattcgcgggaagatgaagacagattttactttcaccatcagcagcctgcagcctgaagatattgcaacatattactgtcaacagtatgataatgtccctccgtacgcctttggccaggggaccaagctggagatcaaacgaactgtggctgcaccatctgtcttcatcttcccgcatctgaagtactctatctgagcgggctggcaaggcgcatagnnn

SEQ ID NO: 98261 - DNA, 636 bp, Homo sapiens
  misc_feature: GYAE6OF01B40RQ.29.81.H04.1.454.CMB.1.raw
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggaggccgtggtcgaagggccgggggggtccctggacgactcctcctgtgcagcctctggattcattcttctagttagttttagctatgaacgtgggtccgccgaggctccgaggggagggctggagtgggtctcatcctattaggtggtaagtaacgtagtagaacagaatacgtacgcagactgagtaggaacgggcctattccaacctactcctaccgaagacaaccgaacgaccaaagaacgtcagttagtaactacgtaaggaaatacgaacgtacgtaccgtagggacgacggacccgaagggaccgtaccggtcgttaggttagtttaaacgtttacgtaggttacggttaaacgttccggtttacgggtacggggttttagtacgttagggaacgaggggttagtttacggg

SEQ ID NO: 98262 - DNA, 265 bp, Homo sapiens
  misc_feature: GYAE6OF01BR89L.29.81.H04.1.454.CMB.1.raw
  modified_base (261)..(265): a, c, t, g, unknown or other
  misc_feature (261)..(265): n is a, c, g, or t
tcagatagagtactcacgaccggtgctcgatttagtagtgtagattcgcgggaagatgaagacagattttactttcaccatcagcagcctgcagcctgaagatattgcaacatattactgtcaacagtatgataatgtccctccgtacacctttggccaggggaccaagctggagatcaaacgaactgtggctgcaccatctgtcttcatcttcccgccatctgaagtactctatctgagcgggctggcaaggcgcatagnnnnn

SEQ ID NO: 98263 - DNA, 262 bp, Homo sapiens; identical to SEQ ID NO: 98257
  misc_feature: GYAE6OF01AXCIX.29.81.H04.1.454.CMB.1.raw
  modified_base (261)..(262): a, c, t, g, unknown or other
  misc_feature (261)..(262): n is a, c, g, or t

SEQ ID NO: 98264 - DNA, 620 bp, Homo sapiens
  misc_feature: GYAE6OF01A5NFJ.29.81.H04.1.454.CMB.1.raw
  modified_base (391)..(391): a, c, t, g, unknown or other
  misc_feature (391)..(391): n is a, c, g, or t
  modified_base (551)..(551): a, c, t, g, unknown or other
  misc_feature (551)..(551): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactgggctccgcttgggttttccttgttgcttattttagaaggtgtccagtgtgaggtgcagcgtgggtggaggttcggtgggggacggtccgtgggtcgaacgggtccgggggggtccctggagtactctccgtgtgcagcctcgtggtattcatcttacgagttacgttttagctatgaacgtgggtccgcgaggcctcggaaggggacgggctgggagtgggtctcgatcaagttgaggtagtaacaggtnacagtactaactacgcaagtactagaggtacggaacgggcctattaccacctacgtcctaccgaagaagaaccgaacgacccaaaagtaacgtccgaattacgtagttacgaaggtaaatcgaaaccaggtccgtagaacggcgacggaggaccacggtnttaggtagttattacgtgtaacgtaacgtcgttcggtcggttagtagttacggacggtaggtggttacg

SEQ ID NO: 98265 - DNA, 506 bp, Homo sapiens
  misc_feature: GYAE6OF01DAXUR.29.81.H04.1.454.CMB.1.raw
  modified_base (302)..(302): a, c, t, g, unknown or other
  misc_feature (302)..(302): n is a, c, g, or t
  modified_base (457)..(457): a, c, t, g, unknown or other
  misc_feature (457)..(457): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaaggccggggggtccctgagactctcctgtgcagcctctggattcatcttcagttagttttagcatgaactgggtccncaggctccgagggaaggggctggagtgggtctcatccattagtggtagtaacagtgacagatactacgcagactcagtgaggccatcacatctcagagacacgccaagaatcactgtatctaggaatgaacagcctgagagaccgagacacggcngtgtattactgtagtaagacttcggcggttggatgaacnggngttacgg

SEQ ID NO: 98266 - DNA, 245 bp, Homo sapiens
  misc_feature: GYAE6OF01D78HH.29.81.H04.1.454.CMB.1.raw
  modified_base (235)..(235): a, c, t, g, unknown or other
  misc_feature (235)..(235): n is a, c, g, or t
  modified_base (240)..(245): a, c, t, g, unknown or other
  misc_feature (240)..(245): n is a, c, g, or t
tcagatagagtactcacgaccggtgctcgatttagtagtgtagattcgcgggaaggatgaagacagatggtgcagcctgaagatattgcaacatattactgtcaacagtatgataatgtccctccgtacacctttggccaggggaccaagctggagatcaaacgaactgtggctgcaccatctgtcttcatcttcccgccatctgaagtactctatctgagcggctggcaaggcncatannnnnn

SEQ ID NO: 98267 - DNA, 690 bp, Homo sapiens
  misc_feature: GYAE6OF01BNZYD.29.81.H04.1.454.CMB.1.raw
  modified_base (201)..(201): a, c, t, g, unknown or other
  misc_feature (201)..(201): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgcgttgggttttccttgttgtcttattttagaaggtgtccagtgtgaggtgcngcgtggtggaggtcggtgggggaggccgttgggtacgaacgggtcccgggggggtccctaggacgaccttctccgtgtcgcgacgcccttcgtggtacttcacttcttactagtttagttttagctagttcgaacgtcgggccgaccgacggccgtacggaggggaagggcgtgggtaggtcggtctcacttcgtagttaggtaggtacgtaacgtagtacgaactagtaacgtacgtacgacgagactacgaggtagggaacggtccgtacttaccacctacttcctaccgaagaacgaaccaaccgaaccaaagtaaccgtacgtacgttagtacgtacgtaaggtaactagaaccgtacgtaccgtaggaccggaacgacgggaaggaacccgtacggtacgtttggtaacgtttagttacgtagttagttaacggttcgttacgggtagggtttagtagtaggaacggttagggttagttaacgg

SEQ ID NO: 98268 - DNA, 666 bp, Homo sapiens
  misc_feature: GYAE6OF01D3GF5.29.81.H04.1.454.CMB.1.raw
  modified_base (180)..(180): a, c, t, g, unknown or other
  misc_feature (180)..(180): n is a, c, g, or t
  modified_base (298)..(298): a, c, t, g, unknown or other
  misc_feature (298)..(298): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactgggctccgctgggttttcctgttgcttattttagaaggtntccagtgtgaggtgcagctggtggagtcgtggggagcctggtcaggccgggggtcctgagactctcctgtgcagcctcgtggtatttaagtttaggattcatgcatgaacgtcggccnccgaggcctcgaggggacgggctgggagtggtctcggtactagttacggtggacgtaggtcggtggacgtacttaatagtttaattagtcgaccacggtaccgtcccgaggggtaacgggtcccggttacaacccttacgtttacccgaggtaacgtaaacctaacgttaccggaaacgtaaccgaacgtaccgttagttacttccgtagtaccgtaaagtcgggaacgtcgtaccgtagacgtaaccgtccggaactaccgaccggtccgtattattgttagtaacggttaacggcgtacggtcgtacgggtaaccggtaccggggtacccggggtaccctacggtccgaccggtacgggtccgggg

SEQ ID NO: 98269 - DNA, 677 bp, Homo sapiens
  misc_feature: GYAE6OF01D398D.29.81.H04.1.454.CMB.1.raw
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgcgttgggttttccttgttgcttatttagaaggtgtccagtgtgaggtgcagcgtggtggagtcgtgggggagcctggtcaacgggccggggggtcctgacgctctccgtgcgcgagtcctcgtggtacttctattctttacgtagttacgttttagctagtacggtacgtacgggtccgaccgacggccgtcggaaggggtagggtcgtaggtaggtgggtactcctagtcctaagtttacggtaggtaacgtaacagtcgaacgtagtaactaccgtacgacgacgtactacgagtaacgggtaacggtccctacgttaccacctacttacctacgaagtaaacgaacctaaaccggacctaaaggaccttcgtaaccttggtactaccggtagtaagtacgaacgtacggtacacgagtaacggccgaacggaccgtacggtcgttagttagttagttaaccgtaggttaaggttacgtacgttacggacgggtttctaagtcggtaacggtagggtggttaacgg

SEQ ID NO: 98270 - DNA, 754 bp, Homo sapiens
  misc_feature: GYAE6OF01CL8SV.29.81.H04.1.454.CMB.1.raw
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (390)..(390): a, c, t, g, unknown or other
  misc_feature (390)..(390): n is a, c, g, or t
tcagatagagtactcacgaccggtgctcgatttagtagtgtagattcgcggggagctctgagagaggagccttagccctggattccaaggcctatccacttggtgatcagcactgagcaccgagattcacatgacgtgggctcgcttggtttctgttgcttatttagagtgtcagtgtgagtgcagcgtggtggagtcggtggggagccgtggtacgacgggtccgggggtcctgacgtctctcgtgtcgcgtctcgtagtaatttaggtttagntacgatcgactagtacgacgtcggccacggngtccgacggaggggacggtcgtaggtaggtcgggtcgtcgtatttacgtagtcggngtggtggtgacgtatattagtagttagngacacgaccgccgtaaggacgggtccttacaacttcgtacgaagaacgtaacttaacgtaacgaaacgtacctcgtacgtttaagtacgtacgttacgaaacgttaaaggcggtaaaccggtaccgttacgtaacgggttaaccgaaccccggttaacggacccggtaaaaccggttcccgggtttacctttaagtttaacgtttttacgggtaaaccggtaaaagggtttaacgggacccgttaaagggtacccgggtttaaaacgggggaaaccccgggttaacccccgggggggtacccccgttaaacccgtttaggttaacccccgggaacgttcgggggtaaaccccggggggaaccgg

SEQ ID NO: 98271 - DNA, 914 bp, Homo sapiens
  misc_feature: GYAE6OF01BCGSX.29.81.H04.1.454.CMB.1.raw
  modified_base (326)..(326): a, c, t, g, unknown or other
  misc_feature (326)..(326): n is a, c, g, or t
tcagatagagtactcacgaccggtgctcgatttagtagtgtagattcgcggggagctctgagagaggagccttagccctggattccgaaggcctatccacttggtgatcagcactgagcaccgaggattcaccatggaacgtggggctccgcgttgggttttccttgttgtcttatttagaaggtgtccagtgtgaggtgcacgtcgtgggtggagtcggtgggggacggccgttggtacgtaacgggcccgggggggtcctcggacgtacctctccgtgtcgcacgcctcgtaggtacttcattcttacctaggttacgttttancgtagttacgaaccggttcgggcccgtaccgacggtaccgtaccgggaacggggtaacggggtcgtagggtacggttacgggtccttacgtacgttaccctaggtttaacggtacggtaacggttaaacgaggttacgaaccggtacgtaaacgttacccgtaacgtaccgtaacgtaaccgtagtaacgggtacgggaacggggtaccctacttaccgaaccgtacttaccgaaccggtaaaggaacccgaaacggtaaaccccggacccgttaaaaaggtacccggttacctaacccggttagttaaaccgtttccggaaacggttaaaaggttacccgtaaaacggtaaccggttaccccgtaagggtaaacccggtacccgggaacccggggaaacggtaaacccggggttcccggggtactttaaacggggtttaacccgttaaggtttaaccgggtttcggtaaaaacccgggtttccgggtttaaccgggttaaccccggggttttaccgggggttttaaacggggtaccccggtttaacgggtaacggttaaaccgggggttttacgggtttaaaccggg

SEQ ID NO: 98272 - DNA, 816 bp, Homo sapiens
  misc_feature: GYAE6OF01BE9G6.29.81.H04.1.454.CMB.1.raw
tcagatagagtactcacgaccggtgctcgatttagtagtgtagattcgcggggagctctgagagaggagccttacgccctggattccaaggcctatccacttggtgatcagcactgagcaccgaggatcaccagtggaacgtggggctccgcgttggttttcctgttgcttaattttagaaggtgtccagtgtgaggtgcagcgtggtggagtcgtgggggacgccgttggtcgaacgggtcccggggggtccctgacgtacctcgtccggtggtcgccgtacgtcccttacgtaggtaactttccattttccgttacgttaaggttttaacgtttttagaccgtaagttacggtaaccggttccggggtacccggaccggtaacgggcccgttaacccggggaagggggggtaaccgggttcgggtaggggtacggttcggggttaccttaccgtaacgttcccgttaaagggttttacgggttaaggtttaaacggtaaacgtaacgggttacgaaaccgtaaggtaaacgtttaacccgtaacgaccgtaaaggtactacggtaggttaacgggaacggggtcctaattacccgactacgtacctcgaaacgacgtaaccgaacgtaccgaaagtaaccgtactaacgttgttaataccggtaaggtaaactcgaaacgcggtacgtagaccggtacgacgggtacgacggcgttacgtagttagtacgtttaacggttggttaaacgttccggaccggtttgggttaccggttaggttacgttacgggacggttaagggtacggtttaacgg

SEQ ID NO: 98273 - DNA, 807 bp, Homo sapiens
  misc_feature: GYAE6OF01A8V4F.29.81.H04.1.454.CMB.1.raw
  modified_base (183)..(183): a, c, t, g, unknown or other
  misc_feature (183)..(183): n is a, c, g, or t
tcagatagagtactcacgaccggtgctcgatttagtagtgtagattcgcggggagctctgagagaggagccttagccctgattccaaggcctatccacttggtgatcagcactgagcacgagattcaccatggaacgtggggctccgcgttgggtttttccttgttgcttattttagaggttntccaggtgtggaggtgcagtcgtgggtggtaggtcggtggggggacggtccgtagggtccgaacgggggtcccggggggggtccctaggacgtacctccgtccgtggtcgccgacgtcccgtcgtaggtacttactacttccttcgtaaggtttagttttacggctaagtcggaacgttcgggccgaccgacggtcctaccgggaaggggacggcggtggaggttcggtactcgtactccgtaagttagggttaggtaacgttaaacgaggttagaacgtaagtacgttaaccgtaacgccgtaaagaccttacgaagggtacggggaaaccgggtccgtaacttacccaaccgttacttacccgtaccgaaacggaaacgaacccgtaacgaacccgaaaaagggtacctaaccggtaaccttaggtaaacgttacggaaaggtaaagtaccgaaccgtacggtacccgtaagggaaccggtccgaacgggaacgggacgtacgggtccttaggggtaatttaaccgttagggtttacggtaacggttaaccgtttaaccgggtttcgggtaaggggttttactaacgggtacggtaacggttaaggggttggtttaaaccgg

SEQ ID NO: 98274 - DNA, 515 bp, Homo sapiens
  misc_feature: GYAE6OF02J00KY.29.81.H04.1.454.CMB.1.raw
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtctgggggagcctggtcaagccggggggtccctgagactctcctgtgcagcctctggattcatcttcagtagttttagcatgaactgggtccgccaggctccagggaagggctgggagtggggtctcatccattagtggtagtaacagtgacagatactacgcagactcagtgaaggccgatcaccatctccagagacaacgccaagaagtcactgtatctggaaatgaacagcctgacgagccgaggacacggctagtgtattactgtagtaagtacttcggcggtttggtatgacgaggagttacgg

SEQ ID NO: 98275 - DNA, 262 bp, Homo sapiens; identical to SEQ ID NO: 98257
  misc_feature: GYAE6OF02G1F5Z.29.81.H04.1.454.CMB.1.raw
  modified_base (261)..(262): a, c, t, g, unknown or other
  misc_feature (261)..(262): n is a, c, g, or t

SEQ ID NO: 98276 - DNA, 610 bp, Homo sapiens
  misc_feature: GYAE6OF02I6DTD.29.81.H04.1.454.CMB.1.raw
  modified_base (351)..(351): a, c, t, g, unknown or other
  misc_feature (351)..(351): n is a, c, g, or t
  modified_base (444)..(444): a, c, t, g, unknown or other
  misc_feature (444)..(444): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggtttcctgttgctattttagaaggtgtccagtgtgaggtgcagctggtggagtctgggggaggcctggtcaaggccggggggtcctgagactctcctgtgcagcctctggattcatcttcagttagtttagcatgaactgggtccgcaggctccgagggaagggctggagtgggtctcatccattagtggtagtaacngtgacagatacgtacgcagactcaggtgtaagggcctagttccacgtatctaccgagacgaacaaccgccaaagaacgtcaacctagtacgtntagggaaatcgaaactagaccttaggaacgtacgaccggaacggtaaccgaccggggcttacggttacgttaaacgttacggttagtacggttaaaacggtccgttttaccgggcggggttttacgggtaagttacgggaaccggttagggtaggttttaacgggg

SEQ ID NO: 98277 - DNA, 541 bp, Homo sapiens
  misc_feature: GYAE6OF02GPDSO.29.81.H04.1.454.CMB.1.raw
  modified_base (475)..(475): a, c, t, g, unknown or other
  misc_feature (475)..(475): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgggggggtccctgagactctcctgtgcagcctctggattaagtttaggagtcatgccatgaactgggtccgccaggctccgagggaaggggctgggagtgggtctcggctagttagtggcagtggtggcgctatatattatgcagacgccctggaacgggtccggtcacctatttccagacgacaattcgaagaacacgctgtatctgacaaatggagagcctgagactcgacgacacggccgtntattattgtagttaaaggcgaggctaggaagtacggggaccgggccgtacgtcggaccagtcgggg

SEQ ID NO: 98278 - DNA, 525 bp, Homo sapiens
  misc_feature: GYAE6OF02HWRDS.29.81.H04.1.454.CMB.1.raw
  modified_base (358)..(358): a, c, t, g, unknown or other
  misc_feature (358)..(358): n is a, c, g, or t
tcagatagagtactcacgaccggtgctcgatttagtagtgtagattcgcgggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggggaggcctggtcaaggccgggggggtccctgagactctcctgtgcagcctctggattcattcttcagtagttttagcatgaactgggtccgcgaggctcgagggaggggctggagtgggtctcatccattagtggtagtaacngtgacagatactacgcagactcagtgaaggcatcaccatctcagacgacaacgaccaagaacgtcactgtatctaggaaatcgaacagctgagagccgaggacacgctgtagtagttctagtagtaacgtacgttcggtacggttggtatggactaggtagttacgg

SEQ ID NO: 98279 - DNA, 555 bp, Homo sapiens
  misc_feature: GYAE6OF02HZECE.29.81.H04.1.454.CMB.1.raw
  modified_base (368)..(368): a, c, t, g, unknown or other
  misc_feature (368)..(368): n is a, c, g, or t
  modified_base (439)..(439): a, c, t, g, unknown or other
  misc_feature (439)..(439): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaaggccgggggggtccctggagactctcctgtgcagcctctggattcattcttcagttagttttagcatgaactgggtccgccgaggcctccgaggggaaggggctgggaggtgggtctcatcctattaggtggtagtaacngtgacagactactacgcagactcagtaggaacgggccgatcaccatcctcagagacaacgccaagaacgtnactgatcaggaaatgaaacagcctagacgcgaccggaagacgacggtctgtagttagttaactgttaggtaacgtacgttcggcgggtttaggagttaggacgtaggaggttacgg

SEQ ID NO: 98280 - DNA, 538 bp, Homo sapiens
  misc_feature: GYAE6OF02GDBLS.29.81.H04.1.454.CMB.1.raw
tcagatagagtactcacgaccggtgctcgatttagtagtgtagattcgcgggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgggggggtccctgagactctcctgtgcagcctctggattcatcttcagttagttttagctatgaacgtgggtccgccgaggctccgaggggaaggggctgggagtggggtctcatccattaggtggtagtaacagtgacagatactacgcagactcagtgaacgggcgtatcaccatctccagagacaaccgcaagaagtcatgatctggaaatggaacagtccaggagagaccgaggacacggctgtgtattactgtagtaacgtacgttccggtcgggtttggtaagtgacgtagggtagttagg

SEQ ID NO: 98281 - DNA, 560 bp, Homo sapiens
  misc_feature: GYAE6OF02FZ49V.29.81.H04.1.454.CMB.1.raw
  modified_base (363)..(363): a, c, t, g, unknown or other
  misc_feature (363)..(363): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaaggccgggggggtccctgagactctcctgtgcagcctctggattcatcttcagtagttttagcatgaactgggtccgccaggctccgaggggaaggggctggaggtgggtctcatccattaggtggtaagtaacngtgaacagatactacgcagactcgagtggaacggggccattccaccatctaccaagacgaacaacgaccaaagaacgtccacgttgtactcgtagggaaattgaaacagcctagagacgcgaggacacggctagtgttacttagtgttaggtaacgtacgttcggtggtttggtaatcggacgtagggtagttacgg

SEQ ID NO: 98282 - DNA, 616 bp, Homo sapiens
  misc_feature: GYAE6OF02HFT1S.29.81.H04.1.454.CMB.1.raw
  modified_base (532)..(532): a, c, t, g, unknown or other
  misc_feature (532)..(532): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctggttttccttgttgctattttagaagtgtccagtgtgaggtgcagctggtggagtcgtgggggagccgtggtcgaacggccggggggtccctgacgactctccgtgtgcagcctcgtgtattcattcttcgagttagttttagactagtcgtaacgttcgggtcccgaccgacggtccgtaccggaggggaacggggtcgtgggtaggttcgggtctcacgttccgtaagttaggtaggtaacgtaacgaggttacgaacgtagtaactacgtacgactagtactacgaggtaggaacgggtcctaatccaacgtactcctaacgagacgaaccgaacgaccaaagaactcgtacgttgtactacgtagtaatacgaacgngtaccgtagacgacgacgagacgcgtgtgtacgttagtgtagtagtaacgtcgttggtacggttgtagtgacgtagtagttacg

SEQ ID NO: 98283 - DNA, 575 bp, Homo sapiens
  misc_feature: GYAE6OF02H2TBN.29.81.H04.1.454.CMB.1.raw
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (391)..(391): a, c, t, g, unknown or other
  misc_feature (391)..(391): n is a, c, g, or t
  modified_base (473)..(473): a, c, t, g, unknown or other
  misc_feature (473)..(473): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctgggtcaaggcccgggggggtccctggagactctcctgtgcagccttctggattcgattcttcagttagttttagctatgaactgggtccgccgaggcctccgagggagggctgggngtgggtctnatccattagtggtataacgagtgacagatactacgacagactnaggtagaacgggcctagttccacctagtcctaccaagacgacaacgaccaaagaacgtcaagtgtatacaggaaatcgaaancgacctagaagtacgcccggaggaccgacggtactaggttagtacgttagtgttaggtaaacgtacgttcggtaggttcggtatggtacagggtgttaacgg

SEQ ID NO: 98284 - DNA, 699 bp, Homo sapiens
  misc_feature: GYAE6OF02H2HO1.29.81.H04.1.454.CMB.1.raw
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgcttattttagaaggtgtccagtgtgaggtgcagcgtggtggagtcgtggggggaggcgtggtcgaagggccgggggggtccctggagactctcctgtgcagcctctggattcattcttctagttagttttagctatagtaacgtcggggtaccgccgacgggcctaccgggaagggggacggggcggtagggtagggttgggtcctctacgtaccgtagttaggttacggtaacgtaacgaggtagaacgaagtaacttacgtacgacacgtactcgagggtacgggtaacgggtacgtactaccaaccctactcctacgacggaaccgaaccaacccggaaccaaagtaactactacgtacgttaactacggtaagtaaagtaacgaacacggtaccgtacggaacggacgaacccgggaacggaaccgtacgggtcgttagttagttacgtttacggttagttaaggtaccgttacggttcggttacggggtttaggttacggtaggtaacggtagggttaggtttaacgg

SEQ ID NO: 98285 - DNA, 1011 bp, Homo sapiens
  misc_feature: GYAE6OF02JIRUG.29.81.H04.1.454.CMB.1.raw
tcagatagagtactcacgaccggtgctcgatttagtagtgtagattcgcggggagctctgagagaggagccttagccctggattccaaggcctatccacttggtgatcagcactgagcaccgaggattcaccatggaactgggctccgcgttgggttttccttgttgcttattttagaggtgtccagtgtgaggtgcagtcgtggtggtaggtccgtgggggacggtccgtggtacgaacgggtccccgggggggttcccgtggacggtaccgttccgttccgttggtcggtaccgacggtcccgttcgtcgggtacgtttccgtaacgttccgtttaccgtaggtttaccggtttttagacccgttagttacggtaacggttcggggttcccgccgtaacgggtccttaccggagggggtaacgggggtccgttacggggacgggtttacggggtcccttaccggtaacggttaccccgttaagggttttacggggttacgggtttaaacggttaaaccggttacgggttaccggtaaacgttaacggtaaagtttaaacccggtaccggaacggtaaccggttaacccgtttaaccggagggtttaacgggtaaacggggtaccccgttaccggtttaaaccgtaaacccccgttaaggttttaaccccgtaccccgggtaaagtaaccgggtaaaaccctaaccccggggtaaacccgaaaaaggggttaaaccctttcccggtaaacccgtttaaggttaaccgtttaacccgtaaaggggttaaaaaccgtcgggttaaaaaccggtaccgttacccggtaaaggggaaccgggttacgaaacccgggggtaaccggtaaaccgggtacccgttaaccgggttcggttaaaccggggttaactttaaccggggtttagttaaacgggggttaaaccttccgggttttaacggttagggggtttaccggttaagtacgggttaaccggtaggggttaacgttacggg

SEQ ID NO: 98286 - DNA, 637 bp, Homo sapiens
  misc_feature: GYAE6OF02FMM5H.29.81.H04.1.454.CMB.1.raw
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtggggggaggcctggtcgaagggcccggggggggtccctggagactcctcctgtgcagcctctggattcatcttcagttagttttagctatggaacgtcggggtcccgccgacggcctccggagggggaacggggcgtgggaggtggggtctctatccagttaggtggtagtaacgtaggtagacgaggtactaacgtacgactagactacgaggtggaacggggctatccactactctccaagacgacaaccgaccaaagacgtcacttcgtatacgtaggaaacgtcgaaacgtcgaccgtagaaggacgtaccggaacggaccgaacgggtccgttaggttagttacgtttaggtcgttaacgtaacggtaccgtttacgggtcgggtttaggtaggttacggtacggagggttagtttacgg

SEQ ID NO: 98287 - DNA, 823 bp, Homo sapiens
  misc_feature: GYAE6OF02FQ0K3.29.81.H04.1.454.CMB.1.raw
  modified_base (283)..(283): a, c, t, g, unknown or other
  misc_feature (283)..(283): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctcgctgggtttccttgtgctatttagaaggtgtccagtgtgaggtgcagctggtggagtcgtgggggagccgttggtacgaacgggcccggggggggttccctggacgtaccttcctccgtggtacgccagtcccctntagggactttcgaacttcctttacgtacggttaaggtttttacgacctaagttacggtaaaccgtcgggggttacccgcccgtaagggtcccttacccggaagggggaaacggggtccgttacggggaaggttcgggggttacctaccggtaagtccctaaggttttaacggtacgggttaaagtaaaccgtaggttacggaacaacggtaattaccgtaacgactaacgtaccttacgaggttaaggacggggtccgtattaaccgaccctaattcccgtacgtaacggaacggaacctaaccgggaacccgtaaaaggtaacggtacctacgttaaccgtacgttaccggtaacggtaaaacgttacgggaaaccgtaccggtaccgtaggaacgggtaacggcccggtaaacggaccgtacgggacgttttaggaacggtttacgtttaacgggtacggttaacgtaaccgggttaccgttacggttaccggggttttacggttagtaacgggaccgttagggtagttttaccgggg

SEQ ID NO: 98288 - DNA, 789 bp, Homo sapiens
  misc_feature: GYAE6OF02JO8LE.29.81.H04.1.454.CMB.1.raw
tcagatagagtactcacgaccggtgctcgatttagtagtgtagattcgcgggggagctctgagagaggagccttagccctggattccaaggcctatccacttggtgatcagcactgagcaccggtaggattcaccatggaactggggctccggcgttcgggttttccttgttcgtcttagttttagaaggtcgtacctaggtgtggaggtcgcgtgtcgtgggtacgggaggtcggtcggggggacgtccggtgggtaccgtaacgggggtccccgggggggttccctaggacgtccgtccgtccggtggtcgcgacggccctcgtaggttactctacgttcgttccgtagtttacggtttacgtctagtcggtaacgttcgggaccgcgtcggtccgtacggagggacggttcggcgggtaggtcggtactcgacttaccgtaggttaggtaggttacgtaaggtagtcggaagtaacgtaacgtacgaccgtacgacgtacgtacgtacgggtacggaacggtaccgttacgtaacctaccgtacgtccgtaaccgtacggaaccgtaaacgacccggaaccgtaacggtaccgtaccttaacgtaaccggttaacgttccggaaacggtaaagttacgtaaacgtaccggtacgttaaccgggtaaggaaaccggttcccgggaaacggccgtaacgggttcgtacgttaccggtagtaccggttgttaacgtacggttaccgtggttaccggttaggtaccgttagggaacgtggtacgttacgg

SEQ ID NO: 98289 - DNA, 682 bp, Homo sapiens
  misc_feature: GYAE6OF02FXUDG.29.81.H04.1.454.CMB.1.raw
  modified_base (591)..(591): a, c, t, g, unknown or other
  misc_feature (591)..(591): n is a, c, g, or t
tcagatagagtactcacgaccggtgctcgatttagtagtgtagattcgcggggagctctgagagaggagccttagccctggattccaaggcctatccacttggtgatcagcactgagcaccgaggattcaccatggaactggggctccgcttggttttccttgttgcttattttagaaggtgtccagtgtgaggtgcagctggtggagtcgtgggggagccgtggtcgaacgggtccgggggggtccctggagactcttcctgtgcagcctgtgattctatcttctagtttattttagctagttacgaacgttcgggtcccgaccgtacggtcgtaccggaaggggtacggggcgtgggaggttcgggttctacgacttctaagttaggttaggtaacgtaacgtagtagaacagtaactacctaacgacgacgtacgttacgaggtacggaacgggtcctaatacccgacctctacctaccggaagtacggaaccaaccggacctaaaggactaaccactaaggtcttacgtaagaaacgttagaaccgtacgaccgtaggaacggtaccgacgggacggacgtacccgnggtttacgtagttacgttacggtagtaaggttaacgttccggtttaccgttcgggttaggaccgttagggaaccgtgggtaaggtttacgg

SEQ ID NO: 98290 - DNA, 185 bp, Homo sapiens
  misc_feature: GYAE6OF01AHIQS.33.39.D06.1.454.CMB.1.raw
  modified_base (181)..(185): a, c, t, g, unknown or other
  misc_feature (181)..(185): n is a, c, g, or t
tcagtacacacactcacgaccggtgctcgatttagtgacatctcgcaggttctttgggtttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 98291 - DNA, 183 bp, Homo sapiens
  misc_feature: GYAE6OF01BW2PE.33.39.D06.1.454.CMB.1.raw
  modified_base (180)..(183): a, c, t, g, unknown or other
  misc_feature (180)..(183): n is a, c, g, or t
tcagtacacacactcacgaccggtgctcgatttagtgacatctcgcagttctttgggttttgggggaagaggaagactgacggtcccccaggagttcaggtgctgggcacagcggccctgggctgcctggtcaaggactacttcagtgtgtgtactgagcgggctggcaaggcgcatagnnnn

SEQ ID NO: 98292 - DNA, 239 bp, Homo sapiens
  misc_feature: GYAE6OF01EDZE6.33.39.D06.1.454.CMB.1.raw
  modified_base (189)..(239): a, c, t, g, unknown or other
  misc_feature (189)..(239): n is a, c, g, or t
tcagtacacacactcacgaccggtgctcgatttagtgacatctcggcagttctttgggttttgggggaagaggaaggactgacggtccccccaggagttcaggtgctgggcacagcggccctgggcctgcctggtcaaggactacttccagtgtcgtgtactggagcgggctggcgaaggcgcatacgnnnnnnnnnnnnnnnnnnnnnnnnnnnnnnnnnnnnnnnnnnnnnnnnnnn

SEQ ID NO: 98293 - DNA, 192 bp, Homo sapiens
  misc_feature: GYAE6OF01CENLM.33.39.D06.1.454.CMB.1.raw
  modified_base (180)..(192): a, c, t, g, unknown or other
  misc_feature (180)..(192): n is a, c, g, or t
tcagtacacacactcacgaccggtgctcgatttagtgacatctcgcagttctttgggtttgggggaagaggaagactgacggtcccccaggagttcgaggtgctgggcacagcggcctgggctgcctggtcaaggactacttccagtgtgtgtactgagcgggctggcaaggcgcatagnnnnnnnnnnnnn

SEQ ID NO: 98294 - DNA, 199 bp, Homo sapiens
  misc_feature: GYAE6OF01B7US1.33.39.D06.1.454.CMB.1.raw
  modified_base (185)..(199): a, c, t, g, unknown or other
  misc_feature (185)..(199): n is a, c, g, or t
tcagtacacacactcacgaccggtgctcgatttagtgacatctcgcgtaggttctttgggttttgggggaagaggaagactgacggtcccccaggagttcaggtgctgggccacagcggccctgggctgcctggtcaaggactacttccagtgtgtgtactgagcgggctggcaaggcgcatagnnnnnnnnnnnnnnn

SEQ ID NO: 98295 - DNA, 182 bp, Homo sapiens
  misc_feature: GYAE6OF01D6XIM.33.39.D06.1.454.CMB.1.raw
  modified_base (178)..(182): a, c, t, g, unknown or other
  misc_feature (178)..(182): n is a, c, g, or t
tcagtacacacactcacgaccggtgctcgatttagtgacatctcgcagttctttgggtttggggaagaggaagactgacggtccccaggagttcaggtgctgggcacagcggccctgggctgcctggtcaaggactacttccagtgtgtgtactgagcgggctggcaaggcgcatagnnnnn

SEQ ID NO: 98296 - DNA, 183 bp, Homo sapiens
  misc_feature: GYAE6OF01E4L3R.33.39.D06.1.454.CMB.1.raw
  modified_base (182)..(183): a, c, t, g, unknown or other
  misc_feature (182)..(183): n is a, c, g, or t
tcagtacacacactcacgaccggtgctcgatttagtgacatctcgcagttctttgggttttgggggaagaggaagactgacggtccccccaggagttcaggtgctgggcacagcggccctgggctgcctggtcaaggactacttccagtgtgtgtactgagcgggctggcaaggcgcatagnn

SEQ ID NO: 98297 - DNA, 183 bp, Homo sapiens
  misc_feature: GYAE6OF01A8UGF.33.39.D06.1.454.CMB.1.raw
  modified_base (181)..(183): a, c, t, g, unknown or other
  misc_feature (181)..(183): n is a, c, g, or t
tcagtacacacactcacgaccggtgctcgatttagtgacatctcgcagttctttgggttttgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 98298 - DNA, 185 bp, Homo sapiens
  misc_feature: GYAE6OF01C5GS1.33.39.D06.1.454.CMB.1.raw
  modified_base (181)..(185): a, c, t, g, unknown or other
  misc_feature (181)..(185): n is a, c, g, or t
tcagtacacacactcacgaccggtgctcgatttagtgacatctcgcagttctttgggtttgggggaagaggaagactgacggtccccccaggagttcaggtgctgggcacagcggccctgggctgcctggtcaaggactacttccagtgtgtgtactgagcgggctggcaaggcgcatagnnnnn

SEQ ID NO: 98299 - DNA, 182 bp, Homo sapiens
  misc_feature: GYAE6OF01C0NPY.33.39.D06.1.454.CMB.1.raw
  modified_base (180)..(182): a, c, t, g, unknown or other
  misc_feature (180)..(182): n is a, c, g, or t
tcagtacacacactcacgaccggtgctcgatttagtgacatctcgcagttctttgggtttgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 98300 - DNA, 185 bp, Homo sapiens
  misc_feature: GYAE6OF01D3ZZP.33.39.D06.1.454.CMB.1.raw
  modified_base (182)..(185): a, c, t, g, unknown or other
  misc_feature (182)..(185): n is a, c, g, or t
tcagtacacacactcacgaccggtgctcgatttagtgacatctcgcagttctttgggttttgggggaagaggaagactgacggtccccccaggagttcaggtgctgggcacagcggccctgggctgcctggtcaaggactacttccagtgtgtgtactgagcgggctggcaaggcgcatagnnnn

SEQ ID NO: 98301 - DNA, 182 bp, Homo sapiens
  misc_feature: GYAE6OF01BY1G6.33.39.D06.1.454.CMB.1.raw
  modified_base (175)..(175): a, c, t, g, unknown or other
  misc_feature (175)..(175): n is a, c, g, or t
  modified_base (180)..(182): a, c, t, g, unknown or other
  misc_feature (180)..(182): n is a, c, g, or t
tcagtacacacactcacgaccggtgctcgatttagtgacatctcgcagttctttgggtttgggggaagaggaagactgacggtcccccaggagttcaggtgctgggcacagcggccctgggctgcctggtcaaggactacttccagtgtgtgtactgagcgggctggcaaggcgnatagnnn

SEQ ID NO: 98302 - DNA, 190 bp, Homo sapiens
  misc_feature: GYAE6OF01B30AP.33.39.D06.1.454.CMB.1.raw
  modified_base (182)..(190): a, c, t, g, unknown or other
  misc_feature (182)..(190): n is a, c, g, or t
tcagtacacacactcacgaccggtgctcgatttagtgacatctcgcaggttctttgggtttgggggaagaggaagactgacggtccccccaggagttcaggtgctgggcacagcggccctgggctgcctggtcaaggactacttccagtgtgtgtactgagcgggctggcaaggcgcatagnnnnnnnnn

SEQ ID NO: 98303 - DNA, 192 bp, Homo sapiens
  misc_feature: GYAE6OF01CIT7B.33.39.D06.1.454.CMB.1.raw
  modified_base (180)..(192): a, c, t, g, unknown or other
  misc_feature (180)..(192): n is a, c, g, or t
tcagtacacacactcacgaccggtgctcgatttagtgacatctcgcagttctttgggtttgggggaagaggaagactgacggtcccccaggagttcaggtgctgggcacagcggccctgggctgcctggtcaaggactacttccagtgtgtgtactgagcgggctggcaaggcgcatagnnnnnnnnnnnnn

SEQ ID NO: 98304 - DNA, 184 bp, Homo sapiens
  misc_feature: GYAE6OF01DCLRI.33.39.D06.1.454.CMB.1.raw
  modified_base (182)..(184): a, c, t, g, unknown or other
  misc_feature (182)..(184): n is a, c, g, or t
tcagtacacacactcacgaccggtgctcgatttagtgacatctcgcagttctttgggttttgggggaagaggaagactgacggtccccccaggagttcaggtgctgggcacagcggccctgggctgcctggtcaaggactacttccagtgtgtgtactgagcgggctggcaaggcgcatagnnn

SEQ ID NO: 98305 - DNA, 214 bp, Homo sapiens
  misc_feature: GYAE6OF01C8O8W.33.39.D06.1.454.CMB.1.raw
  modified_base (192)..(214): a, c, t, g, unknown or other
  misc_feature (192)..(214): n is a, c, g, or t
tcagtacacacactcacgaccggtgctcgatttagtgacatctcgcagttctttggggtttggggggaagaggaagactggaccggtccccccaggagttcaggtgctgggcacagccggccctgggctgcctgggtacaaggactacttccaggtgtgtgtactggagcgggctggcaagggcgcagtagnnnnnnnnnnnnnnnnnnnnnnn

SEQ ID NO: 98306 - DNA, 189 bp, Homo sapiens
  misc_feature: GYAE6OF02IIEGG.33.39.D06.1.454.CMB.1.raw
  modified_base (179)..(189): a, c, t, g, unknown or other
  misc_feature (179)..(189): n is a, c, g, or t
tcagtacacacactcacgaccggtgctcgatttagtgacatctcgcagttctttgggtttggggaagaggaagactgacggtcccccaggagttcaggtgctgggcacagcggccctgggctgcctggtcaaggactacttccagtgtgtgtactgagcgggctggcaaggcgcatagnnnnnnnnnnn

SEQ ID NO: 98307 - DNA, 207 bp, Homo sapiens
  misc_feature: GYAE6OF02GFWYH.33.39.D06.1.454.CMB.1.raw
  modified_base (183)..(207): a, c, t, g, unknown or other
  misc_feature (183)..(207): n is a, c, g, or t
tcagtacacacactcacgaccggtgctcgatttagtgacatctcgctaggttctttgggtttgggggaagaggaagactgacggtcccccaggacgttcaggtgctgggcgacagcggccctgggctgcctggtcaaggctacttccagtgtgtgtactgagcgggctggcaaggcgcatagnnnnnnnnnnnnnnnnnnnnnnnnn

SEQ ID NO: 98308 - DNA, 184 bp, Homo sapiens
  misc_feature: GYAE6OF02HREIZ.33.39.D06.1.454.CMB.1.raw
  modified_base (180)..(184): a, c, t, g, unknown or other
  misc_feature (180)..(184): n is a, c, g, or t
tcagtacacacactcacgaccggtgctcgatttagtgacatctcgcagttctttgggtttgggggaagaggaagactgacggtcccccaggagttcaggtgctgggcacagcggccctgggctgcctggtcaaggactacttccagtgtgtgtactgagcgggctggcaaggcgcatagnnnnn

SEQ ID NO: 98309 - DNA, 197 bp, Homo sapiens
  misc_feature: GYAE6OF02IELWP.33.39.D06.1.454.CMB.1.raw
  modified_base (182)..(197): a, c, t, g, unknown or other
  misc_feature (182)..(197): n is a, c, g, or t
tcagtacacacactcacgaccggtgctcgatttagtgacatctcgcgagttctttgggtttgggggaagaggaagactgacggtccccccaggagttcaggtgctgggcacagcggccctgggctgcctggtcaaggactacttccagtgtgtgtactgagcgggctggcaaggcgcatagnnnnnnnnnnnnnnnn

SEQ ID NO: 98310 - DNA, 188 bp, Homo sapiens
  misc_feature: GYAE6OF02G4Z9O.33.39.D06.1.454.CMB.1.raw
  modified_base (180)..(188): a, c, t, g, unknown or other
  misc_feature (180)..(188): n is a, c, g, or t
tcagtacacacactcacgaccggtgctcgatttagtgacatctcgcagttctttgggtttgggggaagaggaagactgacggtcccccaggagttcaggtgctgggcacagcggccctgggctgcctggtcaaggactacttccagtgtgtgtactgagcgggctggcaaggcgcatagnnnnnnnnn

SEQ ID NO: 98311 - DNA, 290 bp, Homo sapiens
  misc_feature: GYAE6OF01A152O.17.10.A10.1.454.CMB.1.raw
  modified_base (285)..(290): a, c, t, g, unknown or other
  misc_feature (285)..(290): n is a, c, g, or t
tcagcgtagactagcacgaccggtgctcgatttagcgtcgatctcagggttcctgaccgattctctggctccaagtctggcacgtctgccaccctggcatcaccgcgctccagactgggacgaggccgagtatttctgcgcaacatgggattccagcctgacttctggggtgttcggcagtgggaccaagctgaccgtcctaggtcagcccaaggctgccccctcggtcactctgttcccaccctcctcctagtctacgctgagcgggctggcaaggcgcatagnnnnnn

SEQ ID NO: 98312 - DNA, 290 bp, Homo sapiens
  misc_feature: GYAE6OF01BPEH5.17.10.A10.1.454.CMB.1.raw
  modified_base (286)..(290): a, c, t, g, unknown or other
  misc_feature (286)..(290): n is a, c, g, or t
tcagcgtagactagcacgaccggtgctcgatttagcgtcgatctcagggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctggtcactctgttcccaccctcctcctagtctacgctgagcgggctggcaaggcgcatagnnnnn

SEQ ID NO: 98313 - DNA, 292 bp, Homo sapiens
  misc_feature: GYAE6OF01C0DIZ.17.10.A10.1.454.CMB.1.raw
  modified_base (287)..(292): a, c, t, g, unknown or other
  misc_feature (287)..(292): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgcccctcggtcactctgttcccaccctcctcctagtctacgctgagcgggctggcaaggcgcatagnnnnnn

SEQ ID NO: 98314 - DNA, 291 bp, Homo sapiens
  misc_feature: GYAE6OF01B7FZG.17.10.A10.1.454.CMB.1.raw
  modified_base (287)..(291): a, c, t, g, unknown or other
  misc_feature (287)..(291): n is a, c, g, or t
tcagcgtagactagcacgaccggtgctcgatttagcgtcgatctcagggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctgttcccaccctcctcctagtctacgctgagcgggctggcaaggcgcatagnnnnn

SEQ ID NO: 98315 - DNA, 508 bp, Homo sapiens
  misc_feature: GYAE6OF01BSBUN.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacaccccacgaacacagtctacatgcaactgacgagcctgagagctgacgacacggccgtctattactgtgcgagaatgttttctgtcatcgtactatttgataggctctatggactggacttgtcgggg

SEQ ID NO: 98316 - DNA, 292 bp, Homo sapiens
  misc_feature: GYAE6OF01CYKBW.17.10.A10.1.454.CMB.1.raw
  modified_base (288)..(292): a, c, t, g, unknown or other
  misc_feature (288)..(292): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctgttcccgccctcctcctagtctacgctgagcgggctggcaaggcgcatagnnnnn

SEQ ID NO: 98317 - DNA, 535 bp, Homo sapiens
  misc_feature: GYAE6OF01DJ8C3.17.10.A10.1.454.CMB.1.raw
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacaggcccccgganaagggcttgagtgggtggggtgggtcaggcggntttgacggtaaggcacagtatgcaaccgaagatgaagggcagagtcagattaccacggacaccccagaacacagtctacatgcaaactgacgagcctgagagctgacgacacggcctctattactgtgcgaagtacttgttttctgtctaagtccgttaactaattttggattaggccttctaagtggaccttagggtaccttggtacggggg

SEQ ID NO: 98318 - DNA, 523 bp, Homo sapiens
  misc_feature: GYAE6OF01CWG44.17.10.A10.1.454.CMB.1.raw
  modified_base (286)..(286): a, c, t, g, unknown or other
  misc_feature (286)..(286): n is a, c, g, or t
  modified_base (473)..(473): a, c, t, g, unknown or other
  misc_feature (473)..(473): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacaggcccccgganaagggcttggaggtggggtggggtgggtcaggcggtctttggacggtaaggcacgagtatgcaccgaagatgaagggcagagtcacgataccgacgacacccccagaacacagtcacatgacaactgacgagcctgagagctgacgacgacggccgtactattacgtgtgacgtagtattgttttcngtcatcgtaatatttgattaggcttcgtatggatcggtacttggtcgggg

SEQ ID NO: 98319 - DNA, 296 bp, Homo sapiens
  misc_feature: GYAE6OF01DTY7T.17.10.A10.1.454.CMB.1.raw
  modified_base (290)..(296): a, c, t, g, unknown or other
  misc_feature (290)..(296): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctcgccccctcggtcactctcgttcccaccctcctcctagtctacgctgagcgggctggcaaggcgcatagnnnnnnn

SEQ ID NO: 98320 - DNA, 529 bp, Homo sapiens
  misc_feature: GYAE6OF01ACYW2.17.10.A10.1.454.CMB.1.raw
  modified_base (272)..(272): a, c, t, g, unknown or other
  misc_feature (272)..(272): n is a, c, g, or t
  modified_base (324)..(324): a, c, t, g, unknown or other
  misc_feature (324)..(324): n is a, c, g, or t
  modified_base (474)..(474): a, c, t, g, unknown or other
  misc_feature (474)..(474): n is a, c, g, or t
tcagcgtagactagcacgaccggtgctcgatttagcgtcgatctcaggggacccaaaaaccacacccctccttgggagaatcccctagatcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcgaaccctaanactggtgtcacagtgtcttcacccatcctccgggacagacttaccatgaccacgaactcctccataaacacagcctacatggagttgaggagcctgacatctgacgacacggccgtctattactgtagcgagacgtcccacgagtccggngacgccgtacggcaggccggtcctttgacttcgtggggccaggggcgcccgtcgg

SEQ ID NO: 98321 - DNA, 293 bp, Homo sapiens
  misc_feature: GYAE6OF01C8CSB.17.10.A10.1.454.CMB.1.raw
  modified_base (287)..(293): a, c, t, g, unknown or other
  misc_feature (287)..(293): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctggtcactctgttcccaccctcctcctagtctacgctgagcgggctggcaaggcgcatagnnnnnnn

SEQ ID NO: 98322 - DNA, 509 bp, Homo sapiens
  misc_feature: GYAE6OF01DKVGA.17.10.A10.1.454.CMB.1.raw
  modified_base (287)..(287): a, c, t, g, unknown or other
  misc_feature (287)..(287): n is a, c, g, or t
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtggtcagcggctttgacggtaaggcacagtatgcaccgaagatgaaggcagagtcacgataccacggaccaccccagaacacagtctacatgcaactgacagcctgagagctgacgacgacggccgtctattactgtgcgtagattgtttctgtcatccgtaatatttgataggtctcgtatggacttggcttcgtacgggg

SEQ ID NO: 98323 - DNA, 510 bp, Homo sapiens
  misc_feature: GYAE6OF01CBAR4.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcgagcggctttgacggtaaggcacagtatgcaccgaagatgaagggcagagtcacgattaccacggacaccccacgaacacagtctacatgcaactgacgagcctgagagctgacgacgacggccgtctattactgtgcgagtaatgtttctgtcatcgtactaatttgataggctctatggatggcttgtacgggg

SEQ ID NO: 98324 - DNA, 513 bp, Homo sapiens
  misc_feature: GYAE6OF01B725D.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgagtgggtggggtggtcaggcggcgtttgacggtaaggcacagtatgcacgaagatgaaggcagatcacgattaccacggacaccccacgaacacagtctacatgacaactgacgagcctgagagctgacgacacggcctctattacctgtgcgagaatgtttctgtctatcgtactaatttgattaggcttcgtatggactggtacttgtcgggg

SEQ ID NO: 98325 - DNA, 594 bp, Homo sapiens
  misc_feature: GYAE6OF01DYI9T.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaattatggtatgaattgggtgcgacgacggcccccggagaagggtcttggaggttggggtggggtgggtcgaggcggtctttggacggtaaggcacgagtatcgacaccgaagataggaaggcaggagtcacgattaacccgacggaaccacccccaacgaaccacgacgtacctaacagtacgacaacgtcgaacgacgaccgtgacgagccgtagaacgaccgacggtccgttacttagttacgtggtagcgtaagtatttgtttctgttcctagttaccgtataagtttgacgttacggtcttacgtagtacggtattcggtccgttggtaccgggg

SEQ ID NO: 98326 - DNA, 690 bp, Homo sapiens
  misc_feature: GYAE6OF01DBFBN.17.10.A10.1.454.CMB.1.raw
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
  modified_base (356)..(356): a, c, t, g, unknown or other
  misc_feature (356)..(356): n is a, c, g, or t
tcagcgtagactagcacgaccggtgctcgatttagcgtcgatctcagggggtacccgaaaaaccacacccctccttgggagaatcccctagatcacagctcctccaccatggactggaccgtggagcatccttttcctgggtggcagcaggcacaggtgcccacgcccaggttcagttcggtgcagactgggctgaggtgcagagcctgggcatcagtgactgtctccgtgacgaaggccagtggatactatcttanacaaaatatggtatgaagttgggtcncgacacggccccggagaagggtcttgaggtggggtgggtggtcgaggcggtacgtttggaacggtaggcacgngtagtgacacggtaagagtggaaggcagagtcaacgacttaccaaccggaccaccccgaagtaacacgacgtacctacagtacgactaacgtacgaacgacgtccgtagaacgagaccgtaggaacgtaccgaaccgggttcccgtacgttaacgttacccgtaggtaccgtaacggtaacgttaaacgtttcggtttttaccgtcggttaaccgtacgttaacccggttaaacttaagttttacggtaacgtttacccgggtactttaacccgttaccgggttacggttaacccggtacggggtttaacccgttcggggttaaccccgggggg

SEQ ID NO: 98327 - DNA, 531 bp, Homo sapiens
  misc_feature: GYAE6OF01DF59Q.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaaagggcttgaggtggggtggggtgggtcaggcggctttggacggtaaggcacagtatgcaccgaagatggaagggcagagtcacgattaccacggtaccaccccacgaaccacacgtctaacatgacaactgacgagcctgagagctgacgacacggcctactattacgtgtgcagtaatgttttctgtctatacgtactaatttagattagcttactagtagacgtggtattcgtcggggg

SEQ ID NO: 98328 - DNA, 291 bp, Homo sapiens
  misc_feature: GYAE6OF01CYTR9.17.10.A10.1.454.CMB.1.raw
  modified_base (288)..(291): a, c, t, g, unknown or other
  misc_feature (288)..(291): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctgttcccgccctcctcctagtctacgctgagcgggctggcaaggcgcatagnnnn

SEQ ID NO: 98329 - DNA, 587 bp, Homo sapiens
  misc_feature: GYAE6OF01BNV1N.17.10.A10.1.454.CMB.1.raw
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
  modified_base (496)..(496): a, c, t, g, unknown or other
  misc_feature (496)..(496): n is a, c, g, or t
tcagcgtagactagcacgaccggtgctcgatttagcgtcgatctcagggacccaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagcctggggcatcagtgactgtctcctgcaaggccagtggatatatcttnacaaaatatggtatgtaagttgggtgacgacgacggcccccgganaaggggcttggaggtggggtgggtggtcaggcggctttggacggtaggcagagtatgcacgaagataggaaggcagagtcacgataccgacggacaccccaagacacagtctacatgactaacgtgaacgagcctagacgagctagacgaccgacggtcctatacgttacgtggtacgacggtaagtaagtttcgttttacgnggtttaccagtttacgttaaacgtagttttacgaacgttacgggtccttacgttagtcgggtaacttcgggtacgtttcgggtaccggggg

SEQ ID NO: 98330 - DNA, 293 bp, Homo sapiens
  misc_feature: GYAE6OF01CI99T.17.10.A10.1.454.CMB.1.raw
  modified_base (288)..(293): a, c, t, g, unknown or other
  misc_feature (288)..(293): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctcgccccctggtcactctcgttcccacctcctcctagtctacgctgagcgggctggcaaggcgcatagnnnnnn

SEQ ID NO: 98331 - DNA, 514 bp, Homo sapiens
  misc_feature: GYAE6OF01A3KJC.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaaggcagagtcacgattaccacggacacccccacgaacacagtctacatgcaactgacgagcctgagagctgacgacacggccgtactattactgtgcgagaattgtttctgtcattcgtactatttgataggctacgtataggactggtacttgtcggggg

SEQ ID NO: 98332 - DNA, 525 bp, Homo sapiens
  misc_feature: GYAE6OF01BI0G8.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggccccccggacaaggggcttggaggtggggtgggggtgggtcgaggcgggtcttttggacggtaaggcacagtatgcaccgaagatgaagggcagagtcacgattaccacggacaccccagaacacagtctacatgacaactgaacgagcctgagagctagacgacacggcctctattactgtgacgagtattgtttctgtcatcgtactattgatagcttatagtgatggtacttcggtacgggg

SEQ ID NO: 98333 - DNA, 564 bp, Homo sapiens
  misc_feature: GYAE6OF01A36TG.17.10.A10.1.454.CMB.1.raw
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (494)..(494): a, c, t, g, unknown or other
  misc_feature (494)..(494): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattgggtncgacaggcccccgganaagggcttgaggtggggtggggtgggtcgagcggtcttttggacggtaaggcacgagtatgcaccggaagatgaagggcagagtcacgataccgacggaccaccccacgaacacagtctacatgacaacgtgacgagcctagacgagctacggacgacgacgggcccgttatacgttacgtgttacgcgtagtaattggttttacngttacagttacgttactaagtttagattacggcttacgttaagtcggattggtaccgttcggtacggggg

SEQ ID NO: 98334 - DNA, 652 bp, Homo sapiens
  misc_feature: GYAE6OF01B6U72.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggccagtggatatatcttacaacaaaatatggtatagaagttgggtgcgacgacggcccccggagaagggcttggaggtggggtggggtgggtcgaggcggtcgtttggacggtaaggcacgagtatgcacgaagagtagaaggcagacgtcacgattaccgacggaccaccccgacgaacacacgtctaacatgactaacgtgacgacgccgtagagacgcgtagaacgaccgacggccgttacttacgttaacgttggtacggtaccgtaaggttaacgtttcggtttttacgtacggttacctaagtttaccggttaaaccttaaagtttttacggaagtttaacgggttaccttacggtttaacgttacgggttaaccggtttacgggttaccgtttcgggttaacccggggggg

SEQ ID NO: 98335 - DNA, 580 bp, Homo sapiens
  misc_feature: GYAE6OF01CJKLQ.17.10.A10.1.454.CMB.1.raw
  modified_base (255)..(255): a, c, t, g, unknown or other
  misc_feature (255)..(255): n is a, c, g, or t
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccgacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctctgcaaggccagtggatatatcttcacaaaatntaggtatgaattgggtgcgacaggcccccgganaaggggccttggaggtggggtggggtgggtcaggcggctttggacggtaaggcacgagtatgcacgaagatggaagggcagagtcacgattaccgacggaccacccccaagaaccacagtctacatagcaacgtgaccgagccctagagagcgtagaccgaccgacgggcccgttactattaccgtagtcgacggtaagtattcgttttctaggttcacgttcggttaactaagtttaggagttacgggtcttacgttagtgggtacttgggtacgtttcggtaccgggggg

SEQ ID NO: 98336 - DNA, 537 bp, Homo sapiens
  misc_feature: GYAE6OF01DF08E.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacaggcccccggacaagggcttggaggtggggtggggtgggtcgaggcggctttggacggtaaggcacgagtatgcaccgaagatggaagggcaggagtcacgtattaccgacggaccacccccgagaacacagtactacatcgacaacgtgacgagcctgagagctgacgacgacggcctactattacgtgtgcgtagtattgtttctgtctagtacgtataatttgatagcttctagtgtacgttggtcgttgtacgggg

SEQ ID NO: 98337 - DNA, 693 bp, Homo sapiens
  misc_feature: GYAE6OF01DEV26.17.10.A10.1.454.CMB.1.raw
  modified_base (121)..(121): a, c, t, g, unknown or other
  misc_feature (121)..(121): n is a, c, g, or t
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggancatccttttcctggtggcagcaggcacaggtgcccacgcccaggttcagttggtgcagactggggctgaggtgcagaagcctggggcatcagtgactgtctcctgcaaggccagtggatatatcttcaacaaatatggtatgaattgggtgcgacacggcccccgganaagggtcttagaggtggggtggggtggtcaggtcggtcgtttaggacggtaaggcaacagtatgcacgaagagtggaaggcagagtcacgtataccgacggaccaccccagaaccacgacgtactacatcgacaacgtagaccgagacctaggaagacgtacgtacggaaccgaccgaccgggtcccgttactttaacgtttaaccgtgggttacgaccggtaaggttaacgtttcggtttttttacccgtacggttaccgttaagtttacccgggttaaaacgtttaaagttttttcgggaaacgttttaaccgggggttacccttttaaccggttaaaggtttaccggggttaaccgtttacgggggttaaccctttttcccggggggtaacccgggggggg

SEQ ID NO: 98338 - DNA, 295 bp, Homo sapiens
  misc_feature: GYAE6OF01C5L13.17.10.A10.1.454.CMB.1.raw
  modified_base (288)..(295): a, c, t, g, unknown or other
  misc_feature (288)..(295): n is a, c, g, or t
tcagcgtagactagcacgaccggtgctcgatttagcgtcgatctcagggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctgttccccaccctcctcctagtctacgctgagcgggctggcaaggcgcatagnnnnnnnn

SEQ ID NO: 98339 - DNA, 549 bp, Homo sapiens
  misc_feature: GYAE6OF01C056Z.17.10.A10.1.454.CMB.1.raw
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (394)..(395): a, c, t, g, unknown or other
  misc_feature (394)..(395): n is a, c, g, or t
  modified_base (398)..(399): a, c, t, g, unknown or other
  misc_feature (398)..(399): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (407)..(408): a, c, t, g, unknown or other
  misc_feature (407)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (424)..(425): a, c, t, g, unknown or other
  misc_feature (424)..(425): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (455)..(456): a, c, t, g, unknown or other
  misc_feature (455)..(456): n is a, c, g, or t
  modified_base (460)..(460): a, c, t, g, unknown or other
  misc_feature (460)..(460): n is a, c, g, or t
  modified_base (542)..(542): a, c, t, g, unknown or other
  misc_feature (542)..(542): n is a, c, g, or t
tcagcgtagactagcacgaccggtgctcgatttagcgtcgatctctaggggtttccgtgaccgattctcgtgcctccaagttctcggtcacgtctagccacccgtggccatcaccgcgcttcccaggacctgggacaaggccgagttatttcgtcgacggcaacgagtgggtatttccgagcctgacttctggggttnttccggctagtcggaccacgcctcgaccgtcctaggccacgcccaagcctccgcccctggtctactcgtcgttaccccgcccttcctcctagttcacgtcgtacgacgtccggtntaggtacgaaggtcgacataggcgcngacancaccgagctactatttanacgtttacgaccgtntcgcggaccngacananngcnngngngngnntntntnacanananannagngngngngngngagtgttgttgtatgtnnaganactactactactcgtctcgttcttcgtcgtcgtacgacggtagagtagagacgtacgtacgtacgacgtacgtacgacgacncgtcgtc

SEQ ID NO: 98340 - DNA, 524 bp, Homo sapiens
  misc_feature: GYAE6OF01EGDYS.17.10.A10.1.454.CMB.1.raw
  modified_base (273)..(273): a, c, t, g, unknown or other
  misc_feature (273)..(273): n is a, c, g, or t
  modified_base (341)..(341): a, c, t, g, unknown or other
  misc_feature (341)..(341): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtaatgaattgggtncgacaggcccccggacaagggcttggagtggggtggggtggtcagcggctttgacggtaaggctacgngtatgcacgaagatgaagggcagagtcacgatacacggacaccccagaacacacgtactacatgacaactgaacgagcctagacgagctagacgacgacgccgtactattactgtcgacgagaattgtttactgtctatcgtactaatttggataggcttctatggtactggactgtacgggg

SEQ ID NO: 98341 - DNA, 606 bp, Homo sapiens
  misc_feature: GYAE6OF01DIC98.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagacgtggggctgaggtgcagaagccgtggggcatcagtgactgtctcctgcaaggccagtggatatatcttacacaaaatatggtatgaagttgggtgcgacacggcccccggacgaagggcgttggaggtggggtggggtggtcgaggcggctttggacggtaggcacgagtagtgtacaacggaagacgtgaagggcgagacgtacgacgacttaccgacggaccaacccccgaacgaaccacagtcctaacatagacaacgtcgacgacgctagagagctacgacgacgacggtccgtacttataccgtgtacgcgagtaacgtttgttttcttacggtctaacgtcgttaaaccttaagtttcgtagttaacggcttacgttaggttacgtacgttcggttaacgttcgggttacccggggg

SEQ ID NO: 98342 - DNA, 295 bp, Homo sapiens
  misc_feature: GYAE6OF01EAIP9.17.10.A10.1.454.CMB.1.raw
  modified_base (175)..(175): a, c, t, g, unknown or other
  misc_feature (175)..(175): n is a, c, g, or t
  modified_base (285)..(295): a, c, t, g, unknown or other
  misc_feature (285)..(295): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtnttcggcagtgggaccaagctgaccgtctaggtcagcccaaggctgccccctggtcactctgttcccgcctcctcctagtctacgctgagcgggctggcaaggcgcatagnnnnnnnnnnn

SEQ ID NO: 98343 - DNA, 511 bp, Homo sapiens
  misc_feature: GYAE6OF01AGLHB.17.10.A10.1.454.CMB.1.raw
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactgggggctgaggtgcagaagcctggggcatcagtgactgtctcctgcaaggccagtggatatatcttcacaaaatatggtatgaattgggtgcgacaggcccccggacaagggcttggagtgggtggggtgggtcaggcggctttgacggtaaggcacagtatgcaccgaagatgaagggcagagtcacgattaccacggacacccccacgaacacagtctacatgcaactgacgagcctgagagctgacgacacggcgtactattactgtgcgagtatgttttcngtcatcgtactatttgataggctntatggatggacttgtcgggg

SEQ ID NO: 98344 - DNA, 593 bp, Homo sapiens
  misc_feature: GYAE6OF01AU78I.17.10.A10.1.454.CMB.1.raw
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgaggcccccgganaaggggctttggaggtggggtgggggtgggtcgaggcggtctttggacgggtaaggcacgagtatgcaccgaagagtggaaggcagagtcgacgattaccacggaccaccccacgaacacacgtctacatgacaactgacgacgcctgagacgcgtacgacgacgaccgggccgtactacgttacgtggtacgacgtaagtaattcggttttctggtactacgttaccggtaacttaagttttcggtaatacgggtcttacgttagttcgggtaacgttcgggtaccgtttcggtaccgggggg

SEQ ID NO: 98345 - DNA, 553 bp, Homo sapiens
  misc_feature: GYAE6OF01DUCV1.17.10.A10.1.454.CMB.1.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacaggcccccgganaagggcttgagtggggtggggtgggtcaggcggntttgacggtaaggcacgagtatgcaccgaagatggaagggcagagtacacgattaccacggacaacccccagaacacagtactacatgacaactgacgaagcctgagagcgtagaccgacacggccgtactattacgtgtgcgaagattgttttacngtctatcggttaactaagttttgaattacgggtcttacgttagtacggacttagggtaccttcggtaccggggg

SEQ ID NO: 98346 - DNA, 292 bp, Homo sapiens
  misc_feature: GYAE6OF01CXW8F.17.10.A10.1.454.CMB.1.raw
  modified_base (289)..(292): a, c, t, g, unknown or other
  misc_feature (289)..(292): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtctaggtcagcccaaggctcgccccctcggtcactctcgttcccgccctcctcctagtctacgctgagcgggctggcaaggcgcatagnnnn

SEQ ID NO: 98347 - DNA, 565 bp, Homo sapiens
  misc_feature: GYAE6OF01AR4VC.17.10.A10.1.454.CMB.1.raw
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttggaggtggggtggggtgggtcaggcggctttggacggtaaggcacgagtatgacaccgaagagtagaagggcaggagtcacgacttaccgacggaccacccccaacgaacacgacgtactacgatcgacaacgtgacgagcctagagagctgacgacgacggcctacttagtacgtgtgacgtagtattcgtttctgtactagttacgtacttagtttgagttacggtcttacgtagttacggtacttggtacgttcggtaccggggg

SEQ ID NO: 98348 - DNA, 590 bp, Homo sapiens
  misc_feature: GYAE6OF01AMFFU.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccggacaagggtcttggaggtggggtggggtgggtcgaggcggtcgtttggacggtaaggcacgagtagtgacaccgaagagtaggaaggcagagtcacgattaccgacggaccaccccacgaacacacgtctacagtcgacaactggacgacgcctaggacgacgctacggacgaccgacggccgttactagttacgtgtcgacgagtaacgttgtttacgtgtaccattaccgtacttaagttggtacgttagggaccttacgtacggtacggtaaccgttcgggtacgttcgggtaccggggg

SEQ ID NO: 98349 - DNA, 524 bp, Homo sapiens
  misc_feature: GYAE6OF01D6CM6.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtggggtggggtgggtcagcggctttgacggtaaggcacagtatgcaccgaagatgaagggcagagtcacgattaccacggacacccccacgaacacagtctacatgcaactgacgagccagagagctaggacgacgacggccgtactagttactgtgcgagtaattgttttctgtcagttcgtactaatttgataggctactatggactggtcttcgtacggggg

SEQ ID NO: 98350 - DNA, 546 bp, Homo sapiens
  misc_feature: GYAE6OF01BNOSK.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggaggtggggtggggtggggtcaggcggtctttggacggtaaggcacgagtatgcaccgaagatggaagggcagagtcaacgataccacggacacccccacgaacacacgtcacatgacaactgacgagcctagagacgctgacgaccgacggccgtactattactggtgcgtagtaattgtttctgtcaattcgtacttaatttggattaggtcttcgtagttggacgttgggtaccttggtccggggg

SEQ ID NO: 98351 - DNA, 654 bp, Homo sapiens
  misc_feature: GYAE6OF01CZQT0.17.10.A10.1.454.CMB.1.raw
  modified_base (248)..(248): a, c, t, g, unknown or other
  misc_feature (248)..(248): n is a, c, g, or t
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttnacaaaatatggtatgaaagttgggtagcggacgacggcccccggagaacgggtccttggaggtggggtggggtgggtcgaggcggctttggaccgggtaaggcgaacgtaggtagtcgacgaaccgaagagtaggaagggcaaggagtcgaacgtacttaaccgaaccggaccaacccccgaagtaaccaacgaggtacctaacacgttaggacctaaacgtcgaacggacgccgttagacgtacgccgtacggaaccgaacgacgggtcccgttactagtttacccgtgtaccggacgtaagtaactttgttttcgtaggttcctaattacccggttaattaaagttttgaacgttacgcgttacttacgggtacggtactcgggtaccgttcgggtaccggggg

SEQ ID NO: 98352 - DNA, 672 bp, Homo sapiens
  misc_feature: GYAE6OF01C4Q7V.17.10.A10.1.454.CMB.1.raw
  modified_base (248)..(248): a, c, t, g, unknown or other
  misc_feature (248)..(248): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagagccgtggggcatcagtgactgtctctgcaaggcagtgatatatctanaacaaatatggtatagtaagttgggtgacgacgacggcccccggagaacgggtcgttggagggttgggggtggggtgggtcgagggtcggtcgtttaggaacgggtaaggcacgtagtagtcgacgaaccggaagtagtaggaagggtcaaggacgtacgaacgtacgttaaccgacggaacccaccccgaacggaaccacgtacgtacctaacacgtagaccaacgtacgacggtaacgccgtaggaacgacgtacgtacggaacggaccgtaaccgggtccgtaacgttaaccgtttaccggtggtaccggtacgtaagttacgtttcgttttacgtgttaccgtagttacgttaacgttagtttacgagttacgggtcttacgttagtaggtacgtacggtacggttcgggtaaccggggg

SEQ ID NO: 98353 - DNA, 590 bp, Homo sapiens
  misc_feature: GYAE6OF01CNJ54.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcaacaaaatatggtatagaagttgggtgcgacgacggcccccggagaagggcgttggaggtggggtggggtggtcaggcggtcgtttgacgggtaagcacgagtatgacacgaagataggaagggcaagagtcacgtataacccgacggacccaacccccgaacgaacactagtcctaacatgaccaactacggacgacgcctagagagctgaccgacacgggcctacgtattacgtgtcgtacgtagtaattcgtttcgtgtacctagttacgtaacttaagttttcgaagttacggtcttacgttagttacggtacgttcggtaccgttcggtacggggg

SEQ ID NO: 98354 - DNA, 628 bp, Homo sapiens
  misc_feature: GYAE6OF01BW2OR.17.10.A10.1.454.CMB.1.raw
tcagcgtagactagcacgaccggtgctcgatttagcgtcgatctcagggaccctaaaacctacgtacccggtaccttgggagaatccccgtaggactccacgagtctccgtcaccagtggacctggaccgtcggaggctatcccttttccgttggtaggcagtccaggcacgaggtgcccgacggcccaggttcaggttggtgcagactggggctgaggtgcagaagcctggggcatcagtgactgtctcctgcaaggccagtggatatatcttcaacaaaatatggtatgaagttgggtgcgacgacggcccccggaacgaagggcttggaggtggggtggggtgggtcgaggcgggcttttggacggtaaggcacagtagtgcaccggaagagtaggaagggcgagagtacgacgattaccgacggaaccacccccgaacgaaccacgacgtaccaacatacgaccaactagacgaacgccttaggacgacgctacggacaccgtacggcctagtacttaacgtcgttgacgagacgtccccaggacgtccggtagacgtcccgtacgggcgacggccggttccgtttgtaccgttcggtacggggcccgtggggaccgtccccgg

SEQ ID NO: 98355 - DNA, 533 bp, Homo sapiens
  misc_feature: GYAE6OF01B3MSS.17.10.A10.1.454.CMB.1.raw
  modified_base (292)..(292): a, c, t, g, unknown or other
  misc_feature (292)..(292): n is a, c, g, or t
  modified_base (432)..(432): a, c, t, g, unknown or other
  misc_feature (432)..(432): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtaatgaatttgggtgcgacacggcccccgganaagggcttggaggtgggtgggtgggtcaggcggtctttggacggtaaggcacgagtatgcacgaagatgaggcagagtcacgattacgacggacactccccagaacacagtctacatcgacaactgacgagcctagacgngctaggacgacgaccggccttactacttacgtgtgacgtagtaattcgtttctgtactagtcgtaatatttgattaggcttatagtaggactggcttcggg

SEQ ID NO: 98356 - DNA, 596 bp, Homo sapiens
  misc_feature: GYAE6OF01CJR0K.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcagaagccgtggggcatcagtgactgtctcctgcaaggccagtggatatatcttacaacaaaatatggtatgaagttgggtgcgacacggcccccggaagaagggcttgaggtggggtggggtgggtcgaggcggtcgtttaggacggtaaggcgacagtatcgcaaccggagagtaggaaggctaaggagtcgacgtattaccgacggaccaccccacgaacacagtcacagtacgacaacgtcgacgagccgtagagacgcgtacgaacgacgacggtaccgtactacgttaaccgtgtcgacgtagtagttgtttctagtactgttaccgtacgttagtttacgagttacgtctttacgtaacgttacggtacttcggtacgtttgggtaccggggg

SEQ ID NO: 98357 - DNA, 585 bp, Homo sapiens
  misc_feature: GYAE6OF01EGM3J.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctggaggtgcagaagccgtggggcatcagtgactgtctctgcaggccagtgatatatcttacacaaaatatggtatgtaagttgggtgcgacacgggcccccggacgaaggggctttggaggttgggggttgggggtggggtcaggcgggtcgttttgacgggttaaggcacgagtatgcaccgaagatggaagggcagtagcacgattaccgacggaccaccccacgaacacacgtactacatcgacaactgacgacgccctgagacgcgtagacgacgacggccgttactagttacgtgtgacgaagtatttgttttctgtctagttccgttaacttatttacggagttacggtcttacgttagtaggtacgttcggtacgttcgggtaccggggg

SEQ ID NO: 98358 - DNA, 643 bp, Homo sapiens
  misc_feature: GYAE6OF01DKT6Y.17.10.A10.1.454.CMB.1.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactgggggctgaggtgcagaagcctggggcatcagtgactgtctcctgcaaggccagtggatatatcttacacaaaatatggtatgaattgggtgcgacaggcccccgganaagggcttggacggtggggtggggtgggtcaggcggtcgttttggacgggtaaggcacgacgtatgcaccggaagacgtaggaagggcaggagtacgacgtacgttaacgaccggaccaacccccgaacgaaaccaccgagtacctacgattacgacgtaacgtaggaccgacgcctaggaacggagaccgtaggaaccgacgaaccgggcccgttacgttaactttaccgtggtacggacggtaacgttaacgtttgttttacgttggtcctaacgttaccgtacttaagtttacgtagttacggtcttacgttatacgggtacgttgggtaccgttcggttaccgggggg

SEQ ID NO: 98359 - DNA, 508 bp, Homo sapiens
  misc_feature: GYAE6OF01EIKX7.17.10.A10.1.454.CMB.1.raw
tcagcgtagactagcacgaccggtgctcgatttagcgtcgatctcaggggacccaaaaaccacacccctccttgggagaatcccctagatcacagctcctcactatggactggacctggagcatccttttcctggtggcagcaggcacaggtgcccacgcccaggttcagttggtgcagactggggctgaggtgcagaagcctggggcatcagtgactgtctctgcaaggccagtggatatatcttcacaaaatatggtatgaattgggtgcgacaggcccccggacaagggcttggagtggggtggggtgggtcaggcggctttgacggtaaggcacgagtatgcaccgaagatgaaggcagagtcgacgattacacggacaccccagaacacagtctacatgcaacgtgacgagctgagagctgacgacacggcctatattactgtgcgagaattgtttctgtcatcgtactaatttgatagctctagtcgatggtctgtacgggg

SEQ ID NO: 98360 - DNA, 524 bp, Homo sapiens
  misc_feature: GYAE6OF01AHWXM.17.10.A10.1.454.CMB.1.raw
  modified_base (289)..(289): a, c, t, g, unknown or other
  misc_feature (289)..(289): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggacccaaaaaccacacccctccttgggagaatcccctagatcacagctcatcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacaggcccccgganaagggcttgagtgggtggggtgggtcaggcggctttggacggtaaggcacagtatgcaccgaagatgaagggcagagtcacgattaccacggaccacccccagaaccacagtctacatgacaactgacgagcctgagagctgaccgacacggcctntattacgtgtgcgtagaagttcgtttctgtctagttcgtactaatttgattaggcttactagtaggacttggcttcggg

SEQ ID NO: 98361 - DNA, 607 bp, Homo sapiens
  misc_feature: GYAE6OF01D56OY.17.10.A10.1.454.CMB.1.raw
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
tcagcgtagactagcacgaccggtgctcgatttagcgtcgatctcaggggacccaaaaaccacacccctccttgggagaatcccctagatcacagctcctcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagttcaattgggtgcgacgggcctcgtggacaaggccttgagtggatgggaaggntcgtcctagtcgtgacacacaaactacgcacagaacgtccgaggcagactcaccataaccgnggaacaaattaaacgaacaacagttaactcgtaggacgctagaacagtccctagtactagtctagacggacacgggtccttcgtactttcgtcgtgacgtaggtaagttaattaactaactaactactcgttacctttaccttttacctacccttcccgtttacgtacctttccggtcgggtcctacggtaccggtaacccccgttctacccgttcctccctccgctaccccg

SEQ ID NO: 98362 - DNA, 701 bp, Homo sapiens
  misc_feature: GYAE6OF01DIVBE.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcaggttggtgcagacgtggggctggaggtgcagaagccgtggggcatcagtgactgtctcctgcaaggccagtgatatatcttacaactaaaatatggtaatggtaagttgggtgacgaccgaccggacccccggagtaaggggtctttggagggttgggggtggggtgggtcgaggtcggtctttaggacggtaaggctacgtagtatcgacacgtaagagtaggaaggcaggtacgtacgaacgtacttacccgaaccggacccaacccccgaacgaacactacgtactacgaacgttgaacctaacgtaggaccgaagtcccggtaggaacggacggtaccgtaacggaacccggtacccgaccgggttacccgtttaaccgtttaagttaccggttggtacggtacggtaagtttaacgttttcgttttactacggtttacctaacgtttaccggtaaattaagttttgaaggttacgtcttacgtaggttacggttaccgttgggtacccgttggggtaacccggggg

SEQ ID NO: 98363 - DNA, 525 bp, Homo sapiens
  misc_feature: GYAE6OF01EZITY.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaaggggcttggagtggggtggggtgggtcagcggctttgacggtaaggcacagtatgcaccgaagatgaagggcagagtcacgattaccacggacacccccacgaacacagtcacatgacaactgacgagcctgagagctggacgacacggcctactattactgtgacgagaattgtttctgtcattcgtactaatttgagttaggcttatagtggatcggtacttcggtacggggg

SEQ ID NO: 98364 - DNA, 821 bp, Homo sapiens
  misc_feature: GYAE6OF01E53K3.17.10.A10.1.454.CMB.1.raw
  modified_base (138)..(138): a, c, t, g, unknown or other
  misc_feature (138)..(138): n is a, c, g, or t
  modified_base (255)..(255): a, c, t, g, unknown or other
  misc_feature (255)..(255): n is a, c, g, or t
  modified_base (810)..(810): a, c, t, g, unknown or other
  misc_feature (810)..(810): n is a, c, g, or t
tcagcgtagactagcacgaccggtgctcgatttagcgtcgatctcagggacccaaaaccacaccctcttgggagaatcccctagatcacagcctcctcaccatggactgggacctggagctactttccctttttccgngggtggcaggcgaggcacgaggtcgcccacgcccgtaggttcgaggttgggtgcgaggtacggtggggctggaggtgacgaggaacgccgtgggctagtcgagttgactcgtcctcnggacgaacggccgtaggtgtaacttacttacttacgtaaacaaacgtaaagttaggttaggttaagtaggttaacggttcgggaccggaccggaaccggtaccccggggacccgggtaaggtacggggttcgggttaggggttagggggttcggggggttcggggtacgggtacggtacgggttaccgggtttacggtttaacgggaacggacgtaccgtaaggtaacggtagacggaaacggaacggaaaggtacggaacgggaacgggtaccgtaacggtacccgtaaacccgtaaccgtaaaccccgtaacccggaaccccggaaacccctaaccccgaacgtacaccggtaaacttccgaagtccgttaacgaacggtacgtacgggacctacggagtacggacgcggtacccgacggaacgtcccggtatccgttagtacggtcgagttacgtaagttacttttcgttacttaggcttaaacgagttttagtcttaaggtccgtaagttcgtaccgtttggacgggttcggtacccggtggttcccgggngggtaaccggg

SEQ ID NO: 98365 - DNA, 526 bp, Homo sapiens
  misc_feature: GYAE6OF01BAUJ2.17.10.A10.1.454.CMB.1.raw
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (509)..(509): a, c, t, g, unknown or other
  misc_feature (509)..(509): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattgggtgcgacaggcccccggaanaagggcttgagtggggtggggtggtcaggcggctttggacggttaaggcacgagtatgacaccgaagatgaagggcagagtcacgattaccgacggaccaacccccgagaacacagtcctacatcgacaactgaccgagtcctgagacgctaggaccgacgaccggccgtctaattcgtgtcgcgagtaattgtttcagtctatcgtatattgatggctntatgatggcttgtcggg

SEQ ID NO: 98366 - DNA, 630 bp, Homo sapiens
  misc_feature: GYAE6OF01CGLPQ.17.10.A10.1.454.CMB.1.raw
  modified_base (249)..(249): a, c, t, g, unknown or other
  misc_feature (249)..(249): n is a, c, g, or t
  modified_base (346)..(346): a, c, t, g, unknown or other
  misc_feature (346)..(346): n is a, c, g, or t
  modified_base (379)..(379): a, c, t, g, unknown or other
  misc_feature (379)..(379): n is a, c, g, or t
  modified_base (528)..(528): a, c, t, g, unknown or other
  misc_feature (528)..(528): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttnacaaaatataggtatagaagttgggtgcgacacgggcccccggagaagggctttgaggtggggtggggtgggtcgaggcggctttgacgggtaaggnacgagtagtgacaaccgaagatggaagggcagngtacgacgacttaccacggaccacccccacgaacacgagtcctacatgacaacgtgaacgacgacccttggaacgagccgtacgacgaccgaaccggccgttactactttaccgtgttacggacgaacggtaagtttcggtttttaccnggttaccgtacgttacgtaacttaaacgttttaggaaacgtttacggtaccttacgttaacgtagggttaaccgttgggtaccgtttccgggtaccgggggg

SEQ ID NO: 98367 - DNA, 291 bp, Homo sapiens
  misc_feature: GYAE6OF01CGN07.17.10.A10.1.454.CMB.1.raw
  modified_base (289)..(291): a, c, t, g, unknown or other
  misc_feature (289)..(291): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctcgttcccaccctcctcctagtctacgctgagcgggctggcaaggcgcatagnnn

SEQ ID NO: 98368 - DNA, 563 bp, Homo sapiens
  misc_feature: GYAE6OF01DWMR1.17.10.A10.1.454.CMB.1.raw
  modified_base (289)..(289): a, c, t, g, unknown or other
  misc_feature (289)..(289): n is a, c, g, or t
  modified_base (408)..(408): a, c, t, g, unknown or other
  misc_feature (408)..(408): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttgaggtggggtggggtgggtcgagcggctttgacggtaaggcacagtatgcaaccgaagatgaagggcagagtcacgataccacggaccaccccacgaacacagtacacatnacaactagacgagccctgagagcgtgaccgacgacggccgtactattactgtgcgagtattgttttctaggtcagttacgtaacttaagtttcgtaagttacgggtcctacgtttaacgtacggtacttcgggtaccgtttcgggtaccgggggg

SEQ ID NO: 98369 - DNA, 596 bp, Homo sapiens
  misc_feature: GYAE6OF01DCMR5.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaatttgggtgcgacaggcccccgganaagggctttggagtggggtggggtggtcgaggcggcttttgacggtaaggcacgagtatgcaccgaagatgaagggcagagtacacgattaccgacggaccacccccgagaacacacgtactacatgacaactgaccgagccctaggagagcctaggaaccgaccgacgggcccttacttaacttacgtgtcgacgaagtccgtaccccaaggtacgtcccgggtagacggcccttaacgggctaacgggcccggttccttttagggacccttttcgggcggggtccagggggtccctaccccggg

SEQ ID NO: 98370 - DNA, 682 bp, Homo sapiens
  misc_feature: GYAE6OF01AM8B5.17.10.A10.1.454.CMB.1.raw
  modified_base (606)..(606): a, c, t, g, unknown or other
  misc_feature (606)..(606): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcaggttggtgcagacgtgggctggaggtgcagagccgtggggcatcagtgactgtctcctgcaaggccagtgatatatctacaactaaatagtggtataggtaagttgggtgacgacgaccgggcccccggaagaacggggtcgttagggaggggttgggggttcgggggttacgggtcggacgggtcgggttacggtttagggaacgggttaacggactacggtaagtacgtcggaccgaaccggaaggagtacggaagggcaaggtacgtacgaccgtacgtaaccggaccggaccccaaccccgaagaaccacgtacgtacctacacgtacgaaccaggtacgaaccggacgtccgtaggaacgtcggtaccgacggaaccgaccggtaccggtccttaacttcgttacgtggacgtagtagttacttggtttcncgtactacggttacttacgttagttagacgttcggtcttagtaggttacggtagtcggttcgtcgggtaaccgggg

SEQ ID NO: 98371 - DNA, 617 bp, Homo sapiens
  misc_feature: GYAE6OF01C9BL9.17.10.A10.1.454.CMB.1.raw
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaccacacccctccttgggagaatcccctagatcacagctcctcaccatggactggacctggagcattcctttttcctggtggcagcaggcacaggtcgcccaccgcccgaggttcagttggtgcagacgtggggcgtggaggtgcaggaacgccgtggggcatcgagtgactgtctcctgacaaggccagtgatatatctanaactaaatatgtatagtagttggtgcgacgaccggacccggacgaaggtcgtgtaggtgggtgggtgggtcgaggtcggtcgttaggtaccccccggtaaggacgacgagtagtgacgacgaagagtaggaaggacgagagtacgacgtacgtaaccgaccgaacccgaaccccgaaccgaaccgaacgacgtactacactacgacaacgtacgacgacgcgtagacgacgacgacgacgacgacgtaccgtacttacgttacgtgtgacgtagtagttcgttctagtctagtacgttacgttaagttagtagttacgtcgttacgttacgtacgtagtcgttcgttcggtaccggg

SEQ ID NO: 98372 - DNA, 720 bp, Homo sapiens
  misc_feature: GYAE6OF01BOH30.17.10.A10.1.454.CMB.1.raw
  modified_base (536)..(536): a, c, t, g, unknown or other
  misc_feature (536)..(536): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagccgtggggcagtcagtgactgtctcctgcaaggccagtggatatatcttacaactaaaatagtaggtataggaagtttggggtgccggacgaccggaccccccggaagtaacggggtcttgggaggttgggggtgggggtgggtccgaggtcgggtccgttttaggaaccgggttaagggcctaacgaggttatacggaccgaaccggaaagagtgggaaacggggcaaggacggttaccgaaccggttaacgttaacccgaacccggggaacccctaccccccgaacgaaccgaccgtaacggttacctaacgatacgacaaccgtgaaacgngacctaggacgaggcctaggaaccgtaccgaccgggtccgttacttaacgtttaccgtggtacgacggttaagtacgtttttcggtttcttggtaccgtagtttaccgtaacgttaagtttacgtaacgtacgggtcttacgttacggtacgttacggttggtacccgtttgggtacccggggg

SEQ ID NO: 98373 - DNA, 652 bp, Homo sapiens
  misc_feature: GYAE6OF01DH0OX.17.10.A10.1.454.CMB.1.raw
  modified_base (468)..(468): a, c, t, g, unknown or other
  misc_feature (468)..(468): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctcctgcaaggcagtggatatatcttacaacaaaatgtggtatggtaatttgggtgacgacgacgggacccccggagaaggggtcttaggaggtgggggtggggtgggtcgagggtcggtacgtttgggaacgggtaagggcaacgagttagtcggacaaccggaagagtaggaaggggcaggtacgtacgacgtaacgttacccgaacggacccaacccccgaagaaccaacgacgtacctanacgtacgacgtaacgtggaacgacgccgtaggacgacgcgtacgaaccgacgaccgggtccttaccgtattacgtggtacgacgtaagttacgttcgtttactgtacgtattacgtaacgttaagtttggagttacggtcttacgttaaggttcgtacgttcggtaccgttcggggtaccgggg

SEQ ID NO: 98374 - DNA, 618 bp, Homo sapiens
  misc_feature: GYAE6OF01CETW6.17.10.A10.1.454.CMB.1.raw
  modified_base (281)..(281): a, c, t, g, unknown or other
  misc_feature (281)..(281): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctgggggcatcagtgactgtctcctgcaaggccagtggatatatcttacaacaaaatatggtatagaagttgggtgcganacggccccggagaagggtcttggaggtggggtggggtgggtcgaggcggtcgtttggacggtaaggcacgagtatgcaacgaagagtaggagggcaggagtcgacgtattaaccgacggaccacccccagaaccacactctacagtcgacactcgacgacgcctaggacgacgcgtagaccggaccgaccgggtccgttacttaagttaccgttggttacggacggtaagtaagtttcgtttttacgtacgttacctagttacccggttaacttaagttttacggagttacggtcttacgtagtacggtacgttcggtacgtttcggtaccgggggg

SEQ ID NO: 98375 - DNA, 613 bp, Homo sapiens
  misc_feature: GYAE6OF01DPLQH.17.10.A10.1.454.CMB.1.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttanaacaaaatatggtatgaattgggtgcgacgacggcccccggagaagggcttggaggtggggtgggggtgggtcgaggtcggtcgtttaggacgggtaaggcacgagtatgcaacgaagataggaagggcagagtcgacgataccgacgaccaaccccagaacacagtactacatgacaactgacgacgcctggagacgctaggaccgacgaccggaccgttcttaatttaccgtggtacggacgtaaggttacgtttcggtttttcctcggttacctagtttaccgttaaacttaagttttcggaagttacgggtcttacgttagttacgggtacgtttacggtaccgtttcggtacccggggg

SEQ ID NO: 98376 - DNA, 542 bp, Homo sapiens
  misc_feature: GYAE6OF01AQKMU.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacacggcccccgganaaggggctttggaggtggggtggggtgggtcaggcggctttggacggtaaggcacagtatgcaccgaagatggaagggcagagtcgacgacttaccgacggaccaccccgaacgaacacagtctacatgacaactgacgacgcctgagagctgacgacacggccgtactattacgtgtgacgagtaacttgttttctgtctatcgtactaatttgagtacgtcttctatggtatcggtcgttcggtcggggg

SEQ ID NO: 98377 - DNA, 570 bp, Homo sapiens
  misc_feature: GYAE6OF01B06P7.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaaattgggtgcgacaggccccccggacgaaaggggcttggaggtggggtgggggttagggtcgaggcggcgtttgacgggttaaggcacagtatgcacgaagactgaagggcagagtcagattaccgacgacaccccacgaacacgagtctacatgacaactgacgagccgtgagacgctagacgacgacggccgtactacgttactcgtagcgtaagtagttgttttctgtctaagttccgttactaatttggtaatacggtcttacgttaacgttggaccttggtaccgttcgtaacccggggg

SEQ ID NO: 98378 - DNA, 757 bp, Homo sapiens
  misc_feature: GYAE6OF01EOPKF.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcaggttggtgcagacgtggggctgaggtgcagaagccgtggggcatcagtgactgtctctgcaaggccagtggatatatcttacaacaaaatataggttataggtaagttgggtgacgacgacgggcccccggaacgaagggcgttggagggttgggggtgggggtgggtcgaggcgggtctttaggacgggtaaggccaagtagtagtgacaaccggaaggacgtaggaaggggacaaggtaacgtccgaacggtaacgtttaaccccgaaccgggtaaaccccaaccccccggaacgtaaacccgaacccgtaacggttaaccctaaccgaacgttacgaaccgtaaaccgttacggaaccggaacgtacccgttaaggacggtaacgccgtacggaaccggaccgaccgggtcccgttacttaacgttacgtcggtcgacggtaggacccgttacccgacgtaccggttcccgggtagacccgggtacccgtacccgggacgacccgggtaccggtttaccccgtttacgggtacccgttttccggggccgggggtaacccggtacggggtcccggtaccccgggg

SEQ ID NO: 98379 - DNA, 608 bp, Homo sapiens
  misc_feature: GYAE6OF01BPX2Y.17.10.A10.1.454.CMB.1.raw
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcgagactggggctgaggtgcgagaagccgtgggcatcagtgactgtctctgcaaggccagtggatatatcttacacaaaatatggtatagtaagttgggtagacgacacggtcccccggagaagggcttggacggtggggtgggtgggtcgaggcggtcgttgacgggtaaggcgacgagtagtgacgaccggaagagtacggaaggcaaggagtacgacgtattaccacggaccaccccgaacgaacacgagacctacgatcgacaacgtgaacgacgccgtagagagctacggaaccgaccgacggcccgttacttagttacgtggtgacgtaagttagttcgtttcgtgtactaacgttacgttaactaagtttaggaagttacggtacttacgttagacgggtacttgggtcgttcgggtaaccggggg

SEQ ID NO: 98380 - DNA, 545 bp, Homo sapiens
  misc_feature: GYAE6OF01B8W8M.17.10.A10.1.454.CMB.1.raw
  modified_base (370)..(370): a, c, t, g, unknown or other
  misc_feature (370)..(370): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacgacggcccccggacgaagggcttggaggtggggtggggtgggtcgagcggtctttggacggtaggcacagtatgcacgaagatggaaggcagngtcacgataccacggaccaccccaacgaaccacacgtctacatacgacaacgtgacgagccgtagacgagcgtacgacgaccgacggccgtactagttactgtcgacgaagtattgttttctgtcatacgtactaagtttgagtagtctcttagtggtatggtgtcggtacgggg

SEQ ID NO: 98381 - DNA, 628 bp, Homo sapiens
  misc_feature: GYAE6OF01B3GF4.17.10.A10.1.454.CMB.1.raw
  modified_base (211)..(211): a, c, t, g, unknown or other
  misc_feature (211)..(211): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (457)..(457): a, c, t, g, unknown or other
  misc_feature (457)..(457): n is a, c, g, or t
  modified_base (584)..(584): a, c, t, g, unknown or other
  misc_feature (584)..(584): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagcctggggnatcagtgactgtctcctgcgaaggcagtggatatatcttacaanaaaatagtaggtatagaagttgggngacgacgacgggaccccgaagagggtcgttggagggtggggtggggtcggcgaggtcggtcgtttaggacgggtaaggcgacgtagtatcgacgaaccgaagagtaggaaggcagagtcacgtataccgacgaccaacccgacgaacacacgtacacagtacacgaacgtgacgacnccgtagagacgtcgtacgacggaaccgtacggtaccgtattaacgttacggttaggtacggacgtaaggttatttcggttttctacggttctaacgtttcgtaacgttaagttacgtagttacggtnttacggttagtcggtaacgttggtaaccgttcgggtaaccgggg

SEQ ID NO: 98382 - DNA, 659 bp, Homo sapiens
  misc_feature: GYAE6OF01CHETN.17.10.A10.1.454.CMB.1.raw
  modified_base (134)..(134): a, c, t, g, unknown or other
  misc_feature (134)..(134): n is a, c, g, or t
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttccnggtggcagcaggcacaggtgcccacgcccaggttcagttggtgcagacgtggggctggaggtgcaggaagccgtggggcatcgagtgactgtctcctgcgaaggccagtgatatatcttanaacaaaattagtaggtatagtaagttacgggtagacgacgacgggacccccggaagaagggtcgttaggagggttgggggtggggtacgggtcgaggtcgtcgtttaggaacgggtaggcacgagtagtcgacgaaccgaaggagtaggaaggacgaaggtacgtacgaacgtaacgttaaacccgaaccggtaacccaaccccgaacgaacaaccgagtacctaacgatcgaactaacgtagacgacgcgtagacgagtactacggaaccgaccgtacggccgttacgtaacgttaccgtggttacgacgttaagtacttttgggtttctaggttacagtttaccgtaattattacggtagttacgtcttatacgttagtaccgttagtcgttggtaccgggg

SEQ ID NO: 98383 - DNA, 653 bp, Homo sapiens
  misc_feature: GYAE6OF01DRDEH.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctcctgcaaggccaggtggatatatcttacaacaaaatatggtatgaagttgggtgcgacgacggcccccggagaagggcttggaggtggggtggggtgggtcgaggcggtcgttttaggacggttaaggcaacgagtagtcgcaacgaagagtggaagggcaggagtacgacgtacttaccgaccggaccaaccccgacgaacacacgtactacatgacaacgtgacgagcctgagagctaggaccacgacgggtccttacgttaactttacgtcggtagaccgggaacgtacccggtacccgaaccggtacgtcccgggaggtacccgtcccggttaacggggccgtacgggacccgggtttaccgttttacggaacccggttttccgggtacggggggacccctaagggggtacccggttcccccggg

SEQ ID NO: 98384 - DNA, 733 bp, Homo sapiens
  misc_feature: GYAE6OF01BWGG9.17.10.A10.1.454.CMB.1.raw
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcctcgagtgaaggtctcctgcaaggcttcgtggattcacgtttacctctatagtatcaactgggtncgccaggccnctggaccaacgacctgagtggatgggatgggaccgaaaccctaacgacgttgggtagtccacgtagttcgttccttaccaccctacgtcccgtaccgggactacgtaccttaccaagtcgaacccaaccgtaaccttccctaccgaaacttaaaaccgaccaacggtacccttaacgtagtaggggtacgtttagggaacgggtacgtacccgtagaacctattcccgtaggaacccgaaccgtacccgggtccgttacctttagttaaccgttggtacggtaccggtaaggtaccgtaccccgacggtacgttcccgggtaggacccggtcccgttaaccgggccgtaaccggtcccgggtttcccgttttacgggtacccgttttcccggggtacggggggtacccctaacggggggtcccgtccccgggttcgggttaacccccgg

SEQ ID NO: 98385 - DNA, 661 bp, Homo sapiens
  misc_feature: GYAE6OF01C3C5D.17.10.A10.1.454.CMB.1.raw
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
tcagcgtagactagcacgaccggtgctcgatttagcgtcgatctcaggggacccaaaaaccacacccctccttgggagaatcccctagatcacagctcctcacatggactggacctggagcattccttttcctggtggcagcaggcacaggtcgcccacgcccaggttcagttggtgcagacgtggggctggaggtgcagaagccgtggggcagtcagtgactgtctctgcaaggcagtggatatatcttacaacaaaatatggtatagaactttgggtgacgaccgacgggccccccggaagaacggggtcgtttggaacgggttgggggtgggggttcggggtacgacggtcgggtcgtttaggacgggttaagggcacgaggtagtcgacgtaccgaaggtagtaggaagggcagacgtacgacgtactaccgacgaccacccgacgacgacagtacanacgtnactaacngacgtacgcgtaggagtacgcgtacgaacggaccgacgggcccgttagttaacgttacgttacggtcgaccgtaaggtaacgttttcggtttacttcgggttactagtttaccggtaacttaagtttacggtaagttcggacgttacgtagtacggtacgttggtaccggtttcggtaaccgggggg

SEQ ID NO: 98386 - DNA, 624 bp, Homo sapiens
  misc_feature: GYAE6OF01C5CC2.17.10.A10.1.454.CMB.1.raw
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagccgtggggcatcagtgactgtctcctgcaaggccagtggatatatcttacaacaaaattatggtaatgtaagttgggtgcgacacggcccccggagaagggtcttggaggttgggggtggggtgggtcgaggtcggtcgttttaggacgggtaaggcacgagtatgcaccgaaganaggaagggcagagtacacgtataccgacgaccaccccgagaacacatactacgatgacaacgtgacgacgccgtagagagcgtacgacgacgcggtccgttactacgtttacgtggttacggacgtaagttacgtttggtttttactgttactacgttaccgttaacgttaagtttggtaaacggttaggtcctttacgttaagttcgggttacgttacgggtaccgttttcggggtaccgggggg

SEQ ID NO: 98387 - DNA, 779 bp, Homo sapiens
  misc_feature: GYAE6OF01AB46R.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaatttgggtgcgacgacggcccccgganaacggggcttggaggtggggtggggtgggtcaggcggctttggacggttaaggctacgaggtagtcgacgtaccggaaagtgtagggaaggggtcaaggtacggttccaaccgggtaactttaacccggacccgggaacccaaccccccgaagaaccaacgacggttacctaaccaagttcggacctaaacgtacgggacgtaccgtacccgtagggaacgtacgaccgttaggaacccgtaaccggacccgggtaccccgtttacttaaccgtttaccgttaggttaccgggaccggtaaacgggttaaacttttccgggttttttacaccggtttacccgtaagtttaccccgggtttaaacttaaaccgggtttttaaggtacccggttaaggggttacccctttaccgggtttaaacggtttacggggaaaccccgtttttcggggtaaaccccgtttttcggggttaaacccccgggggggggg

SEQ ID NO: 98388 - DNA, 285 bp, Homo sapiens
  misc_feature: GYAE6OF01DZBEZ.17.10.A10.1.454.CMB.1.raw
  modified_base (277)..(277): a, c, t, g, unknown or other
  misc_feature (277)..(277): n is a, c, g, or t
  modified_base (279)..(285): a, c, t, g, unknown or other
  misc_feature (279)..(285): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttcgtggggtgttcggcagtggaccaagctgaccgtctaggtcagcccaggctcgcccctcgtcactctcgtcccaccctcctctagtctacgctgagcggctggcaggcgnannnnnnn

SEQ ID NO: 98389 - DNA, 640 bp, Homo sapiens
  misc_feature: GYAE6OF01C4987.17.10.A10.1.454.CMB.1.raw
  modified_base (559)..(559): a, c, t, g, unknown or other
  misc_feature (559)..(559): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagagcctggggcatcagtgactgtctcctgcaaggccagtggatatatcttcaacaaaatatggtaatgtaagttgggtgaccgacgacgggccccccggaagaagggtctttggaaggtggggtggggtgggtcgaggtcggtacgttttggaacgggtaaggcacgtaggtactggacgaacgaagaagtcgaagggaccgaggtacgtacgacgtacgttaaccgaacggaacccacccccgaacgaaccaacgtacgtactacatacgacaacgtacgacgacgtacctaggacgagcgtacgacgaccgacggtaccgttagtactttacgtgtagacgtaagttaattggttttacncgttactagttaccgttaaattagtttgtaacgttagtccttagttaacgtgggtacttggtaccgtttcggtaccggggg

SEQ ID NO: 98390 - DNA, 618 bp, Homo sapiens
  misc_feature: GYAE6OF01BEC7R.17.10.A10.1.454.CMB.1.raw
  modified_base (286)..(286): a, c, t, g, unknown or other
  misc_feature (286)..(286): n is a, c, g, or t
  modified_base (459)..(459): a, c, t, g, unknown or other
  misc_feature (459)..(459): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgtagagcctggggcatcagtgactgtctcctgcaaggccagtgatatatctcaacaaatatggtatgaattgggtgcgacaggcccccgganaagggcttggaggtggggtggggtggtcgaggcggtctttggacggtaaggcacgagtatgcaccgaagataggaaggcgagagtcaacgtactaccgacggaccaaccccacgaacacacgtctacacgtcgactaactgacgacgccgtagaacgagacgtggaccgaacncccgggtacgttaccttaattaaccgttggtacggtacgaacggttaagtttcgtttttaccgttgttacgtacgttacggtttaactaaggttttagaagttacggtcttacgttagtcgggtactacgggttactttccgggtcggggtaacccggg

SEQ ID NO: 98391 - DNA, 546 bp, Homo sapiens
  misc_feature: GYAE6OF01EZLRZ.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttcacaaaatatggtatgaattgggtgcgacacggcccccggacaagggcttggaggtggggtggggtgggtcgaggcggctttggacggtaaggcacgagtatgcaccgaagagtgaagggcagagcacgattaccgacgaccaccccacgaacacagtacacatgacaactgaccgagcctgagagctgacgacgacggccgttactacgttagtgttgacgtagaatttgtttctgtacgattcgtactaattttcgattaggcttacgtagtaggtatcggtacgttcggtacggggg

SEQ ID NO: 98392 - DNA, 544 bp, Homo sapiens
  misc_feature: GYAE6OF01CH5EV.17.10.A10.1.454.CMB.1.raw
  modified_base (250)..(250): a, c, t, g, unknown or other
  misc_feature (250)..(250): n is a, c, g, or t
  modified_base (377)..(377): a, c, t, g, unknown or other
  misc_feature (377)..(377): n is a, c, g, or t
  modified_base (481)..(481): a, c, t, g, unknown or other
  misc_feature (481)..(481): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaaggccagtggatatatcttnacaaaatatggtatgaagttgggtgcgacaggcccccggacaagggcttggaggtggggtgggggtgggtcgaggcggcgtttggacgggtaaggcacgagtatgcaccgaagatgaaggcagagtnacgattaccgacgacaccccagaaccacagtctacatagcaacgtgacgagctagagagctgacgacacggccgtactacgttactgtagcgtagattgttttntgtcagttcgtaacttagtttgagtacggtcttgtactggtactcggtacttcggtaccgggg

SEQ ID NO: 98393 - DNA, 296 bp, Homo sapiens
  misc_feature: GYAE6OF01CHBM3.17.10.A10.1.454.CMB.1.raw
  modified_base (140)..(140): a, c, t, g, unknown or other
  misc_feature (140)..(140): n is a, c, g, or t
  modified_base (288)..(296): a, c, t, g, unknown or other
  misc_feature (288)..(296): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttcngcgcaacatgggattccagcctgacttctggggtgttcggcagtgggaccaagctgaccgtcctaggtcagccctaaggctcgccccctggtcactctcgttcccgcctcctctagtctacgctgagcgggctggacaaggcgcatgnnnnnnnnn

SEQ ID NO: 98394 - DNA, 919 bp, Homo sapiens
  misc_feature: GYAE6OF01A3X54.17.10.A10.1.454.CMB.1.raw
tcagcgtagactagcacgaccggtgctcgatttagcgtcgatctctagggggacccaaaaccgacaccccgtccttccgggacgaagttccccctaggattcacagtcgtcctcaccatggactggaccctggagcaatccttttcctggtggcgaggtcgaggcacaggttggttcccctacgtcccaggtttacttaaggtttgggttcgcgtaggtacgtgggggctgagggtgtcgaggaagtccgtggggggcattcgagtgacgtgggttcctcgtgccaacggccagtggatatactcttcgactaaaactacttggtatagtaattgggtacgtcgacgacgggaccccccggacggaaccggggccctttagggacggttcggggggtaggggggttacgggggtactaaggggtaccgggttacgttttgggaacccgggttaaagggtaccgtaacgtaaggtaagttacggaccgtaaacccggaaaagtaacgtaagggtaaagggtacctaaaggtaacggttacccgaaaaccggttaacgtttaaacccggtaaaccgggggaaaccccggaacccccccgtaaacgggtaaaccctaacccgaaaccgtttacccgtaacctaaccggtacgggtaaaccctaaaccgtttacggaaaacccggtaacggtaccccgtttaggaaacgttaacggtacccgtttaacgggaaacccggaccggtaacccggggtccccggtttaaccgttaacggtttaaccggtacggtacggtacggtaacggtaacgtttcgggttttcctaggtttacctaagtttacccggttaagtaaggtttaggaacgttaggaccgtttacgtagttacgggtacgttgggtacccggttcggtaccgggggg

SEQ ID NO: 98395 - DNA, 593 bp, Homo sapiens
  misc_feature: GYAE6OF01DVJ71.17.10.A10.1.454.CMB.1.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgtaattgggtgcgacacggcccccgganaacgggcttggaggtggggtggggtgggtcaggtcggcgtttggacggtaaggcacgagtatgcaccgaagatggaaggcagagtcgacgacttaccgacggaccaccccgacgaacacagtacctacatgacaacgtgaaccgacgccgtggacgacgcgtagaccgaaccgacgggcccttatacttaccgtgttacgacgtaagtatttgttttactgtccgtagtacgttaacttaagttttcggaagttacggtcttacgttagtacggtagttcgggtccgttcggtaccgggggg

SEQ ID NO: 98396 - DNA, 693 bp, Homo sapiens
  misc_feature: GYAE6OF01DZ647.17.10.A10.1.454.CMB.1.raw
  modified_base (276)..(276): a, c, t, g, unknown or other
  misc_feature (276)..(276): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaagtttgggngcgacacggccccggagaagggtcttggaggtgggtggggtggtcaggcggtcgtttgacggtaggcagagtatgacacgaagagtaggaagggtcaagacgtacgaacgtacgttacccgaacggtacccaacccccgaacgaaccacgtaacgtacctaacgagttacgaaccaacgtgaaccgacgtccgtagaagtacgaccgtaggaaccgaaccgaccggtccgttaacgttaacgtttacgtacggtacgacggtaacgttaacgttttcgttttaccgtacggttaccttaagttacccggttaaacgttaagttttacggtaacggttaccggttactttaaccggtttaacggttacgggttaacgtttaccggggttaccgtttccggggttaaaccccggggggg

SEQ ID NO: 98397 - DNA, 552 bp, Homo sapiens
  misc_feature: GYAE6OF01A3361.17.10.A10.1.454.CMB.1.raw
  modified_base (289)..(289): a, c, t, g, unknown or other
  misc_feature (289)..(289): n is a, c, g, or t
  modified_base (494)..(494): a, c, t, g, unknown or other
  misc_feature (494)..(494): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtgggtcaggcggctttgacggtaaggcacagtatgcaccgaagatgaagggcaggagtcacgtattaccgacggaccacccccgacgaacacgagtctaacgatacgacaacgtgaacgagccctaggagagctagaccgacacgggccgtactagttacgtggtcgcgaagtaagttgttttcngttcagttcgtactaatttcgatggcttcgtagtggactggtacgttcggtaccgggg

SEQ ID NO: 98398 - DNA, 614 bp, Homo sapiens
  misc_feature: GYAE6OF01CJD7P.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatagaagttgggtgcgacacggcccccggacaagggtcttggaggtggggtggggtgggtcgaggccgggtcgtttcggacggtaaggcgacgaggtatgcaaccggaagagtaggaagggcaaggacgtacgacgaacgttacccgaccggacccaaccccccgaacgaaccacgagtacctaacactcgacaacgtgacgacgtcctgacgagcctaggaccgaccgacggcccttacgttacgttaccgtggtacggcgtaagtatttgttttctgtactagttagttacctaattttcggagttacggcttacgttagttcggagttcggtcgttccgggtaccggggg

SEQ ID NO: 98399 - DNA, 640 bp, Homo sapiens
  misc_feature: GYAE6OF01BMNUQ.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgtaattgggtgcgacgacggcccccggagaagggcttggaggtgggtggggtgggtcgaggcggtcgtttgacgggtaaggcacgagtatgacacgaagagtgaagggcagagtcgacgtacttaaccgacggaccacccccgaagaacacgagtactacatgacaagtcgacgacgcctgagagctagacgacgaccggtccgtacttaacttacgtggtacgaccggtaagtaacgtttcggttttacttacggttacctaagtttaccgggttaaacttaaaggttttcggtaaacgttacggggtacctttacggtttaacgttacggggtaaccgtttcggggttaacccgtttcggggtaacccggggggg

SEQ ID NO: 98400 - DNA, 689 bp, Homo sapiens
  misc_feature: GYAE6OF01BHQ3O.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcaggttggtgcagacgtggggctggaggtgcaggaagccgtggggcatcagtgactgtctcctgcaaggccagtggatagtactcttacaactaaaatatggtatgtaagttgggtgcgacgacgggacccccggagaagggtcttggaggtggggtggggtgggtcgaggcgggtcgtttggaacgggtaaggcaacgtagtagtcgacgtacggaaagtacgtaggaagggcaaggagtacgacgtaacttaccgaacggtacccaacccccgaagaaccaacgtacgtacctaacgtacgtacgtaacgaacgtcgaaaccggagtacccgtaggaacgacggccgttacggaaccggaaccggtacccgggtaccgttacgttaacgttacgtacggttcgacggttaagtacggtttacgtttcgttacgtactaagttacgtaacgttaagtttacggtaagttacggtacttacgttacgtacggtacgttcgggttacgttccggtacggggg

SEQ ID NO: 98401 - DNA, 650 bp, Homo sapiens
  misc_feature: GYAE6OF01C7COL.17.10.A10.1.454.CMB.1.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttanaacaaatatggtatgaattgggtgcgacgacggcccccggagaagggtcttggaggtggggtggggtgggtcgaggcggtcgtttggacgggtaaggcacgagtatgcaaccgaagagtaggacgggcaggagtacgacgtattaccgacggacccaccccgacgaaccacgacgtactacacttgactaacgtggaccgagcctagagagtctacggaccgacgaccgggtacccgttacttaacgtttacgttaggtcggacggtaaacgttacgtttcggttttttaccgtacgtaccttacgttacggtttaaacctaagttttttacggaacgttacggtctttacgttacggttacggttaaccgttcgggttaccgtttcgggtacccgggggg

SEQ ID NO: 98402 - DNA, 720 bp, Homo sapiens
  misc_feature: GYAE6OF01C029U.17.10.A10.1.454.CMB.1.raw
  modified_base (244)..(244): a, c, t, g, unknown or other
  misc_feature (244)..(244): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagagccgtggggcatcagtgactgtctcctgcaggccagtgatatntctacacaaaatatggtatgaagttgggtgacgacgacggcccccggagaagggcgttggaggtcggggtgggggtggtcgaggcggtcgtttggacgggtaacggcacgaggtagtacggcgaaccggaaggtaagtagggaaacggggacgacggtaacggtaccgtaacggtaaccgtttaaccccgggaaccggaacccctaaccccccggaagaaaccctaacggaaccgttaaccgttaacaacgtacgtaaccgtaacgttacggaaccggaccgtaccgacggaagacgtacgggacaaccgggaccgaccggtcccgttaacgttacgttaacgtcggtacgacgttaaggttacgttttcgttttaccgtcggttacgtaccgttacgttaaaccgttaagtttacggtagttacggttctacgttacggttacgtacggttcggtcgtttccggggtaccggggg

SEQ ID NO: 98403 - DNA, 529 bp, Homo sapiens
  misc_feature: GYAE6OF01E20J5.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggagtggggtggggtgggtcaggcggctttgacggtaaggcacagtatgcaccgaagatgaagggcagagtcacgattaccacggacaccccacgaacacagtctacatgacaactgacgagcctgagagctggacgacacgggcctactagttactgtcgacgagtaattgtttctgtcattacgtactaatttgattaggcttacgtatggatcggtcttcggtacggggg

SEQ ID NO: 98404 - DNA, 782 bp, Homo sapiens
  misc_feature: GYAE6OF01BWBOV.17.10.A10.1.454.CMB.1.raw
tcagcgtagactagcacgaccggtgctcgatttagcgtcgatctcaggggacccaaaaccacacccctccttgggagaatcccctagatcacagctcctcaccatggactggacctggagcattccttttcctggtggcagcaggcacaggtcgcccacgccctaggttcaggttggtgcagacgtggggctggaggtgcaggacgccgtggggcagtcagtgacttgtctcgtgacacggccagtggatattatactacaactaaatgtaggtatagtaagtttggggacgaccgacgaccggggcccccggaaggtaacgggtcgttagggagggttcgggggtgggggtacgggtacgtagggccggttacggtttacgggaacgggttacgggacgtaacggtagttacggtacggaccgtaaaccggaaggtagggtacggggaacgggtacgaacgggtaacgtaccggtaacgtaaccgttaaccccggaaaccgggtaaacccccgaaccccccggaaaccgaaaccgtacccgtaaacggttaccgtaacgtacggtaccgaacgttaaaccggtacgggaaccgtaccgtaccgttacggaacggacgtacgtacggacccgtaccgacggttcccgttaattaccgttacggttcggtacgacgttaacgttacgtttgtttcgtacgtactacggttacgtaacgttagttaaggtcgtacgttcgttacgttagttaccggtagttggtaccgggtttcggaccggggg

SEQ ID NO: 98405 - DNA, 583 bp, Homo sapiens
  misc_feature: GYAE6OF01A6VGJ.17.10.A10.1.454.CMB.1.raw
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (486)..(486): a, c, t, g, unknown or other
  misc_feature (486)..(486): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtgggtggggtgggtnagcggctttgacggtaaggcaacagtatgcaccgaagatgaagggcaagagtcacgattaccgaacggaccaccccagaacacagtctacatgacaactgacgagcctgacgagctagacgaacgacggccgtatactttaccgtggtacgcgtaagtaattcggttttancgttaccaagttaccggtaaacttaagttttcggaaattacgggactttacgttaacgttgggtaaccttgggtaccgttttcggtaacccgggggg

SEQ ID NO: 98406 - DNA, 680 bp, Homo sapiens
  misc_feature: GYAE6OF01ER31G.17.10.A10.1.454.CMB.1.raw
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtgggcatcgagtgactgtctctgcaaggccagtgatatatcttacacaaatagtgtatagtagttggtgacgacgaccgggacccccgaggaacgggtcgtagggaggtgggggtaggggtgggtcgaggcgggtgtttgggacggtaaggcacgagtagtcgacgacgaagacgtagggaaggtacgaaggtagacgtaacgtaacgttaacccggacccggaacccaaccccccggaagaaccaacgtaccgtactacgactacggaacctaacgtagggaaccgtacgaccgtaggaagccggacgtaacgaccggaccgacggttaccgtctttaagtccgtggtagacggtaagttacgtttcggtttactgttaccgtacgtttaccgttaaagtttagtttacggactttacggtatttacgtacggttacgggtagttaccggttccgggttaccggtaccggggggg

SEQ ID NO: 98407 - DNA, 600 bp, Homo sapiens
  misc_feature: GYAE6OF01A5NK9.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctctgcaaggccagtggatatatcttacacaaaatatggtatgtaagttgggtgcgacgacggcccccggaacgaagggtcttaggaggttggggtgggggtggggtcaggtcggtctttggacggtaaggcaacgagtatcgacgaccgaagacgtaggagggacagagtacgacgtactaccgacgaccaaccccacgaacacacgtcacgatcgaaccacgtcgaacgacgccgtagacgacgcgtacgacgaccgacggtaccgtacttacgttacgtgtcgacgtagtagtttcgtttcgtagttctacgttacgtaattaagttgtagtacgtacgttctagtagtacgttacggttcgttgggtaccgggg

SEQ ID NO: 98408 - DNA, 693 bp, Homo sapiens
  misc_feature: GYAE6OF01DYJB8.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaggccagtgatatatcttacactaaatatggtatgtaagttgggtgcgacgacggcccccggagaagggcttggaggttgggggtggggtgggtcaggtcggtcgtttggacgggtaaggcgaacgtagtatgacgaaccggaagtagtaggaaggggacaaggtacgtacgacggtacgttaacccgacggaaccccacccccgaacgaaccaacgacgtaccgtactagtacgacaacgtgacgacgccgtagaacgcgccgtaggaaccgaccggaccggtacccgttacgtttacgttacgttacggtacggtacggtaagttacgttttccggtttttcgtacggttacgttaacggtttaccggttaaccttaaagtttttcggaaggtttacggtaccttacgttaacgggttacggttacggtttacgggttacgttcgggggttaacccgggggg

SEQ ID NO: 98409 - DNA, 553 bp, Homo sapiens
  misc_feature: GYAE6OF01E0UBE.17.10.A10.1.454.CMB.1.raw
  modified_base (325)..(325): a, c, t, g, unknown or other
  misc_feature (325)..(325): n is a, c, g, or t
  modified_base (436)..(436): a, c, t, g, unknown or other
  misc_feature (436)..(436): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggccccggacaagggcttggagtggggtggggtgggtcgaggcggtntttgacggtaaggcacagtatgcaccgaagatggaagggcaggagtcgacgattaaccgacggaccacccccgacgaaccacagtctacatgacaactgacgagcctgagngctgacgacgacggcgtactattacgtagtggacgagtaagttcgtttctcgttctagttcgtactaagtttgattacggtcttacgtacgtggacgttggtcgttcggtacggggg

SEQ ID NO: 98410 - DNA, 671 bp, Homo sapiens
  misc_feature: GYAE6OF01DZ2AK.17.10.A10.1.454.CMB.1.raw
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggacccccgagaaggcttgaggtggggtggggtgggtacgaggcggtctttaggacggtaaggcgaacgagtatgcaccgaagataggaagggcaaggagtacacggaacttaaccgaaccggacccaacccccacggaaccacacgtactacgatacgacgaaactcgaaccggagtacccgtgaacggtacgaccgttacggaaccgaccgtaaccggggtacccgttacttaacgtttacgttaggttccggacggtaaacggtagtttcgtttttccgtggttaccagtttaccgttaaaccttttaaagttttacggtaaacgttaggttcccgtttaacgttagttacgggtacgttacgggttaccgtttccgggtaacccgggggg

SEQ ID NO: 98411 - DNA, 661 bp, Homo sapiens
  misc_feature: GYAE6OF01CG3YW.17.10.A10.1.454.CMB.1.raw
  modified_base (121)..(121): a, c, t, g, unknown or other
  misc_feature (121)..(121): n is a, c, g, or t
  modified_base (178)..(178): a, c, t, g, unknown or other
  misc_feature (178)..(178): n is a, c, g, or t
  modified_base (298)..(298): a, c, t, g, unknown or other
  misc_feature (298)..(298): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
tcagcgtagactagcacgaccggtgctcgatttagcgtcgatctcaggggacccaaaaaccacacccctccttgggagaatcccctagatcacagctcctcaccatggactggacctggancattccttttcctggtggcagcaggcacaggtcgcccacgcccaggttcagttggtncagcgtgggctaggaggtgcgagaagccgtggggcagtcagtcgactcggtctcctgacgaacggccagtggaatagtatctacaactaaaattagtggtataggtaagtttcggggtanaccgacgacggtcccccggaagaacggggtcttgggaggttggggttcgggtgggtccgtaacggtcgggtacgttaggaacgggttaacgcgaacgagttagcgaccacggtaacgatgggaaacgcgagcgttaaccacgtacgttaaccgacgacccaaccccgtaagacctacgtacgttacactagcgactaacngaccggacncgtagacgtagccgtacaacgaccacgggtctactacgtagcgttagacgtaacgttattcggtctagtaccgtaagtccgtttaaactagttttcgaagttccgtacgttcgaaagtttaggggaccccttagggtccttggggtaacccggg

SEQ ID NO: 98412 - DNA, 729 bp, Homo sapiens
  misc_feature: GYAE6OF01ANA9Z.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctgaggtgcagagccgtggggcatcagtgactgtcctcgtgcgaacggccaggtcggatatatcttacaactaaatgtaggtatgtaagttgggtgacgtacgaccgggccccggagaacgggtcgttggagggttggggtggggtcgggtcgaggtcggtacgttaggacgggtaacggcaacgtagtacgtcgacgaacggaagtaggtacggaacgggtcgtaacggaacgtacgtaacggtaaccgttaacccggaaccggaacccgaaccccccgaacgaaccgaaccgtaacgtacctaacgagtacgaacgtaacgtacggaacgacggtacgtaggacgtacgacgtacggaccgaaccggtccggtaccgtaccgtttacgtacgtacggtcgtacggttacgttaacgtttcggtttactacgttaccttacggttaacgttaacgttaaggttttggaacggtttacggtacttacggttaacggttacgggttaccgtttacgggttcggttccggggttaacccgggggg

SEQ ID NO: 98413 - DNA, 573 bp, Homo sapiens
  misc_feature: GYAE6OF01CQ9G2.17.10.A10.1.454.CMB.1.raw
  modified_base (290)..(290): a, c, t, g, unknown or other
  misc_feature (290)..(290): n is a, c, g, or t
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacgaggcccccgganaagggtcttaggaggtggggtggggtgggtcaggcggctttgacggtaaggcanagtatgcacgaagatgaaggcagagtacacgattaaccgacggaccacccccagaacacagtctacatgcaatgacgagcctgagngctgaccgacacggccgtctattacgtgtgacgagtaattcggttttactgttacctagtccgttaacgtaattttcggaagttacgggtctttaccgttaattagggtacctttagggtacccgtttcgggtaaccgggggg

SEQ ID NO: 98414 - DNA, 555 bp, Homo sapiens
  misc_feature: GYAE6OF01AISIU.17.10.A10.1.454.CMB.1.raw
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (472)..(472): a, c, t, g, unknown or other
  misc_feature (472)..(472): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggctgaggtggggtgggtgggtcgaggcggtctttggacggtaaggcacgagtatgacaccgaagatggaagggcagagtcacgattaccacggaccacccccagaacacagtcacatgacaactgacgacgcctgagagcngacgacacggcctntacttctgtgcgagtattgtttcgngttacagttcgttaactagttttaggaacgttagggtaccttacgttagtggtaacgttcggtaaccgttcggtaccgggggg

SEQ ID NO: 98415 - DNA, 638 bp, Homo sapiens
  misc_feature: GYAE6OF01DNQ4W.17.10.A10.1.454.CMB.1.raw
  modified_base (397)..(397): a, c, t, g, unknown or other
  misc_feature (397)..(397): n is a, c, g, or t
  modified_base (490)..(490): a, c, t, g, unknown or other
  misc_feature (490)..(490): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctgggtggcagcaggcacaggtgcccacgcccaggttcagttggtgcagacgtgggggctggaggtgcaggaagccgtggggcatcagtgactgtctcctgcaaggccagtggatatatcttacaacaaaatatggtatgtaagttgggtgcgacgacggcccccggacgaacgggtcgttggagggtggggtgggggtgggtcgaggcggtcgtttggacgggtaggcacgagtagtgacgaccgaagagtaggaacggggtanaggtagtacgacgtaacttaccgaaccgggacccaacccccgtaagaaccacgacgtacctacatcgacaacgtagaccgacgacgtgagacncgtagacgaaccgtacggtccgttactagtttacgtggtacggtacgaagttacgtttgttttctagtctacggttacgttaacgttagtttggtaacgttacgtcttacgttagtacggtacgttcggtccgttgggtaccgggggg

SEQ ID NO: 98416 - DNA, 529 bp, Homo sapiens
  misc_feature: GYAE6OF01ATH85.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatagaattgggtgcgacaggcccccgganaagggctttgagtgggtgggtgggtcaggcggctttgacggtaaggcacagtatgcacgaagatggaaggcagagtcacgattacccacggaccacccccgacgaacacagtctacatgcaactgacgagcctgagacgctgacgacgacggccgtactattactgtgcgagtattgttttctgtcagtacgtactatttgattaggcttacgtatggtactggtacgttcgtcggggg

SEQ ID NO: 98417 - DNA, 658 bp, Homo sapiens
  misc_feature: GYAE6OF01EEHE3.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactgggacctggagcattcctttttcctggtggcagcaggcacaggtgcccacgcccaggttcagttggtgcagacgtggggctggaggtgcagaagccgtggggcatcagtgactgtctctgcaaggccagtggatatatcttacaacaaaatatggtatgtaattgggtgcgacgacgggcccccggaagaagggtcttggaggtggggtggggtggtcgagcggtctttggacggtaaggcacaggtatgctacgaagataggaagggcaggacgtcaacgacttaaccgaacggacccaacccccgaacggaaaccactaacggttaccaacgtatacggactaaacgtagtaacggacgacccgtaggaacgacgtacgtacggaacggaccaccgggccgttactaacgtttaccgtggtcggacgtaagtaacgttttggttttactacggttatacgttaacggtaacttaaaggttttgaacgttacggtacttacgttagttacggtacgtttacgggttacgttcgggttaccgggggg

SEQ ID NO: 98418 - DNA, 689 bp, Homo sapiens
  misc_feature: GYAE6OF01AWWND.17.10.A10.1.454.CMB.1.raw
  modified_base (295)..(295): a, c, t, g, unknown or other
  misc_feature (295)..(295): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtaatgaacgttgggtgcgacgacggcccccgganaagggcttggaggtggggtggggtgggtcgaggtcgggtcgtttgggacggtaagggccaacgtagtacgtcggacaaccggaagtacgtaggaagggcgaaggacgttcgaacgtattacccgaacggacccaccccgacgaacacagtaccacgatcgacaactcggaacgcgaccgtggacgagacgtacggaacggaccgtaaccgggccgtttacgtacgttacgttcggtacggtacggaagttaacgtttacggttttcgttacggttacctaacggttacccggttaaactaaagttttaggaaaccgtttagggtaccgtttaaccgttaacggttaccgggttaactttacggggtacccgttttacgggggtaccccgggggg

SEQ ID NO: 98419 - DNA, 538 bp, Homo sapiens
  misc_feature: GYAE6OF01E5AQL.17.10.A10.1.454.CMB.1.raw
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (396)..(396): a, c, t, g, unknown or other
  misc_feature (396)..(396): n is a, c, g, or t
  modified_base (435)..(435): a, c, t, g, unknown or other
  misc_feature (435)..(435): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacaggccgntggacaacgacctgagtggatggggatgggccgaaaccctaacgacgtggtgtcacagtcgtcttcacccatcccgtccgggaacagaccttaccatgacccacgaacctccnccaataaacacacgcctacatggagttgaggcgctgacntctgacgacgacgccgtctattactgtcgacgagacgtcccacgacgtccggtgacgacccgtcggcgacgccggtccttcgacttcggtcgggcgtacgggg

SEQ ID NO: 98420 - DNA, 627 bp, Homo sapiens
  misc_feature: GYAE6OF01AUPFV.17.10.A10.1.454.CMB.1.raw
  modified_base (249)..(249): a, c, t, g, unknown or other
  misc_feature (249)..(249): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttnacaaaatatggtatgaattgggtgcgacgacggcccccggagaagggcttggaggtggggtggggtgggtacgaggcggtcgtttaggaccgggttaaggcgaacgtaggtatcgacgaaccgaagagtagaagggcgagagtcacgataccgacgaccaccccaacgacacgagtactacatacgacaactacgacgacgaccgtaggacgagccgtacgacgaaccgaccgccgtactacgttacgtagtcggtcgtagtaacgtttgtttcgtcgttacgtacgttacgttaaccttaagtttacggtaagttaccggttacttacgttacggttacggtacgttacgggttaaccgttcgggttaacccggggg

SEQ ID NO: 98421 - DNA, 843 bp, Homo sapiens
  misc_feature: GYAE6OF01BJVB2.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcgcccacgcccaggttcagttggtgcagacgtggggctggaggtgcgagaaggccgtggggcatcgagtgactgtctcgtgacgagccagtgatagtactctacaactaaagtgtggtaagtagtaagttggggtacacggacgacccgggcccccggaagtaaggggtccgtttaggggagggtttgggggtcgggggttacggggtacgaacggggtccgggtacgttttacggggaacgggttaacggaccgtaacggtaaggtttacgaccggtaaccggaaccggaaagtacgggtacgggaaacggggtcaaagggttaacgtacccgtaaaccggtaaaccggttaaacccccggaaacccggaaaccccgtaacccccccgaacgggtaaaacccgtaccggttaacggtaccttaaaccggtagtaccgtaaaccggtaaaccgttacgggaacccggtaccgtacccggttaaggaacggtacggtaccgttaaccgggaacccgttaaccgggaaccccgggtttcgtttaccgttttaagtccggtaacgggttacgaccgtttaaggtaacgttttccgttttacgtaggttacgtacgtttacggttattagttacggtaagtccgtacgttacgtaacggtccggaagtttacggtccgttcgggtaaccgggg

SEQ ID NO: 98422 - DNA, 622 bp, Homo sapiens
  misc_feature: GYAE6OF01EH9Y0.17.10.A10.1.454.CMB.1.raw
  modified_base (326)..(326): a, c, t, g, unknown or other
  misc_feature (326)..(326): n is a, c, g, or t
  modified_base (432)..(432): a, c, t, g, unknown or other
  misc_feature (432)..(432): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcagctacaagtgcccactcccaggtccagttggtgcaatcgtggggctgaggtgaagacgcctgggtcctcggtggagggtctccgtgcaaggtcttcgtggaggccaccttcagcgactattagtttcaagttgggtgcggacgggtcctcgtaggacaggccttggaggtggagtggggaagntcgtcctagtcgtgacacaacaaactacgacacgacgaagttccgaggacagactacgaactaacgtaaccggacgaaacaaacttaaccgaacacgtaagttaancgtaggactcgtaagaactacgctagtacagtacaggagacgacgggtcttacttacgtcgtgtcgtacgaggtaattattacgtaatactacgtctacctttacctttaccgtacccttaccgttcgtacttcggtcgggtacctacggtacccgggtacccctacgtacccgtcttcccgcgtacccg

SEQ ID NO: 98423 - DNA, 680 bp, Homo sapiens
  misc_feature: GYAE6OF01BHLM9.17.10.A10.1.454.CMB.1.raw
  modified_base (327)..(327): a, c, t, g, unknown or other
  misc_feature (327)..(327): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtgggcatcagtgactgtctcctgcaaggccaggtggatatatcttacaactaaaatatggtatagtaagttgggtcgcgacgacggacccccggagaagggtctggaggtggggtggggtgggngaggcggtcgtttggacggttaggcgtacgagtacgtgacgaaccgaagagtaggaaggcaagagtactacgaacttaccgacggaccaccccgacgaaccaacaggtacctaacgagtacgactaacgtacgacgacgtcgtagacggtacgacgtacggaaccgaccggtaccgggtacccgttaccgtttaacgttaccgttacgttacgggtaacgttaacggttaacttttacgggttttcttaccggttacttaacggttaccgttaaaccgttaattttaggggactttaggacctttacgttacgtaggggttaacctttcgggtacgtttcgggtaaccggggg

SEQ ID NO: 98424 - DNA, 789 bp, Homo sapiens
  misc_feature: GYAE6OF01DXHNG.17.10.A10.1.454.CMB.1.raw
  modified_base (96)..(96): a, c, t, g, unknown or other
  misc_feature (96)..(96): n is a, c, g, or t
  modified_base (178)..(178): a, c, t, g, unknown or other
  misc_feature (178)..(178): n is a, c, g, or t
tcagcgtagactagcacgaccggtgctcgatttagcgtcgatctcagggggacccaaaaaccacacccctccttgggagaatcccctagatcacanctcctcaccatggactcggacctggagcacttccttttcctggtggcagcaggcacaggtgcccacgccaggttcagttggngcagacctggggctgaggtgcagaagccgtgggcatcagtgactgtcctcgtgcaaggccaggtgaatatattcttacaactaaatagtaggttaataggtaagtttggggtcgaccgtaaccgaccgggtaccccccggaacggtaaacggggtacgtttgggtacggggttgggggggttagggggttcggggtacgacggtcgggtacggttttcgggaacgggttaacgggacgtacgaaggttacgtcggaccgtaaccggaaacgtacggttaagggaagggtacgtaagggtaacgtaccgtaaccggtaaacgtttaaccccggaaacccgggttaaacccccaacccccccggtaacgtaaacccaaccggtaacgtaccgtaacgtacgtacgaacctaacggacgaaccggtaacgtccgtaacggaagtacggtaccgtaacggaccgaaaccggtacggtacccgttaacgtttacgttacgtagtacgggacgttaagtacgttttagtttactcggtattacgtacccgtttaatagtttagtacgtacgttgtaccgttagtaccgtacggtttacgacgtttcgggtaccgggg

SEQ ID NO: 98425 - DNA, 614 bp, Homo sapiens
  misc_feature: GYAE6OF01D0KJH.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaagttgggtgcggacacggcccccggacgaagggtcttggaggtgggggtggggtgggtcgaggcggtcgttttggacgggtaaggcacgaggttatgcgaaccggaagagtaggaaggggcaaggagtacaacgacttaaccgaccgaccaacccccgaagaaccacgacgtactacatacgactaaacgtggaacgacgtaccgtaggagagccgtagaaccgaccgaccgggtccgtaccttaacgttacgtcgtaggacgtaagtagtttcgtttcgtgttacgtattacgtaattattgtagtacgtcttacgtatacggtattcggtcgttcggtaccggggg

SEQ ID NO: 98426 - DNA, 680 bp, Homo sapiens
  misc_feature: GYAE6OF01COM5Z.17.10.A10.1.454.CMB.1.raw
  modified_base (247)..(247): a, c, t, g, unknown or other
  misc_feature (247)..(247): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagactggggctgaggtgcagaacgccgtggggcatcagtgactgtctcctgcaaggccagtggatatntcttcaacaaaatataggtatagtaagttgggtgcgacacggcccccggagagggtctggaggtggggtgggggtggtcgaggcggtcgttaggaacgggtaaggcacgagtatgacaaccgaagagtaggaagggctaaggacgtacgaacgtacttaacccgaccggtaacccaaccccgaacgaaaccacgtaacggtcctaacgacttcgactaacgtgaaccgacgacccgtaggacgagtcgtacggaaccgaccggaccggtccgtacttaacgtttacgtcggttacggaccggtaaagttacgttttggttttcctggttacctacgttttaccggttaaatttagtttaacggaacgtttcgggtacctttacggtaggttacgggtactttacgggttaaccgttcggggtaaccccggggg

SEQ ID NO: 98427 - DNA, 627 bp, Homo sapiens
  misc_feature: GYAE6OF01DP04P.17.10.A10.1.454.CMB.1.raw
  modified_base (363)..(363): a, c, t, g, unknown or other
  misc_feature (363)..(363): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagcctggggcatcgagtgactgtctcctgcaagccagtgatatatctacaacaaatagtggtatagtaagttgggtgcgacgacggacccccggaagaagggtcttaggagggttgggggtggggtgggtcgaggcggtcgtttaggacggtaggcacgagtangcacgaagagtaggaaggcaggagtacacgtactaccgaccgacccaccccgaacaacacagttacaacgactcgactaacgtagacgtacgcgtaggaacgacgtcgtacggaccgaccgtaccggtccgttacttacgtttacgtgtacggacgtaagttacgttttcggtttcttagtacgtagttaccgttaattaagtttagtaacgttacgttacttacgttagtacggtacgttcggtaccgttcgggtaccggggg

SEQ ID NO: 98428 - DNA, 653 bp, Homo sapiens
  misc_feature: GYAE6OF01CR34J.17.10.A10.1.454.CMB.1.raw
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (483)..(483): a, c, t, g, unknown or other
  misc_feature (483)..(483): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcaggttggtgcagacgtggggctggaggtgcagagccgtggggcatcagtgacttgtctctgcgaaggccagtgatatattctacaactaaaatagtggtaatagtaagtttgggtgacgaacgaccgggacccccggaagaacgggtcgttaggaggtgggggtggggtggtcgaggtcggtcgttggacggtagcgacgagtntgacacggaagngtaggaggacaggagtacgaagtacttaaccgacgacccaaccccgagaaccgacacgtactacgactacgaactacgtacgacgactcgtagaggntacgagacgaccgaccggtaccgtacttacgtacgtgtacggtagtaacggttattacggttttacgtacggttacctaacgttcgttaaaccgttaagtttacggtaggttaccggtactttcggttaacgtacggtacggtacgttaacggttcgggtaacccggggg

SEQ ID NO: 98429 - DNA, 681 bp, Homo sapiens
  misc_feature: GYAE6OF01BE3KD.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcagaagcctggggcatcagtgactgtctcctgcaagccagtggatatatcttcacaaaatatggtatgtaattgggtgcgacaggcccccgganaagggtcttggagttggggtggggtgggtcgaggtcggtctttggacggtaaggcacgagtagtgcaccggaagagtgaagggcaagagtcacgacttacccaacggaccaccccaacgaaccaactaggtacctaacacttagacctaacgtaggaaccgacgccgttaggaacggtacgaccgtacggaaccgaaccgaccgggtaccccgttaccttaacgtttacccgttacgggttacgaacggttagtaaacgttttcgttttccgttacggttacttaacgttaccgttaacgttaaagttttacgggtaacgttacgggtacctttacgttaaggttacgggtaaccggttacgggttacccgtttcgggttacccggggggg

SEQ ID NO: 98430 - DNA, 740 bp, Homo sapiens
  misc_feature: GYAE6OF01CISXL.17.10.A10.1.454.CMB.1.raw
  modified_base (280)..(280): a, c, t, g, unknown or other
  misc_feature (280)..(280): n is a, c, g, or t
  modified_base (553)..(553): a, c, t, g, unknown or other
  misc_feature (553)..(553): n is a, c, g, or t
tcagcgtagactagcacgaccggtgctcgatttagcgtcgatctcaggggacccaaaaaccacacccctccttgggagaatcccctagatcacagctcctcaccatggactgggacctggagctacttccttttccgtgggtggcagcgaggcacgtaggcgcccacgcccgtaggttcgtaggttggtgcaggtacggtggggcgtggaggtcgcgaggacggccgtggggcagtcgaggtcgtactcgtcctccgtgacgaacggccgaggtgatatnttctaacaactaaagttgtaggtagttacggtaaggtttgggcgacgacggacccgggccccggaaggtaacgggtcgttaggcgggttgggggtcgggggtacggacggtcgggtccggttacggtttacgggaacggggtaacgacgtaggtaacggttagtacggaaccgaaccgaaagtaacgacggggaaggacaagggtacaacggtaacgtacgtaacccggaccgaacccaacccccgaagaaccacgtacgttaccacgtaacncgtaactaacgacggacgtcgacgagtcgacgcgtacgacgaaccgtcggccttacttacgtcgtagtcggtactaaggtttcgttacgttcgttctaccggtagtttacccgttaagttaacgtttaggtacgtacgttaccgtttagtacggtcggtaggtttccggtgttcggggtacccgggg

SEQ ID NO: 98431 - DNA, 292 bp, Homo sapiens
  misc_feature: GYAE6OF01BJYFY.17.10.A10.1.454.CMB.1.raw
  modified_base (279)..(279): a, c, t, g, unknown or other
  misc_feature (279)..(279): n is a, c, g, or t
  modified_base (285)..(292): a, c, t, g, unknown or other
  misc_feature (285)..(292): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtctaggtcagcccaaggctcgccccctggtcactctcgttcccacctcctctagtctacgctgagcggctggcaaggcncatagnnnnnnnn

SEQ ID NO: 98432 - DNA, 679 bp, Homo sapiens
  misc_feature: GYAE6OF01ET718.17.10.A10.1.454.CMB.1.raw
  modified_base (266)..(266): a, c, t, g, unknown or other
  misc_feature (266)..(266): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttccagttggtgcagacgtgggctggaggtgcagacgccgtgggcagtcagtgactcgtcctcgtgacgaacggccaggtggattagtactaccgttanaactaaagtagtaggtatagtaagttgggtcacgtacgaccggtacccccggaagtaacgggtcgtggaggttcggggtacgggtggtacgacggtcggtacgtttagacggtaacgcgacgtagtagtacgacgaacggaagagtacggaaggcagtacgtacgtaacgtacgtaaccgacgtacccgacccgaacgacgacacgtacacgacgtgaaccacgtacggacgtacgccgtagaacgtacgtacggtacgaccggtacgtacccggtacgttaaccttacggttaacgtaggtaccggagttaacggtttacgtttcgttacgtacgtttcaacgtttacgtaacgtttattacggtcgtaacgtcgttaacgtaggtacttaggcggttagtcggtaccgggg

SEQ ID NO: 98433 - DNA, 632 bp, Homo sapiens
  misc_feature: GYAE6OF01DJZWL.17.10.A10.1.454.CMB.1.raw
  modified_base (247)..(247): a, c, t, g, unknown or other
  misc_feature (247)..(247): n is a, c, g, or t
  modified_base (361)..(361): a, c, t, g, unknown or other
  misc_feature (361)..(361): n is a, c, g, or t
tcagcgtagactagcacgaccggtgctcgatttagcgtcgatctcaggggacccaaaaaaccacacccctccttgggagaatccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatctanaacaaaatatggtatagaagtttgggtgacgacgacggccccccggacgaaggggtccgttggaggttgggggtaggggtggggtcaggcggtctttggacggtaagcacagtntgcaccgaagagtggaagggcaaggacgtacgacgtattaacccggaccggtacccaccccgacgaaccacagtcctacagtcgacaactcgacgacgcctagagacgctagaaccgacgtaccggctacgttacttaccgtgtacggactaaggttacgtttcgtttccgttgtaccttgttaaccgttaattaacgttttggtaacgttaccggtcttacgttaacggacgggttacgttacgggtccgtttcggggtaacccgggggg

SEQ ID NO: 98434 - DNA, 689 bp, Homo sapiens
  misc_feature: GYAE6OF01CZ8E4.17.10.A10.1.454.CMB.1.raw
  modified_base (338)..(338): a, c, t, g, unknown or other
  misc_feature (338)..(338): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctgggtggcagcaggcacaggtgcccacgcccaggttcagttggtgcagacgtggggctggaggtgcaggaagccgtggggcatcagtgactgtctcctgacaaggcagtggatatctcttacaaactaaatataggtatagtagttgggtgcgacgacggccccggagaagggtcgttggacgggtggggtgggggtgggtacgnggtcggtcgtttagggacgggtaaggcaacgtggtatcggacgaaccggaagaggtaaggaagggactaaggacgttacgaccggttaacgtaacccgaaccggaacccaccccgagaaccacgtacgtactacagtacgaacaacgtacgacgacgactggagacgcgtacggaccacgaccggtcgtacgtagtttacgtgtacgacggtagttaagttttcgtttaccgtaggttaccttagttaccgttaaagtttaaggttttacggtaacgttacggttccgtttacgttacgggttacgggttacggttacggggttcccggtttcgggggtaacccggggggg

SEQ ID NO: 98435 - DNA, 709 bp, Homo sapiens
  misc_feature: GYAE6OF01AH7IM.17.10.A10.1.454.CMB.1.raw
  modified_base (151)..(151): a, c, t, g, unknown or other
  misc_feature (151)..(151): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (568)..(568): a, c, t, g, unknown or other
  misc_feature (568)..(568): n is a, c, g, or t
  modified_base (598)..(598): a, c, t, g, unknown or other
  misc_feature (598)..(598): n is a, c, g, or t
tcagcgtagactagcacgaccggtgctcgatttagcgtcgatctcagggacccaaaaccacacccctccttggagaatccctagatcacagctcctcaccatggactggacctggacgcacttccttttccgtggtggcagcaggctacgnggtgcccacgccctaggttcagttggtgcgagtacgtgggggctggtaggtggacgaggaaccgcggtcggggctaacttcgaggtcgtacgtcggttcctccggtgaccgtaacggccaggtggtaattactattcccttacgaaactaaagttgttaggtaagtaggtaagtttggtcgtacgaaccggtaccgggaacccccggaggtaacgggtgttcgggtagggttcggggtggggtcggggtcagggtccggttacgttagggaacggtagcgtagtagttancggacgtaacgaagngtaggacggagctaggacgagtaccacgaccggacccacccgagtaacagtacacgntagcacgtaacgngtaaccgngaccgtgacgactcgacgtaccaaccggtccgtntaacgttggtacgtgaacgtggtaacgttntttcggttaccttaggtcctaagttaaccgttaaggttctaaccggttgttacccggattttaccgtaagggtacgtttacgttcgggtaaccccgtttgggaacccgggg

SEQ ID NO: 98436 - DNA, 650 bp, Homo sapiens
  misc_feature: GYAE6OF01D2KTN.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgcaaggccagtggatatattctcaactaaaatatggtatgaagtttggtgcgacgacggcccccggacgaagggtcgttggaggttgggggtgggggtgggtcgaggcggtcgtttggacggtaaggcgacagtatgacgaccgagagtgaagggcagagtcaacgtactaccgacggacccaccccgaacgaacacgagtacctaacgacgtagaccaacgtgaacgcgtaccgtgaagcgtctacggaacgacgaccggtccgtacgttacgttacgtcggttacgacgtaagtacgtttcgttttacgtcgttaccgttacgttaccggttaacttagtttacgttaacggttacgtacgtttaacgttacggtacgggttaaccgtttgggtaccgtttccgggggttacccgggggg

SEQ ID NO: 98437 - DNA, 644 bp, Homo sapiens
  misc_feature: GYAE6OF01CIPIG.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagacgtgggggctggaggtgcaggaacgccgtggggcatcagtgactgtctcctgcaacggtccagtggatatatcttacaataaaatatggtatagaattgggtgcgacgacggccccggagaacgggtctaggaggtgggtgggtggcgagcggtctttggacggtagcactaggtatgacgaccgaagagtaggaaggacaggagtacgaacgtacttaaccgaccggaaccaacccccgaacgaaacacgtaacgtactaacgtactacgacgaaacgtacggaacgacgtacccgtaggaacgagcgtacgaccgaacgaccggtccgtactacgttacgtcggtgacgtaacgttaagttccgttttgtacgtactaacgtaccgttaactaagtttacgagtttacggacgtttactaggttacggtaacgttcggtaacggtttcgggtaccggggg

SEQ ID NO: 98438 - DNA, 689 bp, Homo sapiens
  misc_feature: GYAE6OF01D209I.17.10.A10.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (276)..(276): a, c, t, g, unknown or other
  misc_feature (276)..(276): n is a, c, g, or t
tcagcgtagactagcacgaccggtgctcgatttagcgtcgatctcagggggacccaaaaccacacccctccttgggagaatcccctagatcacagctcctcaccatgggacctggacctggagctatccttttcctggtggcagcaggcacaggtgcccacgcccaggttcagttggtgcagactggggctgaggtncagagcctgggcatcagtgactgtctctgcaaggccagtggactatatcttanactaaaatatggtatagtaattgggngtcgacgacggcccccggaagaacgggtacgttaggtaggtggggttaggggtcgggtacgacggtcggtagttttcggaacgggtaagggtacacgaggttacgtcggacgaccggaagtacgtagggtaacgggaccgtaaggaggtaccgaacgtagttaacccggaacgggtaccaacccccgagaacctacaacgtacttacacgttacgaaccaacgtagacgtagccgtagacgtacgtcgtaggacgtacgacgggtccgtaattacgtttcgtagtcgacgtaagtacttacggtttcgtagtaccgttattaccggtaactttaaggtttacggacgttaacggttcgttaaccgttaggttaacgggtaacggttacggtttaccgtggggttacccggggg

SEQ ID NO: 98439 - DNA, 294 bp, Homo sapiens
  misc_feature: GYAE6OF01CDBXP.17.10.A10.1.454.CMB.1.raw
  modified_base (290)..(294): a, c, t, g, unknown or other
  misc_feature (290)..(294): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctcgccccctggtcactctcgttccccaccctcctcctagtctacgctgagcgggctggcaaggcgcatagnnnnn

SEQ ID NO: 98440 - DNA, 589 bp, Homo sapiens
  misc_feature: GYAE6OF01EZ8EW.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattcctttttcctggtggcagcaggcacaggtgcccacgcccaggttcagttggtgcagactggggctgaggtgcagaagccgtggggcatcagtgactgtctccgtgcaaggccaggtgatatatcttacacaaaatatggtatagattgggtgcgacgacggccccggacgaaggcttggagtggggtggggtgggtcgaggcggtcgtttggacgggtaaggcacgtagtactgacacgaagagtaggaaggcagagtcaacgattaccgacgaccaccccacgaacacagtctacatacgacaacgtcgaacgcgcctagacgtagcgagacgaccgacggccgtacttacgttacgtgtagtacgaagtacttgtttcgtcgttactaacttacggttaacttaagtttacgtacgttaggtaccttcgtacgtgtaacgttcggttcgtccggtacggggg

SEQ ID NO: 98441 - DNA, 778 bp, Homo sapiens
  misc_feature: GYAE6OF01AMU9X.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaacgccgtggggcatcagtgactgtctctgcaaggccaggtggatatatcttacaacaaaatatggtatgtaagttgggtgtcgacgacgggcccccggaacgaaggggcgtttacggagggttgggggtggggggttcggggtacgtagggccgggtcgtttacgggtaacggggttaaggaccgtaacgaggtagtcgacgaccggtaaaggtagtagggaaacggggacgtaagggaggtaaccgacggtaactttaacccggaaccggacccgaccccccggtaacgaaccaaccgtaacggtcctaacgagtaccgaacgtaacgtacgaaccggactaccggtacggaacggtacgcgtacgtaacggaccgtacccggtccgttactaaccggtttcgtacggttacgtacggaaggttaacgtttccggtttacgttagtttcccgtaacggttaaccggtttaacttaacggtttaacggtacggtttaaccgggttaccgttacgtttaaagggtttaccggtaaccggtttaccggggttaaccgtttccggggttaaccccggggggg

SEQ ID NO: 98442 - DNA, 296 bp, Homo sapiens
  misc_feature: GYAE6OF01C0JIY.17.10.A10.1.454.CMB.1.raw
  modified_base (281)..(281): a, c, t, g, unknown or other
  misc_feature (281)..(281): n is a, c, g, or t
  modified_base (287)..(296): a, c, t, g, unknown or other
  misc_feature (287)..(296): n is a, c, g, or t
tcagcgtagactagcacgaccggtgctcgatttagcgtcgatctcaggggttcctgaccgattctctggctccaagtctggcacgtctgccaccctggcatcaccgcgctccagactggggacgaggccgagtatttctgcgcaacatgggattccagcctgacttcgtggggtgttcggcaggtgggaccaagctgaccgtctaggtcagccaaggctcgcccctggtcactctcgtcccgccctcctcctagtctacgctggagcgggctggcaaggcncatagnnnnnnnnnn

SEQ ID NO: 98443 - DNA, 721 bp, Homo sapiens
  misc_feature: GYAE6OF01DRITP.17.10.A10.1.454.CMB.1.raw
tcagcgtagactagcacgaccggtgctcgatttagcgtcgatctcaggggacccaaaaaccacaaccctccttgggagaatcccctagatcacagctcctcaccatggactggacctggagcattccttttcctggtggcagcaggcacaggtcgccccacgcccaggttcaggttggtgcagacgtggggctggaggtgcagagccgtggggcatcagtgactgtcctcctagacgaaggccaggtacggatatatctacaacaaaatatggtatgaagttgggtgcgacgacggcccccggagaacgggtcttcggagggtgggggtgggggtgggtcgaggtcggtcgtttggacgggtaaggcgaacgtagtatcggacgaccggaagtagtagggaagggacgaaggacgtacgacgtaacttacccggaaccggtaacccaccccccgaaacgaaccgaaccgtaacgttacctaacgactcggacctaaacgtcgggaaaccgcggtacccgtagggacggtacgaccgtacggaccgtaaccgaccggtcccgttacgttacgttacgtgtacggtaccgtaagttacgtttcgttttcgtacgttacgtaacttaccgttaaattaagttttaggtaacggttacggtcttaaccgtttaaggttacgggtaaccgtttacgggttaccggttccggggtaacccggggggg

SEQ ID NO: 98444 - DNA, 616 bp, Homo sapiens
  misc_feature: GYAE6OF01A2S18.17.10.A10.1.454.CMB.1.raw
  modified_base (294)..(294): a, c, t, g, unknown or other
  misc_feature (294)..(294): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttcaactaaaatatggtatgaagttgggtgcgacgacggcccccgganaacggcttggaggtggggtggggtgggtcaggcggtcgtttaggacggtaaggcacgagtatcgacgaccgaagagtaggaagggcagagtcacgtactaccgacggacccaccccgaacgaacacgacgtctaacagtcgactaacgtaggaccgacgtccgtaggacgacgcgtacggaccgaccgaccggtccttacgttagttacgtggtacgacgtaagttaatttcggtttctacgtactagttaccgttaattaagtttgaagttacggtcttacgtagttacggtacgttcggttaccgttcgggtaccggggg

SEQ ID NO: 98445 - DNA, 603 bp, Homo sapiens
  misc_feature: GYAE6OF01D1GNT.17.10.A10.1.454.CMB.1.raw
  modified_base (277)..(277): a, c, t, g, unknown or other
  misc_feature (277)..(277): n is a, c, g, or t
  modified_base (336)..(336): a, c, t, g, unknown or other
  misc_feature (336)..(336): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagcctggggcctcagtgaaggtctcctgcaaggcttctggattctacgtttacctcctatagtatcaacgtgggtacnccgccgaggccgctggaacaacgcctgagtggatgggatgggacaaccctaagctggtntcatagtgtctccaccatccgtacgggacagtacttaccatcgaccacgactcctacaataacacancctantaggattgaggcncctagactatcgtagaccgacgaccggtccttactaacgttactcggtacgcgtaacggtaccgtacccgacgtacgtcccgggtagaccggtaccgtaccgggcacgggttccgttccgtttaacggcccgtttacgggtccggggaccgtaggggtacccgtcccggttggtaacccccg

SEQ ID NO: 98446 - DNA, 607 bp, Homo sapiens
  misc_feature: GYAE6OF01B7CX1.17.10.A10.1.454.CMB.1.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttnacaaatntaggtatgaattgggtgcgacacggcccccggacaagggcttgaggtggggtggggtggtcgaggcggcttttggacggtaaggcacgagtatgcaaccgaagatggaaggcgagacgtacacgtactaaccgacggaccacccccaacgaacgaacaacgtcctacactcgacaacgtcggacgacgccgtagacgagaccgtagaccggaacgacgggacccgttattacctttacgtggtacgacgtaagtaactttgttttcgtgttactacgttacggttaacctaagtttacgtagttacggtcttacgttagtcggtacgttggttaccgttcggtaaccggggg

SEQ ID NO: 98447 - DNA, 630 bp, Homo sapiens
  misc_feature: GYAE6OF01B3YFW.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtgggctgaggtgcagaagcctgggcatcagtgactgtctctgcaaggcagtgatatatcttacacaaaatatggtataggaattggggtgcgacgacggcccccggaacgaagggtcttggaggttggggtggggtgggtcgaggcggtcgttttggacgggtaaggcgaacgagtatacgacaacggaaagaagtggaaacgggcagtagtacaacggattaacccgaacggaacccaacccccgaacggaaccacgtaacgtactaaccatacggaccaaacgttacggaacggacgtcccgaggaacgaggtacgacgaacgaccgtaaccggcccgtaccttagttaccgtggtacgacgtagtaatttcgtttcgtgttcgtattccgtactaagttgattggtacttacgtattacggtactggtaacgttcggtacgggg

SEQ ID NO: 98448 - DNA, 712 bp, Homo sapiens
  misc_feature: GYAE6OF01A3LIW.17.10.A10.1.454.CMB.1.raw
  modified_base (370)..(370): a, c, t, g, unknown or other
  misc_feature (370)..(370): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgacagaagccgtggggcatcagtgactgtctctgcaaggcagtgatatatctacaactaaatagtaggtatagtagttgggtgacgacgaccggacccccggaagacgggtcgttggaggttgggggtggggtgggtcgaggtcggtcgttaggacgggtaaggctagagtacgngacgaacgaagagtaggaacggacgaaggacgtacgaacgtaacgttaccgaaccgaccccaaccccgaacgaacctacgacgtaccgtacagtacgaccgtaacgtacgaccggtacgaccgtagggaacgtaacggccgtaacgggaaccgacccggtacgggtcccggttaacttaacgttacggtgggttaaccgacggttaagtttaacgtttggtttttaccgaggttttaccaacggtttacgtaacgtttaagttttacggaacggtttacggtacgtttaacgttaacgggtcgggttaaccgcgggtttaccggttcgggggtaacccgggg

SEQ ID NO: 98449 - DNA, 602 bp, Homo sapiens
  misc_feature: GYAE6OF01DHR6H.17.10.A10.1.454.CMB.1.raw
  modified_base (464)..(464): a, c, t, g, unknown or other
  misc_feature (464)..(464): n is a, c, g, or t
  modified_base (499)..(499): a, c, t, g, unknown or other
  misc_feature (499)..(499): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtgggctgaggtgcagagccgtggggcatcagtgactgtctcctgcaaggccagtggatatatctacaacaaatatggtatgtaagtttgggtgcgacgacggcccccggagaagggtcttggagggtggggtggggtgggtcgaggcggtcgtttggacgggtaaggcacgagtatgcaacggaagagtaggaagggtacaggagtacacgtactaccgaaccggacccaacccccgagaaccacgagttaactacatcgacaacgtgacgacgctagagncgtagaccgacgcgggtcctattacgttcttggtnacggtaagttactttggtttactgtacttatcgttaaactagttttcgtaagtcggttcttacgttaggtacggtctttacgggtccttcggggtaccggggg

SEQ ID NO: 98450 - DNA, 810 bp, Homo sapiens
  misc_feature: GYAE6OF01AKBKH.17.10.A10.1.454.CMB.1.raw
  modified_base (239)..(239): a, c, t, g, unknown or other
  misc_feature (239)..(239): n is a, c, g, or t
  modified_base (366)..(366): a, c, t, g, unknown or other
  misc_feature (366)..(366): n is a, c, g, or t
tcagcgtagactagcacgaccggtgctcgatttagcgtcgatctcaggggacccaaaaccacacccctccttgggagaatcccctagatcacagctcctcaccatggactggacctggagcattccttttcctgatggcagcaggcacgaggtcgccccacgcccgagggttcaggttggtcgcgagcgtggggctggaggtgcagacgccggtgggcatcgagtcgacttgtcctcgngaccgaaggccaggtgatatactctacaacaaattagtaggtatggtaagttcggtagacgacggtaccggcccccggaagaacggggtcgttaggaacgggtgggggtagggggttcgggtaacgngggtcgggttacgtttacgggtaagggtaacggtacgaacggtaagtacgttcggaaccggtaaccggtaaaggaccggttagggaaacgggacggacggttaacgtaccgaaacgggttaaccttaacccgggaacccggaacccctaaaccccccgggaactaaaccccgaccgttaaacgtacccgtaaaccgtactacggtaacccgtaagtaaccgaacggtaccgtaccgtaggacgtaccggtaccgagaaacccgtcgggaccgtaccggttaacttacgttaacggtcgttacgggaacgttaagtaccggttttacgtttcctaccggttacttaaccggtaccgttttaaagtaacgttttacggtaacgtaacccggttcgtactttacgggaaccgggttcgttaccggggtttaccgttaaccggggggg

SEQ ID NO: 98451 - DNA, 663 bp, Homo sapiens
  misc_feature: GYAE6OF01BN81Z.17.10.A10.1.454.CMB.1.raw
  modified_base (580)..(580): a, c, t, g, unknown or other
  misc_feature (580)..(580): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcaaggccagtggatatatcttacaactaaaatataggtatagaatttgggtgcgacgacgggcccccggagaacgggtcgtttaggaggttgggggtggggtgggtcgaggtcggtcgtttaggacgggtaaggcgtaacgaggttagtcgacgaaccggaagtacgtaggaaacgggcaaggtacgtacaacgtaacgttaacccgaccggaacccaacccccgagaaaccacgacgtacctaacagtcgaacaacgtagacgacgtccgtagacgacgacgtagaaccgaaccgaccgggtacccgttacttacgttacgtgtacgacgtagtaacgtttcgttttacgngttacctagttaccgtaattagtttaggaacttacggtcttacgtacgttacggtacgttcggtacgtttcgggtaaccgggg

SEQ ID NO: 98452 - DNA, 699 bp, Homo sapiens
  misc_feature: GYAE6OF01E4DZF.17.10.A10.1.454.CMB.1.raw
  modified_base (120)..(120): a, c, t, g, unknown or other
  misc_feature (120)..(120): n is a, c, g, or t
  modified_base (133)..(133): a, c, t, g, unknown or other
  misc_feature (133)..(133): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (613)..(613): a, c, t, g, unknown or other
  misc_feature (613)..(613): n is a, c, g, or t
tcagcgtagactagcacgaccggtgctcgatttagcgtcgatctcagggacccaaaaaccacacccctccttgggagaatcccctagatcacagctcctcaccatggactggacctggancattccttttccngggtggcagcaggcacgaggtgccccacgcccaggttcaggttggtgcagacgtggggctgaggtgacagacgccgtgggcatcgagtnacgtcgtctctgacgaaggctaggtgattatactctacaactaaagtgtaggtangtaagttcgggtgaccgacgaccggccccggtaagacgggtgttcgggagggtgggggttgggnggtcgacggtcggttcgttagggaacggtagacgtagagtntcggacgaacggaagaggtaaggacggtacgacggtaacgttacgaaccgtaaccgtaacccgaaccggacccctaaccccgaacgaaccacgtaacgtacctaacgcgtaacgaaccgtaaccgtagaacccggacgtccgtaaggaccgcgtaccggaccgtacggaccgcccggtcgtttacgtacgtttaccggtagtacgtacggttagtttaacgttcgttttancgttaactagtttaaccgttattaaggttcgtaaagttcggtacttacgtacgttaggtaccgttcggtttggtcgggacccgggg

SEQ ID NO: 98453 - DNA, 719 bp, Homo sapiens
  misc_feature: GYAE6OF01DEKXS.17.10.A10.1.454.CMB.1.raw
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (391)..(391): a, c, t, g, unknown or other
  misc_feature (391)..(391): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagacgtggggctggaggtgcagaacgtccgtggggcagtcgagtcgactcggtcctccgtggacaacggccgtaggtaggatactattcttacaanaaaatagtgtatagtagttggngacgacgaccggcccggtaagaagggtcgtaggaggttggggtgggtggtacgagggtcggtacgtttagggaaccggtaggacgtacgaggtntacggacgaacggaagtgtaaggaacgggtagaacggtacgtacgaacgtaaccgtaaaccggacccggaaccccgaacccccgtaagaacctacgtaacgtacctactacggtacaactaacgtacggaacgtaccgcgtacgaaggtacgacgtaccggaacgtacccgggaccggttcccgtacgttacgttaccgtaggtcggtaacggtaacgttacgtttacgtttccgtacgtacgttacgttacgtttagttagttagtcggttacggtacgtttacgttaacgtggttaacctcgggtacgtttccggggacccggggg

SEQ ID NO: 98454 - DNA, 626 bp, Homo sapiens
  misc_feature: GYAE6OF01ADEFO.17.10.A10.1.454.CMB.1.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacaacaaatatggtatgaagttgggtgcgacgacggcccccgganaacgggtcttggaggtggggtggggtgggtcgaggcggtcgtttggacggtaggcacgagtatcgacacgaagagtaggaagggcaggagtacgacgtacttaccgacggtacccaccccgaacgaacacacgtactaacacgtacgacaacgtcgaacgacgtaccgtaggacgacgactaggaccgaccgaccggcccgttacgtacgttcgtagtcgtacggtagtagtttcgtttcgtgttactacgttacgttaaccttagtttacggtacgttacggtcttaacgttacgtacggtacgttcgggttaccgttcggggtaacccggggg

SEQ ID NO: 98455 - DNA, 753 bp, Homo sapiens
  misc_feature: GYAE6OF01DJ5BS.17.10.A10.1.454.CMB.1.raw
  modified_base (122)..(122): a, c, t, g, unknown or other
  misc_feature (122)..(122): n is a, c, g, or t
  modified_base (351)..(351): a, c, t, g, unknown or other
  misc_feature (351)..(351): n is a, c, g, or t
  modified_base (725)..(725): a, c, t, g, unknown or other
  misc_feature (725)..(725): n is a, c, g, or t
tcagcgtagactagcacgaccggtgctcgatttagcgtcgatctcaggggacccaaaaaccacacccctccttgggagaatccccgtagatcacagctcctcaccatggactggacctggancattccttttcctggtggcagcaggcacaggtgcccacgcccaggttcagtggtgcagactgggctgaggtgcagagccgtggggcatcagtgactgtctcctgacgtaaggccaggtggtattagtacttctacaaacaaaatattggtaattagtaagttgggtgacgacgacggcccccggaagaacgggtcgttaggacggtgggggttagggggttcgggtcgnggtccgggttcgtttacgggaacgggtaacggaccgtaacgtaggttagtcggaccgtaaaccgaaggtacggttacgggaaggggacgtaaggtacgtaccgtaaccggtaaccttaacccggaaccggtaacccaaccccccgaacggaaacctaccgacggttaacctaacggtaactacggtaaccgtaaaccgtggaacccggtacggtacccgtaggtaacggtacgtccgacggtaacccgaccgtacggttacccgtatttaaccgttgtcggtaggttaccgagttagttttcgtttactaggttacctagttaccgttaaagttatttaggtaacgttacgtccttaacgttagtaaccggttnttaccgggtcgtttccggggaaccgggg

SEQ ID NO: 98456 - DNA, 681 bp, Homo sapiens
  misc_feature: GYAE6OF01DT73Z.17.10.A10.1.454.CMB.1.raw
  modified_base (247)..(247): a, c, t, g, unknown or other
  misc_feature (247)..(247): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagacgtggggctggaggtgcagaacgccgtggggcatcgagtgactgtctctgcaaggcagtgatatntctacaacaaatgtagtatagaagttggagcgacgacggaccccgagaggtcgttaggagggttggggtggggtggtacgaggtcggtcgttaggacggtaaggctaacgagtagtcgacgaacgaagtagtaggaaggctaaggacgtacaacgtacgtaaccgaccggaacccaccccgaacgaaccacgtaagtacctaacgctacgaactaacgtacgaaccgtacgtaccggtagaacgtacgtaccgtacggaaccggacccgtacgggttaccttaacgttacgtttacgtcggttacggaacgttaacgttaacgtttccgttttaccgtaggttacccttaagttacgtttaacttaaggtttaacgtcgtacgttacgtacgttacgtacggtaggttcggttaacgttcgggtaacccggggg

SEQ ID NO: 98457 - DNA, 672 bp, Homo sapiens
  misc_feature: GYAE6OF01AKANH.17.10.A10.1.454.CMB.1.raw
  modified_base (378)..(378): a, c, t, g, unknown or other
  misc_feature (378)..(378): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactgggggctgaggtgcagaagcctggggcatcagtgactgtctcctgcaaggccagtggatatatcttacacaaaatatggtatgaattgggtgcgacacggcccccggacgaagggcttggaggtggggtggggtgggtcgaggcggtcgtttgacggtaaggcacgagtactgacgaccgaagagtaggaacgggnaggagtcaacgacttaccgacggaccaccccacgaacacgacgtctacagtcgacaacgtgacgacgccgagacgacgactgaaccggaaccgtaccgggacccgtttacgttaacgtttacgttacgggtacgtaccggtaagttaagtttaccgggtttttctcggttacctaaggtttaccggttaaacttaaggttttacggaaacgttacggggttacccttacggtttaacggttacgggttaaccgtttacggggttaaaccggtttcgggttaaacccgggggggg

SEQ ID NO: 98458 - DNA, 655 bp, Homo sapiens
  misc_feature: GYAE6OF01CITHE.17.10.A10.1.454.CMB.1.raw
  modified_base (577)..(577): a, c, t, g, unknown or other
  misc_feature (577)..(577): n is a, c, g, or t
  modified_base (593)..(593): a, c, t, g, unknown or other
  misc_feature (593)..(593): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcgaggcacgaggtcgcccacgcccaggttcagttggtgcgagacgtgggctgaggtgcagaagccgtgggcagtcagtcgactgtctcctgacaacggccagtggatagtacttactacaacgtaaaattgtaggtatagtaagtttgggagaccgacgaccgggtacccccggaaggtaaggggtcctttgggaaggttgggggtcggggtcggacgaggtcggtcgtttaggacggtaggctaacgagtgtacgcgaacggaagagtacggaaggcgaagtacgtacgacgtacgttaacccggaacggaccccaaccccggaaggaaccctaacggtacgtaaccttacgaagttcggaacctaacgtaggaccggacggtacctaggaccggtagtccgtaagacccgtaccgacggtctacgtacttacgngtacgagtattacttntttgatctagtcgtattagtgtacgattccgtagtacgacgtgtacgtgttcgggtaacggg

SEQ ID NO: 98459 - DNA, 707 bp, Homo sapiens
  misc_feature: GYAE6OF01EVG35.17.10.A10.1.454.CMB.1.raw
tcagcgtagactagcacgaccggtgctcgattttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcagtcagtgactgtctctgcaaggccagtggatatatcttacaacaaatataggtatagtaagttgggtgacgacgaccgggccccccggaagaacggggtcgttaggtggggttggggggtgggggttgggttacggagggtccgggttcgtttacgggaacggggttaaggccgaacgtaaggttacgtcggaccgaacggtaaagaaggttagggaacgggacgaaggaggtaccgacggtaaacgttaccccggaacggtaaaccccacccccgaaagaacccaacgtacgttaacctaccgagttacggaacctaacgtcggaaccgacgtcgtacgaggtacgccgtacggaccgaccgtacggtccgttaactagttactcggtgacgttagtaacgtttcgtttgtcgttacgtagttacgtaacttaagtttagcgttaggttcctaacgttagtacgggtagttccggttcgtttcggggacccgggg

SEQ ID NO: 98460 - DNA, 797 bp, Homo sapiens
  misc_feature: GYAE6OF01AP1LU.17.10.A10.1.454.CMB.1.raw
  modified_base (278)..(278): a, c, t, g, unknown or other
  misc_feature (278)..(278): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctggaggtgcagaagccgtggggcatcagtgactgtctctgcaaggccagtgatatatcttcaacaaaatgtaggtatagtaagttgggngcgacgacggcccccggaagacgggtcgttggagggtggggtgggggtggggtcgaggcgggtcgtttaggacgggttaaggcaagagtacgtcggaccgaaccggaaaggaggtacgggaaaggggcgtaaacgggtacgttacccgaacgggtaaccgtttaaccccgaaaccggggacccccaaccccccggaacggtaaacccgaacgtaacggttacctaacgtaacgtccgaaacccgtaacgtaccgggaacggaaccgtccgtagggaacgtacggtaccgtacgggaaccggtacccggacccggggttacccgttacgtttaccgtttacgttacgggtacggtaccgggttaaagtttacggttttccgtttttacgtacggttaccttacggtttaaccgtttaacgttaaggttttacggtaacggtttacgggttccctttacggttacggttacgggttaacggtttaccgggttaaccggtttcgggggttaacccggggggg

SEQ ID NO: 98461 - DNA, 610 bp, Homo sapiens
  misc_feature: GYAE6OF01BYD6I.17.10.A10.1.454.CMB.1.raw
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (566)..(566): a, c, t, g, unknown or other
  misc_feature (566)..(566): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcgaagccaggtgatatatcttcacaaatntggtatgaattgggtncgacgacggcccccggagaggtctggaggtggggtggggtgggtcgaggcggtcgtttggacggtaaggcgacgagtagtgacaccgaagagtagaaggacgaggagtacgacgactaccgacggacccaccccgaagaaccacgacgtactacgatacgacaacgtagaccgagtacctaggagacgcgtacgaccggacgaaccggccgttactacgttacgtggtgacggtaagtactttgtttccgtgttacacgttacgtaaccgtattttaggacgttaacgggtnttacgtagttacgggtacgttcggtacgtttccgggtacggggg

SEQ ID NO: 98462 - DNA, 726 bp, Homo sapiens
  misc_feature: GYAE6OF01BTPR3.17.10.A10.1.454.CMB.1.raw
  modified_base (280)..(280): a, c, t, g, unknown or other
  misc_feature (280)..(280): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcgagacgtggggctggaggtgcagagccgtgggcatcagtgactgtctcgtgcgaggccaggtgatatatctacaactaaatgtaggtatagtaagttgggncgacgacggaccccgagagggtctaggaggttggggtaggggtcggacgaggtcggtacgttcgggaacggtaacggctacgtagtacgtacgacgaaccggaagtaggtagggaaggtcgaaggtacgtaccgaaggtaccctaaccggaaccggaaccccaaccccgaacgtaaccaacgtacgtacctaacgtacgacggtaacaaccggtacgaccggtacgtaccggtaggacggtacgtaccgtacggaaccgtaccggtaccggtacccgtttatttaaccggttacgttagggacggttaacgttaagttaacgtttcggttttactacggttacctaacgtttacgttaaacgtttaggttcggtaaacggttccgttactttacggttacggttacggttaacgggtacggtttaacgggtcccgggtaacggggg

SEQ ID NO: 98463 - DNA, 659 bp, Homo sapiens
  misc_feature: GYAE6OF01CZFYT.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagctggggcatcagtgactgtctcctgcaaggccagtggatatatcttacaactaaaatataggttataggtaagtttggggtacgtcgaaccgacgggccccccgggaacgaaacggggtcgtttacggagggttgggggtgggggtggggtcgagggtcggtcgtttaggacgggtaaggcacgtagtagtcgacgaccgaagagtaggaagggacgaggagtcgacgtattaacccgacggaacccaccccgacgaacactacgtactaacgatacgacaactagacgacgccgtagagagacgtcggaaccgaacgacggtacccgttacttacgttacgtggtacgacgtaacgttacgttgttttacgttagtcctagttacgtaaacttagtttacgaagttacggtcttacgttacggtacggtacgttacggtacgttcgggtaaccgggggg

SEQ ID NO: 98464 - DNA, 618 bp, Homo sapiens
  misc_feature: GYAE6OF01AHDKK.17.10.A10.1.454.CMB.1.raw
  modified_base (273)..(273): a, c, t, g, unknown or other
  misc_feature (273)..(273): n is a, c, g, or t
  modified_base (503)..(503): a, c, t, g, unknown or other
  misc_feature (503)..(503): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
  modified_base (551)..(551): a, c, t, g, unknown or other
  misc_feature (551)..(551): n is a, c, g, or t
  modified_base (557)..(557): a, c, t, g, unknown or other
  misc_feature (557)..(557): n is a, c, g, or t
tcagcgtagactagcacgaccggtgctcgatttagcgtcgatctcagggggacccaaaaaccacacccctccttgggagaatcccctagatcacagctcctcaccatggactggacctggagcattcctttttcctgggtcggcagcaggcacgaggtcggccccacgcccaggttccagttggtgcagactggggctggaggtgcagaagccgtgggcatcagtgactgtctacctgcaaggccagtggattatatcttacgaactaaaatntaggtattagaagtttgggtacgacgacgaccggtacccccgagaagggtcttggaggtgggtgggtggtcgaggtcggtcgttaggacggtaggctacgagtagtcgacgaacgaagagtaggaacgggcaggtactacgacgtacgtaccgaccggaccctaaccccgaacgaaccacgtacgtacctaacgtatccgaacctaacgtcggaaccgagtccgagacgngacgtcgacgtaccgacgtcctatactgtgngtanagttagttcttcngttacngtacgttacgtaagttgacgttcgcgttacgttagcggttactgggtccgtgggtaccggg

SEQ ID NO: 98465 - DNA, 851 bp, Homo sapiens
  misc_feature: GYAE6OF01B5VQV.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtggggcatcagtgactgtctcctgcaaggccagtggactatatcttacaacaaattagtaggtatgtaagtttgggtcgacggtacgaccggggaccccccggaacgaacgggtctttacgggaggttggggggtacgggggttcgggtacgacggccgggttcgtttaggaacgggttaagggctaacggaggttagtccggactaaccggaaaggtagttaacgggaaaggggacctaaggtaacgtacgtaacggtaacgtttaaccccgaaacccgggtaacccgaacccccccgaaacggtaaacccaaccgtacggttaccttaaccacgttaccgaaccgtaacgtacggaacccgtacggtaccgtggaaaggtacgtccgtacggaacccgtaaccggtaacccgggtcccgttaaccgtttaacgtttaccgttaggttaccggaaccggttaacggttaagttttccggttttttacgttaacgtttacccgtaaacgttttaccgggtttaaacgtttaaaggttttttacgggaaacggtttttacgggtacccgtttaacgttttaacgggttacgggtttaaccgggttaccgggggttttaaacccggtttcccggggggttaaaccgggggg

SEQ ID NO: 98466 - DNA, 694 bp, Homo sapiens
  misc_feature: GYAE6OF01DMUE6.17.10.A10.1.454.CMB.1.raw
  modified_base (134)..(134): a, c, t, g, unknown or other
  misc_feature (134)..(134): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttccnggtggcagcgaggcacaggtcgccccaccgcccgaggttcaggttggtgcagacgtggggctggaggtgacgaggacgccgtggggcatcgagtcgactgtctccngacaggcaggtgatatnttctacgaactaaagtgtagtatagtaaggttgggcgacgaccgaccgggaccccgaggtaacggggtctttagggaggggttgggggtcgggtcggtacgacggtcggttgttacgggacggtagcacggagttagacgtaccggaacgaaggtagtaggaacgggcaacggtcgtacacgtaactacccggaacccggaaccccaacccgtaacgaacctacgaacgttaccaagtacgtacgaaaccgtacgtcgaacggtaccgcgtacggaacgtatccggaacgaaccgaccgtaccggtcccttaagttacgttaccgtgggaaccgttagtaatttagtttcgtttcagtaaccttagttaccgttagtagtttaggcgttcgacttggtacgttccggaacgtttcggtaacgttccggggaacgggg

SEQ ID NO: 98467 - DNA, 626 bp, Homo sapiens
  misc_feature: GYAE6OF01CXH65.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggagaagggcttggaggtggggtgggggtggtcgaggcggtcttttggaacgggttaaggcaacgaggtatcggcaaccgaaggagtaggaagggcaaggagtacacgtattaaccgacggaccaccccgagaacacagtctacatgacaactagacgagcctaggagacgacgtcgacgaccgacgggtacccgtacgttaacgttacgtaggtcgtacggtaagtacgtttcgtttttacgtgttacctagttccgttaaacttaagttttggtaaacgtttacggtcttacgtaagttacgggtacgttcgggttaaccggtttcggtaacccgggggg

SEQ ID NO: 98468 - DNA, 635 bp, Homo sapiens
  misc_feature: GYAE6OF01EKPBT.17.10.A10.1.454.CMB.1.raw
  modified_base (300)..(300): a, c, t, g, unknown or other
  misc_feature (300)..(300): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttacacaaaaatatggtatgaaagttgggtcgcgacgtacggaccccccgggtaanaaacggggtcttgggaacggttggggggtggggtttggggttccgaaggtcgggtcgttttaggaccgggttaaggaccgtaacgtaagtagtcgacgaacgaaagtagtaggaacgggacgagtagtacgaacgtaacgtaaccgaacggaaccacccgaacgaacacacgtacgtactactacgacacgtacgacgacgacgtagacgacgcgtacgaacgacgacgacgtacttacgttacgtcgtacgacgtagtaagttcgtttcgtagtacgtacgttcgtaacttaagttagtacgtacgtctacgtacgtagtacgtcgtacgtcgg

SEQ ID NO: 98469 - DNA, 674 bp, Homo sapiens
  misc_feature: GYAE6OF01A87HB.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcgagtgactgtctcctgcaaggccagtggatatatcttacaacaaaatatggtatgaattgggtgcgacacgggcccccggacaacggggcttggaggttggggtgggggtgggtcgaggcggtcgtttggacggtaaggcacgagtagtggcgaaccggaagagtaggaagggcgaaggagtacgacgtacttaacccgaacggtaacccgaacccccgtacgaaacctacgaacggttacctaaccgagtacgaccctaaacgtacgaccgagaccctaggagacgtacctacggaaccggaactaccgggcccgttagttacgtttaccgtggttcgacggtaacgtaagtttcgttttcgtacgttctaagttaccggttaacttaagtttcggtaagttaccggtacgttacgttagtacggtaaccgttcgggttaccgtttggggtacccgggggg

SEQ ID NO: 98470 - DNA, 292 bp, Homo sapiens
  misc_feature: GYAE6OF01BROA4.17.10.A10.1.454.CMB.1.raw
  modified_base (282)..(282): a, c, t, g, unknown or other
  misc_feature (282)..(282): n is a, c, g, or t
  modified_base (287)..(292): a, c, t, g, unknown or other
  misc_feature (287)..(292): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttcgtgggtgttcggcagtgggaccaagctgaccgtctaggtcagcccaaggctcgcccctggtcactctcgttcccgccctcctcctagtctacgctgagcgggctggcaaggcgnatagnnnnnn

SEQ ID NO: 98471 - DNA, 554 bp, Homo sapiens
  misc_feature: GYAE6OF01DO1FX.17.10.A10.1.454.CMB.1.raw
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatnttcacaaaatatggtatgaattgggtncgacaggcccccgaagaagggctttggaggtggggtggggtgggtcaggcggcttttggacggtaaggcacgagtatgcacgaagatgaaggcagagtcaaagattaaccacggacacccccgaagaacacaagtcctaagactagacaaactgaaacgagacctagagagtcctaggaacacaacggccgtactaattactagcgtcgaagtaattgtttctgtcaatcgttaacaattttcgataggtctataacgtgaacttgggtacttcggtacgggg

SEQ ID NO: 98472 - DNA, 775 bp, Homo sapiens
  misc_feature: GYAE6OF01BPP9A.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctgatggcagcaggcacaggtgccccacgcccaggtttcagttggtgcagactggggctgaggtgcagaagccgtggggcatcagtgactgtctcctgcaaggccagtggatagtatcttacaacaaaagtatggtatgaagttgggtgcgaccgacgggacccccggacgaagggtcttggaggtggggtgggggtggtccgaggtcggtcgtttggaacgggtaaggccaacgtagtacgtcgccaaacccgggtaaagtagtagggaaacgggtaccgaaggtacgttaccgaacgtaaccgtttaacccgaaccggggaacccaaccccccgtaaggaacccaacgtaacggttacctaaacgtacgtacgtaaccgtaaacgtcggaaccggtaccggtaccgtaacggacggtacgacccggttacggacccgggtaaccggtacccggtaaccccggtttacgttaacgttttaacccgtagggttaacggaagttaacggttaaacgtttcggttttacgttacgttaccgtaacgttaccggttaactttaacggttttacgtaacggtttaacggttacccgttaacgtttaggttaaccgggtacctttagggttaacccggtttaccggggg

SEQ ID NO: 98473 - DNA, 768 bp, Homo sapiens
  misc_feature: GYAE6OF01EZEPG.17.10.A10.1.454.CMB.1.raw
  modified_base (273)..(273): a, c, t, g, unknown or other
  misc_feature (273)..(273): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcaggactggggctggaggtgcagaacgccgtgggcatcgaggtgtactgtcctcgtgacgaggccgagtggatagtactcttacaaactaaaagtnttaggtataggtaagttgggtacgacggtaccgaccgggaccccggaaggtaagggtccgtttagggacggggttggggggtcggggttacgggtacggacggtccgggttacggttttagggaacgggttaacggaccgtaacggtaggttacgcgggaacgtaaccgggtaaaggtacgtaaggggaacggtacggaaggtaaccgtaaccgtaaacggtaaaccgttaccggaaacccggtaaccccgtaaacccccgaagaaacccgacgtacggtaacctaacgtacgtacgtaacgtacgtacggacgtacgtaccgtaagacgtacggacgtaacgaccggaccgtacgttaccgtattaccgtacggtacgtacgtaacgtaagttctttacggttacgtcttacgaacgtttacgtactttaaggtacgtacggtacgttacgtacgtacggttacgtacgtcggtacccgttggggaacccgggg

SEQ ID NO: 98474 - DNA, 649 bp, Homo sapiens
  misc_feature: GYAE6OF01A626O.17.10.A10.1.454.CMB.1.raw
  modified_base (284)..(284): a, c, t, g, unknown or other
  misc_feature (284)..(284): n is a, c, g, or t
  modified_base (566)..(566): a, c, t, g, unknown or other
  misc_feature (566)..(566): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggacgccgtggggcatcagtgactgtctccgtgcaaggccagtaggatatatcttacaactaaaatagtggtatagaagttgggtncgacgcggacccccggtagaacggtcgtcggaggtggggtggggtcggtcgaggtcggtcgtttaggacgggtaaggcgtaacgtagtatcggacgaaccggtaagacgtagggaacgggacaggagtacgtacgtaacgttaaccgaacggacccaaccccgaacgtaacacctacgttcaacgtatcggaactaacgtgaacgaccgtcgaggacgacgtcgtacggacggaccgtccggccttaactcgttagtcggacgtagaacgtttattcggttntactcgtacttacgttaacttagttacggtaacgttctcgttacgtagttacggtggttaacggtccttacgggggtaccggg

SEQ ID NO: 98475 - DNA, 676 bp, Homo sapiens
  misc_feature: GYAE6OF01EL3DP.17.10.A10.1.454.CMB.1.raw
  modified_base (259)..(259): a, c, t, g, unknown or other
  misc_feature (259)..(259): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtgcccacgcccaggttcagttggtgcagacgtggggctgaggtgcagaagccgtggggcatcagtgactgtctcctgcaaggccagtggatatatctacacaaatntgtatgtaagttggtgcgacgacggccccggagaagggcttggaggtgggggtggggtgggtcgaggtcggtcgtttggaacgggttaggcacgtagtatgaccgacggaagagtaggaagggcgaaggtacgtacgaacgtacttaaccgacggaacccaaccccaacggaacaaccgtacgtactacgtacgtacgaaccgaacgtggaaccgtagtcccgtaggacgacggtctacggaaccgaaccgacgggtacccgtacgtttaacgttaccgttggtacgacggtaacgttacgttttcggttttactacggtttctaccgtttacgttaacttaaggtttacgtaacggttacgttccgttacgttacggttagggtaccgttcgggttaccgttcggggtaccggggg

SEQ ID NO: 98476 - DNA, 614 bp, Homo sapiens
  misc_feature: GYAE6OF01BM6FU.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagcctggggcatcagtgactgtctctgcaaggccagtggatatatcttcaacaaaatatggtatagtaattgggtgcgacgacggcccccggagagggtcttggaggtggggtgggggtgggtcgaggcggtctttgggacgggtaagggcacgtaggtatggactaccggaaagagtaggaagggcaggacgtacacgaacttaccgaaccggaaccacccccaacgaccactagtactacatacgacacgtagacgacgccgtagagacgtcgtcggaacgtaccggacggccgtataacgttacgtcggagtcgaagtatttcggttttctacgttctagttacgttaaccgttagttacgagtacgtcttacgttgtacgtaacgttcggttcgttcgggtaccggggg

SEQ ID NO: 98477 - DNA, 717 bp, Homo sapiens
  misc_feature: GYAE6OF01A5VTE.17.10.A10.1.454.CMB.1.raw
  modified_base (213)..(213): a, c, t, g, unknown or other
  misc_feature (213)..(213): n is a, c, g, or t
  modified_base (550)..(550): a, c, t, g, unknown or other
  misc_feature (550)..(550): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttcctggtggcagcaggcacaggtgcccacgcccaggttcagttggtgcagacgtggggctgaggtgcagagcgtgggcatcagtnactgtctcgtgcaggccagtgatatatcttacaactaaaatagtggtatacgtaagtttgggcgtacggacgaccgggcccccggtaagacgggtcgttggaggtggggtcggggtggtcgaggcgtcgttaggaggtaacgcaagtacgtagtcgacgaaccggtaagtagacggtaagggcgaacggagtaccaacgtaacgtacccgaaccggaccctaaccccgaacgaacacgacgtactacgacgtccgacaacgtagacgaaccgtagtacgaacggactcggtaacgaacccggtaccgtacccggacccgttattacggttttaacgnggttaaccggtacggtaaagttagttttaccggtttccgtacgttaccgttaacgttaaccggtttaaacgtttaaacggttttacggtaccgggttacgggttaccttacggtttaacgtacgggttacccgttcgggtttaacccgttcggggggtaacccgggg

SEQ ID NO: 98478 - DNA, 709 bp, Homo sapiens
  misc_feature: GYAE6OF01BSO9R.17.10.A10.1.454.CMB.1.raw
  modified_base (441)..(441): a, c, t, g, unknown or other
  misc_feature (441)..(441): n is a, c, g, or t
  modified_base (462)..(462): a, c, t, g, unknown or other
  misc_feature (462)..(462): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtggggcatcagtgactgtctcctgcgaaggccagtggatatctcttacaacaaaatataggtatagtaagttgggtagcgacgaccggccccggacgaacgggcgttggaggtggggtgggggtgggtcgacggcggtcgtttacggtacgggtaacggcgtaacgagtagtcgacgtaaccggaagtagtaggaagggcagagtacgacgtacttacccgacggacccacccccgaanaaccacacgtacctacacgtnaaccaacgtagaaccgtacggcctagaacggtcgacgtacgtaaccggaccgtaaccgggtccttaacttacgttaccgtacggtacggaccgtaagtttactttacggttttacgtcggtttaaccgttaacgtttaccgttaaagtttacgttttaacggtaccgtttacgggtacttttaaccggttacggttacgggtaacccggtttcgggttaaacccggttttcggggaaccccgggggg

SEQ ID NO: 98479 - DNA, 884 bp, Homo sapiens
  misc_feature: GYAE6OF01BTM9D.17.10.A10.1.454.CMB.1.raw
  modified_base (785)..(785): a, c, t, g, unknown or other
  misc_feature (785)..(785): n is a, c, g, or t
tcagcgtagactagcacgaccggtgctcgatttagcgtcgatctcaggggacccgaaaaaccacacccctccttgggagaatcccctagatcacagctcctcaccatggactggacctggagcatccttttcctgatggcagcaggcacaggtgcccacgcccaggttcagttggtgcagactggggctgaggtgcagaagccgtggggcatcagtgactgtctctgcgaaggccagtggatatatcgttacaacaaaatagtaggtaatacgtaagttggggtacgacgacgtacgggacccccggtaacgtaacgggggtcgtttaggtaacgggttggggggttcggggggttacgggggttaccgaacggggtccgggttaccgtttttacggggaaaccggggttaaacgggaccgtaaaccggtaacggttaacggtacgggaaccgtaaacccgggtaaaaggtaaggttaagggaaacgggggaccgtaaaggggtaaccggttaacccgaaaccggtaaaccgtttaaacccggaaaccccgggtaaccccaaaccccccccgaaacggtaaaccccgtaacccgtaacggttaacccttaaaccgaacgttaacggaacccgtaaaccgttacggaacccggtaacggtacccgttaacgggaacgacggtacccgtaacgaaccgggtaacccgtaacccggggtacccgtttaaccgttaacgtttaccgtcgggttacggtacccggtaagttaaccgtttcggttttacgnggttaaccttacgttaccggttaacttaaggtttcgaaacgtttcgggtaactttcggttaacgttacgggtacctttaggttacccggtttaccgggg

SEQ ID NO: 98480 - DNA, 676 bp, Homo sapiens
  misc_feature: GYAE6OF01DY0MP.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctgaggtgcagaagcctggggcatcagtgactgtcctcctgcaaggccagtggatatatcttacaacaaatatggtatagtaagttgggtgacgacgacggacccccggacgaacgggtcttggagggttgggggtgggggtgggtacgaggcggtctttggaacggttaaggcacagtatgcaaccgaagacgtggaagggcgagacgtcgacgtacgttaacccgaacggacccaaccccgacgaacaactacggtacctacaacgttgaacctaacgtacggaacgtacgaccgttagggacgacggtacctaggaacccgaaccgtaccccgtaccccggttactttaaacgtttaacgttcggtacgtaaccgtaggtaacttttcggttttaccgtggttacctaacgttacgtaaactttaaggtttgaacgttaggtccttacgttagtacggtagttacggtcgtttcgggtaaccggggg

SEQ ID NO: 98481 - DNA, 703 bp, Homo sapiens
  misc_feature: GYAE6OF01CQSAC.17.10.A10.1.454.CMB.1.raw
tcagcgtagactagcacgaccggtgctcgatttagcgtcgatctcaggggacccaaaaccacacccctccttgggagaatcccctagatcacagctcctcaccatggactggacctggagcattccttttcctggtggcagcaggcacaggtcgcccacgcccaggttcagttggtgcagacgtgggctggaggtgcagagccgtggggcatcaggtgactgtctccgtgacaaggccagtggatagtatcttacaactaaaatataggtatagtaagttgggtgacgacgaccggaccccggagaacggtgttaggagggttggggtgggtacggcgacggtcggtacgtttacggaacgggttaaggccaacgtaggtacgtcgaaccgaacggaagagtaggaacgggacgtaagtaggtaccaacgtaaccgttaacccgaacccgggaacccaaccccccgtaacggaacccaacgtaacggtacctaacgtactaacgaacccgtaagtaccggaacgaccgaccgtagaacggacgacgtacgacgaaccgacgtccgtactattaccgtgtacgacgtagtagtttcgtttacgtgtacttacgtacgttaaacgttaagttttgaaacggtttccgtactttacggttaacgtacggggttaccttacggttccggtttccggacccggggggg

SEQ ID NO: 98482 - DNA, 667 bp, Homo sapiens
  misc_feature: GYAE6OF01D15G9.17.10.A10.1.454.CMB.1.raw
  modified_base (203)..(203): a, c, t, g, unknown or other
  misc_feature (203)..(203): n is a, c, g, or t
tcagcgtagactagcacgaccggtgctcgatttagcgtcgatctcaggggaacccaaaaaaccacacccctccttgggagaatcccctagatcacagctcctcaccatggactggacctggagcattcctttttcctggtggcagcaggcacaggtcgcccacgcccaggttcaggttggtgcagacgtggggctggaggtgnagaacgccgtggggcatcagtgacttgtcctcctgcgaaggccaggtgattatattctacaaacaaaattagtggtatagtaagttgggtgcgacgaccggccccggaagacgggtcttgggagggttggggggtggggtgggtcgtacggtcggttcgtttagggaacgggtaggactacgtagtagtcgacgaacgaagtagtagggaaggtacgaggacgtacgacgtaacgtaccgaaccggaaccccaaccccgacgaaccacgtactactaacagtcacgtacgacgacgagtccgtagagagcgtacgacgaccgtacggtaccttacgtacgttcgtgtacgacgttaacgtagttttcgttcgtcgttacgttacgttacgttaaattagtttacggtaagttaccggttattacggttaggttacggtacttcggtccgttcggggtaccgggg

SEQ ID NO: 98483 - DNA, 342 bp, Homo sapiens
  misc_feature: GYAE6OF01DEF29.17.10.A10.1.454.CMB.1.raw
  modified_base (141)..(141): a, c, t, g, unknown or other
  misc_feature (141)..(141): n is a, c, g, or t
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (300)..(303): a, c, t, g, unknown or other
  misc_feature (300)..(303): n is a, c, g, or t
  modified_base (306)..(342): a, c, t, g, unknown or other
  misc_feature (306)..(342): n is a, c, g, or t
tcagcgtagactagcacgaccggtgctcgatttagcgtcgatctcagggggttcctgaccgattctctggctccaagtctggcacgtctgccaccctgggcatcaccgcgctccagactggggacgaggccgagtatttcngcgcaacatgggattccagcctgacttctggggtntcggnagtgggaccaagctgacgtcctaggtcagcccaaggctcgcccctacggtaactctcgttccccgccctccgtcctagtctacgctggagtcgggctagggccaaggcgacaatacgannnntannnnnnnnnnnnnnnnnnnnnnnnnnnnnnnnnnnnn

SEQ ID NO: 98484 - DNA, 805 bp, Homo sapiens
  misc_feature: GYAE6OF01CJIEH.17.10.A10.1.454.CMB.1.raw
  modified_base (684)..(684): a, c, t, g, unknown or other
  misc_feature (684)..(684): n is a, c, g, or t
  modified_base (694)..(694): a, c, t, g, unknown or other
  misc_feature (694)..(694): n is a, c, g, or t
tcagcgtagactagcacgaccggtgctcgatttagcgtcgatctcagggacccaaaaaccacacccctccttgggagaatccctagatcacagctcctcaccatggactggacctggagcattccttttcctggtggcagcaggcacgaggtcgcccacgccctaggttcaggttggtgcagacgtgggctggaggtgcagagccgtggggacagtcgaggtgacttgtctaccgtgacgaacggccgtaggtaggattattacttaccttacaaactaaaaattgttaggtaagttaggtaaggtttggggtacgacgtaaccgacccggggacccccggtaggaacggggttcgttaggtaggggttcgggggttagggggtcggtacggtacgggtcgggtttacggtttacgggaaccggggtacggacgtaacggtaaggtacggttaccgaacgaaccgggtaagacggtaagggaacgggtactaaacggacgtaccggaaaccgttaacgtaaccccgaaacccgggaccccctaacccccgggaacgtaaccgtaaccgtaacgtaccgtaactacgtacgaaccgttaaaccgcgggaaccgtacgaccgtaggacggtaccgtacgtaacggacccggaaccggtacgggttacccttaacgtacgttaccgnggtttaccgngttaacgttacgtttcttttacgtgttacccgtatttaaccggtattaggttacctaggttacttccgtagttacggtacggttacttaccgggttgtccggggtaccggg

SEQ ID NO: 98485 - DNA, 769 bp, Homo sapiens
  misc_feature: GYAE6OF01BAKRW.17.10.A10.1.454.CMB.1.raw
tcagcgtagactagcacgaccggtgctcgatttagcgtcgatctcaggggacccaaaaccacacccctccttgggagaatcccctagatcacagctcctcaccatggactggacctggagcattccttttcctggtggcagcaggcacaggtgcccacgcccaggttcagttggtgcagtacgtggggctaggaggtgcagaagccgtggggcagtcagtgactgtctctgcgaaggccagtgatagtactctacaactaaatagtggtatgtaagttgggtgaccgacgacggcccccggaaggtaacgggtcgttaggaggttggggggtggggttacggggcgtaagggtccgggttacgttttacgggaacgggttaacggtaccgtaacgtacggttaacgtcggtaccgaaaccggtaagaacggttaacgggaaggggtaccgtaacggtacggttaaccgaaccgttaaacgttaacccggaaccccgggaaacccctaaccccccggaacgtaaacccaaccgggtaaccgttaaccgttaaccgaacggttaccgaccgtaaacgttaccgggaaccgacgtacccgttaagggaacgtacggtaccgtacggaacccggaaccgtacccgggtccgttactttacgtaccgggttagtaccggacgttaggtactttcgtttacgtcggtactacgttcgtaacttagttaggtcgtaggtcttagacgtttagaccgtttcggttgtcggggtcggg

SEQ ID NO: 98486 - DNA, 624 bp, Homo sapiens
  misc_feature: GYAE6OF01CJ6XT.17.10.A10.1.454.CMB.1.raw
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccaccgcccaggttcaggtttggtgcagacgtggggctgaggtgcagaagccgtgggcatcagtgactgtcctctgcaggccagtgatatntctacaanaaatatgtatagtagtggngcgacgacggcccgagaggtgtgnggtgggtgggtggcgnggtcggtcgttaggacggtacgcagtagtagtacgacgaacgaagtagtaggaggagagacgtacgacgtacgtaccgaccgaacccaaccccgaacgaaccactacgtactaacacgtacgaccgtaacgtacgacgacgacgtagacgacgtacgtacgacgaccggtaccggtaccgttacgttacgtacgtcggtcgtacgttaagtacgtttaggtttcgtacgtacgttacgttacgttaacgttaagttagtacgttacgttcttacgtaggttcggtacgtcggttacggttccggtacgggg

SEQ ID NO: 98487 - DNA, 738 bp, Homo sapiens
  misc_feature: GYAE6OF01BC0CD.17.10.A10.1.454.CMB.1.raw
  modified_base (280)..(280): a, c, t, g, unknown or other
  misc_feature (280)..(280): n is a, c, g, or t
  modified_base (505)..(505): a, c, t, g, unknown or other
  misc_feature (505)..(505): n is a, c, g, or t
  modified_base (530)..(530): a, c, t, g, unknown or other
  misc_feature (530)..(530): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgccctaggttcagttggtgcagacgtgggctggaggtgcgagacgccgtgggcatcgagtgtactgtcctcgtagacgaacggcctaggtggacttataactcttacaaactaaaaagttntaggtattaggtacgtttggagacgaacgaccggaccccggaagaacgggtcgtaggagggttggggtgggtggtacgacggtcggtagtttacgggaacgggtaaggcctaagtaggtacgtggaccgtaacggtaagacgtaggggaacgggcaaggtacgtacgaacgttaaccgtaaccgaaccgacccaacccccgtaagaacaacggtatactaacgtntacgactaacgtcgacgatcggtanacgtacgacgtacggaaccgacgtacggacttacgtacgttaacgtggtacggtaacgtaacggttaacgttcggtttttacgcgtttacccgtaagtttaccgtaaacgtttaagggtttacctaacggttcgggtttaaacctaagggtttaccggttacgggtaggggtttaaccccgttagggttttccggggaaacccggggg

SEQ ID NO: 98488 - DNA, 690 bp, Homo sapiens
  misc_feature: GYAE6OF01ER4X4.17.10.A10.1.454.CMB.1.raw
  modified_base (226)..(226): a, c, t, g, unknown or other
  misc_feature (226)..(226): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
tcagcgtagactagcacgaccggtgctcgatttagcgtcgatctcaggggacccaaaaaccacacccctccttgggagaatcccctagatcacagcctcctcaccatggactggacctggagcattccttttcctgggtggcagcaggcacaggtcgcccaccgcccgaggttcaggttggtgcagacgtggggctggaggtgcagagccgtgggcatcagtgctntctctgcgacggccagtggattatatcttacaaactaaaattatggtatagtaagtttgggtgacggaccgaccgggcccccggaagacgggtctaggagggttggggtgggggtggtcgaggcggtctttggacggtaggcagagtancgacgaacggaagngtaggaggacgagacgtacgacgtagtaccgaccggtaacccaaccccgaacgtaaccaacgtacgtaccgtaactacgtacgacgaacgtcggaacgacgtccggtagagaccggacgtacggaacccgtaccggcccgggttaccgttaccttaagttacggtacgttagggacgtaaggttaaccgttttgtttccgttcgttaactaccgtttaacgttaacgttaagtttgtaaacgttcggttacttaacgttacgtcgggttaaccgtcgggttccgtcgggttaacccggggg

SEQ ID NO: 98489 - DNA, 725 bp, Homo sapiens
  misc_feature: GYAE6OF01BDNQG.17.10.A10.1.454.CMB.1.raw
  modified_base (442)..(442): a, c, t, g, unknown or other
  misc_feature (442)..(442): n is a, c, g, or t
  modified_base (632)..(632): a, c, t, g, unknown or other
  misc_feature (632)..(632): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctgaggtgcagagccgtgggcagtcagtgacttgtctcctgacgaaggccgtaggtggaattacttacttccttactaaactaaaattagttacgggttaataggtaaggtttggggtcgaccggaccgaccgggacccccggaagtaacggggtcttagggagggttgggggtacgggggtgggtcgaggtcggttcgtttaggaacgggtaaggcaacgaggttacacggaccaacggaagaggtaggaacggngaaggacgtacgaacgtacgttaacccggaaccggaaccccaacccccgaacgtaaccacgtaacctactacgtacgtcgaacttacgtaacggaccgtacgccgtaggacgtacgtcgtacggaaccgaccgacggtaccgttacttacgttaacgtggtacgacggtaacgtttatttccggttttanacggttactaacgtttacgtaactttaggttacggtagttacgttacttcggttacgtacggttacgtcggttccggtttcgggtaccggggg

SEQ ID NO: 98490 - DNA, 640 bp, Homo sapiens
  misc_feature: GYAE6OF01C5ORF.17.10.A10.1.454.CMB.1.raw
  modified_base (135)..(135): a, c, t, g, unknown or other
  misc_feature (135)..(135): n is a, c, g, or t
  modified_base (190)..(190): a, c, t, g, unknown or other
  misc_feature (190)..(190): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttccgnggtggcagcaggcacaggtgcccacgcccaggttcaggttggtgcagacgtgggntgaggtgcgaagacgccgtggggcagtcaggtgacttgtccttcctcgcgaacggcctaggtggataagtnttctanaaactaaaatgtaggtatagtaaggttgggagacgacgaccgggaccccgaggaaggtcgtggtagggtggggtggggtggtcgacggtggtcgtttagggacggtaagcaagagtagcgacacggaanagtaggacggagagacgtanacgtactaccgacgaccacccagacanacgtctaacngtcacacgtacgacgtacgacgtgacgcacgacgaccgacgtcgaccttattacgtcgtcgtaggagtaagttagtttcgttagttcgtacgtaacgttacggttacgttaagtttacggtaacggttacgtactttaacgttcgggttaacgtaccggttacgggttccgtggggtaacccggggg

SEQ ID NO: 98491 - DNA, 745 bp, Homo sapiens
  misc_feature: GYAE6OF01EPL0I.17.10.A10.1.454.CMB.1.raw
  modified_base (134)..(134): a, c, t, g, unknown or other
  misc_feature (134)..(134): n is a, c, g, or t
  modified_base (505)..(505): a, c, t, g, unknown or other
  misc_feature (505)..(505): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttccgnggtggcagcaggcacaggtcgcccacgccaggttcacggttggtgcagtacgtggggctgaggtgacagagccgtgggcatcagtgtactgtcctcgtgacgaaggccaggtggtatactatccgttacaaataaaactgtcggttaagtagtacgtttagggtcgaacgacggtaccggcccccggaagtaacgggtgtacggtaggttaggggggtcgggggtcggttgacggtcgggtccgtttaaggaacgggttaacggactaaccgtagtacgtagacccgaaggaaagtgaacggtacgggacaaggtagtacacggtaacttaccgaaccggtaaccccacccgaagaacacgtacgtacacngtacgaccaaggtgaacggcgtacgtcgaagtccggactacggaccgtacgtaccgggtccttaacttacgttaacggtcgaacgttacgaacggtttacttttacggtttcctaacggttctacgtttaaccgggtttaattaacgggttacgttacggtaacgtttaacccggttaggttaacggtaacggggtttaccaacccgggggtttaacttcggggggtaaaccccgggggg

SEQ ID NO: 98492 - DNA, 725 bp, Homo sapiens
  misc_feature: GYAE6OF01BLAUH.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcgcccactccaggttcagttgtgcagacgtggggctgaggtgcagaagcctggggcagtcgagtcgactcgtctccgtacgtacgaacggccgtaaggtacggtattacgttacttaccgtttacaactaaaagtacgttaggtattaggtaggtttcgggtacgtacggacgaccgggtaccccccgggaagtaacggggtccgttaggacgggttgggggttgggggtcgggtcgacggtcggtcgtttaggtacgggtaacgggccaggtagtacgtacggacgaaccggtaagacgtaggaagggtacgagtacgacgtacggtaactaccgaaccggaacccaccccggaacaaccgtacgtacggtactaccgtagtacgaccgtaacgtcggaacgtacgccgtaagacgtcgtcgaacggtaccgacgacgtaccgtacttaacgttcgtacggtaggtacgtagtactttcgttcgtagttacgtagttaacgttacttaagttagtacgtcggttactacgttacgtaggttaacggttcgttaccgggtcggtaccgggg

SEQ ID NO: 98493 - DNA, 747 bp, Homo sapiens
  misc_feature: GYAE6OF01BAR89.17.10.A10.1.454.CMB.1.raw
  modified_base (659)..(659): a, c, t, g, unknown or other
  misc_feature (659)..(659): n is a, c, g, or t
  modified_base (699)..(699): a, c, t, g, unknown or other
  misc_feature (699)..(699): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcccttttcctggtggcagcaggcacaggtcgcccaccgcccaggttcagttggtgcagacgtggggctggaggtgcagacgccgtggggcatcgagtgactgtcctccgtgacgaaggccaggtggtattatattccttacaaactaaaattagttaggtaagttaggtaaggtttggggtagaccggaacgacccgggccccccgggaaaggtaacggggtcggtttagggtaggggttggggggtagggggttcggggtaccggacggcgggttcgttttaggggaacgggttaacggaccgtaacgtaggtactcggaccgtaaaccgggaaagtacggtaagggaacggggcgaacggtaacggtaaccggacgtaacgtaaccccggaaccggaccccaacccccgaacgaacctacgaccttacaactacgtacgaacctaacgtacgaccgacgtccgtagacgacgagtacggacgaccgacggtccttacttacgttacgtggacgtacgtattacgtttgtttcngttacgacgtttacgtaacgtttagttacgtacgtacgtntttacgtacggtttacggaacgttcggttaccggtcgggtaacggggg

SEQ ID NO: 98494 - DNA, 861 bp, Homo sapiens
  misc_feature: GYAE6OF01DKUH1.17.10.A10.1.454.CMB.1.raw
  modified_base (122)..(122): a, c, t, g, unknown or other
  misc_feature (122)..(122): n is a, c, g, or t
  modified_base (133)..(133): a, c, t, g, unknown or other
  misc_feature (133)..(133): n is a, c, g, or t
tcagcgtagactagcacgaccggtgctcgatttagcgtcgatctcagggacccaaaaaccacacccctccttgggagaatcccctagatcacagctccctcaccagtggactggacctggancattcctttcnggtggcagcaggcacgaggtcgacccacgtcccgtaggttcaggttggtgcaggacggtgggggacttggaagggtcgacgacggaacggtccggttcgggggcaagtccggtaaggttacgtaccttcggttccttcccgtaggaccgtaacgggcctaagggttacggtaattaacttacttccttaacgtaaacgtaaaagttcggttaggtaagttaggttaaacggtttcggggtaccgaccgggaaccccggaccggggtaccccccggaaaggtaacgggttccggtttaagggtcggggggttggggggttacgggtacgggtaccggagggtaccggtttaggtttacgggaaacgggtacggaactaacggttagtacgacggtaacgaaacggttagaggtaacgggaaggtcgaaaggtccgtaacgacgtttaccgaacccgggaccgaaaccccaacccgggaagtaacccgtaacgtacctaacgtaacgtacgtaaccggaactaacggtaacgacgtacgtaccgaggtacgacggtcgaccgacgtacccgtacgtcgttaacttacgtacgtcggaacggtacgtttaagttacgtttacgttctagtaccgtttacgtaacggttttaacttagggttaacggtagttacgggtctttacggtaaggttacccggttaggttccgggtacgggtttccgggaacgggg

SEQ ID NO: 98495 - DNA, 735 bp, Homo sapiens
  misc_feature: GYAE6OF01DPK3C.17.10.A10.1.454.CMB.1.raw
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcaggttggtgcagacgtggggctggaggtgcagaagccgtggggcatcagtgactgtctcctgcaaggccagtggatatatcttnaacaaaattntggtatgtaagttgggtgacgacgaccggcccccggagaagggcgtttggaggttgggggtggggtcggtcgaggtcggtcgtttggaacgggttaaggcaacgtaggtagtacggaccgaaccggaagtagtagggaacgggcgaaaggacggtaccgaacggtaaccttaacccggaccggaaccccaacccccgaacgaacctaacctaggtaccctaagacttggaacctaacgtaggaccgacgtactacggagacgtacgacggaacgccggtaaccgggtccttattaacgttccggtagttacggacgttaacgttagtttccgtttttcgacgttaccttacgtttacggttaaaactttacggtttacggtaacgtttaaccgggtaccctttaacggtttacggtttaacgggtacccgttttaacggggttccccgttcgggggttaaaccccgggggg

SEQ ID NO: 98496 - DNA, 890 bp, Homo sapiens
  misc_feature: GYAE6OF01BIDNM.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacgaggtgcccacgcccaggttcagttggtgtcagacgtggggctggaggtgcagacgcgtgggcagtcagtgactgtctccgtgcaagccagtggattatatctacactaaatgttaggtatagtaagttggtgaccgtacgaccggacccccggaagaacgggttcttagggagggttgggggttcgggggttggggttacgacggtcgggttaccggtttaggtaaccgggtaaggtacgaaccgtaaggttacgtaccgaaccggtaacccgtaaggaacggtagggaaacgggacgaacggtaagtacccggtaaaccgtaaccgttaaaccccggaacccgggtaaaccccaacccccggaaaccgtaaaccgaacccggtaacgtaaccttaaccgaacgttaccggaaccctaacgggttaaacgaccggtaaccgtaccgggtaacggtacgggttaaccgaccgttacggaacccggtaaaccccgggtccgggttaacccggttaacttacggtttaacccgtacggggtttaccggacgggttaacccggttacccgggaacccgtaacccggggtaaccggttttcccgggggaccgtacccggggtaaccccgttaccggggtaacccgttacccggggtccccggtttaaccccggttttaccggttaccggttaacccgggggtaccggggtaacccgggtaacgggggtaacccccggttccccggg

SEQ ID NO: 98497 - DNA, 955 bp, Homo sapiens
  misc_feature: GYAE6OF01D1NC4.17.10.A10.1.454.CMB.1.raw
  modified_base (156)..(156): a, c, t, g, unknown or other
  misc_feature (156)..(156): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcncccacgcccagggttcaggttggtgcagacgtggggctgagggtgacaggaacggccgtggggcagtcgaggtagcgtggtcctcgtgacgaacggcctaggtaggaattactaacttccttaacaaacctaaaagttaaggttaggttaagtaaggttaaaggtttggggtacgaccggaaccggaacccgggaccccccgggaacggtaacggggtccgtttagggtagggggttggggggttaggggggttaccggggtaccggacgggtaccggggtttcgttttacggggaacgggtaacgggtcctaacggtacgttacggtacggaaccggaaccggtaaagtagggtaaggggtacggggtacgtaacggtacgtaccggtaacggtaccgtttaaccccggaacccggtaaacccccgaaacccccgaacgtaaaccggtaccgtaaccggttaaccctaacgtaccgttacggtaaccctaaacggtccgtaaaccggggaccgtccggtaaagggtaaccggacggtaacccggttacgggaaacccccggtaccgggtaacccggggtttaaaccccgttacggtttaaccggtttaccgtacggggttacggggaacggtttaacggtttacggttttaccgttttcggtacgtttacgttaaccgtttacgggttaaactttagggttttaacggtaggttacccgggtttacgtaccggttttaacggacggggtttaacccggtttaacggggtcccgtttaacggggggtaacccccggggg

SEQ ID NO: 98498 - DNA, 627 bp, Homo sapiens
  misc_feature: GYAE6OF01BKE06.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcagacacaggtgcccacgcccaggttcagttggtgcagactggggctgaggtgcagaagccgtggggcatcagtgactgtctctgcgaaggccagtggatatatcttacaactaaaatatgtatgaagttgggtgcgacgacggccccggagaacgggcgttggaggtggggtggggtgggtcgaggtcggtcgtttggacggttaaggctacgtagtagtgacgaaccgaagagtggaagggcgagacgtacgacgtactaccgacgaccaccccgacgaacacgacgtactacatacgacaacgtcgacgacgcgtaggagacgacgtacgaacgaccgacggtacccgttacgttacttacgtcgtcgacgtaagttactttcggtttacgtacgttactagttaccgtaacgttaagtttacggtaagttcgtactacgttagtcggttaacgttcggttaccggttcgggtaaccggggg

SEQ ID NO: 98499 - DNA, 748 bp, Homo sapiens
  misc_feature: GYAE6OF01EKRBM.17.10.A10.1.454.CMB.1.raw
tcagcgtagactagcacgaccggtgctcgattttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagccgtgggcatcagtgactgtctcctgcaggcagtgatatatcttacaacaaatataggttatgtaagttgggtcgacgacgtaccgggcccccgaacgaagggtccgttggagggttcgggggttgggggtggggtacgaggtcgggtcgtttttgggaacgggttaagggccgaacgtaggttaacgtcgaccgaaccggaaaggacgtagggaaagggacgaacggaagtaccgaaccgtacgttaaccgaacccggtaacccaaccccccgaacgaaaccgacctaacgttacctaacacgtacgaactaaccgtacgaacgaccgtaccgtagaagtacggaccgtaacggaaccgtaaccggtaccggtaccgtttacgtacgtttaccgttaggttcggtaacgtaacggttaacgttttcgtttttacgtacgttacgttaactttacggttaaacgtttaagttttagaacgtttacgggtcctttacgttaacggttacggtaaccgtttcgggttaccgttcggggtaccggggg

SEQ ID NO: 98500 - DNA, 833 bp, Homo sapiens
  misc_feature: GYAE6OF01AR6IV.17.10.A10.1.454.CMB.1.raw
  modified_base (177)..(177): a, c, t, g, unknown or other
  misc_feature (177)..(177): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttctggtggcagcaggcacaggtcgcccacgcccaggttcaggttggngcagacgtggggctgaggtgcaggaagccgtgggcatcagtgactgtctctgcaaggccaggtgatatatcttacaacaaatagtaggtatgtaagttgggtcgcgacgacgggcccccggagaagggtcttggagggtcgggtggggtacggtcgacggcggttcgtttagggaacggtaagggcctaagtaggtaactcggaccgaaccggtaaagtacgtagggaacgggtcgaaacggtacggtaactaaaccggtaacgttaaacccgaccgggtaaaccccaaccccccgaaacggaaccgttaaccgaacgttaccgtaaacccgagttacggaaacccgtaaccgttaacggaaaccgggtacgtaccccgggttaaagggaccgttaaccgggacgttaaccgggaaaccgggtaacccgacgggggtttaaccccttaacgttaaccggttttaaaccggtccgggttaccgggtaaaccggttaagggtttaacccgttttcgggttttaccgttacgttaccgtaacggttttaacccggtttaaatttaaccggttttaacgacggttttaccgtaacgtttacgttaaggggttaccgtaaccggttcggggttaacccgttacgggggttaacccgggggg

SEQ ID NO: 98501 - DNA, 605 bp, Homo sapiens
  misc_feature: GYAE6OF01ADLB9.17.10.A10.1.454.CMB.1.raw
  modified_base (256)..(256): a, c, t, g, unknown or other
  misc_feature (256)..(256): n is a, c, g, or t
  modified_base (464)..(464): a, c, t, g, unknown or other
  misc_feature (464)..(464): n is a, c, g, or t
  modified_base (524)..(524): a, c, t, g, unknown or other
  misc_feature (524)..(524): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattgggtgcgacacggcccccggacaaggggcttggagtggggtgggtgggtcaggcggtcgtttggacggtaaggtcacgagtatgacaaccgaagatggaagggcaggtagtacacgtacttaacccgacggaaccacccccgaagtaacacacgtactaacatacgacaactggaacgacgacctgacgagtaccgngaaccgaccgacgggtccttactagtttactaggtacggcgaagttaacttcggttttcnggttaccaagttccgttaataagttttgagttaacgggctttacgtagttacggatttcggttacgttcgggtaccggggg

SEQ ID NO: 98502 - DNA, 694 bp, Homo sapiens
  misc_feature: GYAE6OF01AOBTL.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctaggtggcagcaggcacaggtgcccacgcccaggttcagttggtgcagacgtgggctgaggtgcagaagccgtggggcatcgagtgactgtcctcctgcaaggccagtgatatatcttacactaaaatgtggtatggaatttggggtgcgacgtacgggccccccggaacaacggggtcctttggacgttggggtggggttgggtcaaggtcggtctttggacggtaaggcacgagtatcggaccgtaacccggaagagtacgggaaaggggtccaaggacggtacgaaccggtaacgttaaccccggaccggtacccaccccccgtaacgaacccgacgacgtaccctaacgactcgaccgtaacgtacgaacggtacgccgttagaacggcgtaccgtacgaaccgaccgtaaccgggccttaactacgttactcggtacgacggtaagtaaccttggttttccgagttccgtattacccggttaacttaggtttacggacgttaccgggtacttacgtaggttacggtacggtggttaccgttcggggtaacccggggg

SEQ ID NO: 98503 - DNA, 696 bp, Homo sapiens
  misc_feature: GYAE6OF01DR2CE.17.10.A10.1.454.CMB.1.raw
  modified_base (181)..(181): a, c, t, g, unknown or other
  misc_feature (181)..(181): n is a, c, g, or t
  modified_base (573)..(573): a, c, t, g, unknown or other
  misc_feature (573)..(573): n is a, c, g, or t
tcagcgtagactagcacgaccggtgctcgatttagcgtcgatctcgaggggacccaaaaaccacacccctccttgggagaatcccctagatcacagctcctcaccatggactggacctggagcattccttttcctggtggcagcaggcacagtgccacgccaggttcagttgtgcagtacngggctgagtgcagagcgtgggcatcagtgactcgtctcctagacgtaggcctaggtggtattactacttcgttacaaactaaatagtgggtaataggtaagtttgggtcgacgaaccgacgggtacccccggtagaacggggtactttagggagggttcggggggttacgggggtacgggtaccgacgggtcgggttactttacggggaaccgggttaaggaccgtaaccgaggttaacgtcggaaccgtaacggaaaggtacgttacgggaacgggactaacgggtagttaccgaacggttactaaccgaacggaccctaaccccgagtaaccgactacgtaaccagactacggactaacgtgacgtacgactcggagacgtcaagaaccncgtaccgtaccgtacttaagttctacgtcggactaacggtatttaggtttcctcggtattcgtaaggttaactaagtttcgaagtcgtcctagtccgagtcgttacgtcgttcgggaaccggg

SEQ ID NO: 98504 - DNA, 762 bp, Homo sapiens
  misc_feature: GYAE6OF01A4C2M.17.10.A10.1.454.CMB.1.raw
  modified_base (250)..(250): a, c, t, g, unknown or other
  misc_feature (250)..(250): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaggccagtgatatatcttcaanaaatatggtatgaagttgggtacgtcggaacctacggggaccccccggaacgaaacggggtcgtttggagggttggggggttcggggggttgggggtacgaacgggtccgggtcgttttacgggaacgggttaacgggtaccgtaacgtaggtaagttcggacccgaacccgggaaaggtaagttacgggaaacggggtcgaagggtaacggtacgtaaaccgtaaccgtttaacccgaaccgggaacccaaccccccgtaaacggaacccaacgtaacgttacctaacgagtaccgacaacgtaccggaacgtacgtaccgtagaacgacgaccgtagaaccggaccgtaccggtccgttaccgttaacgtttacgtcggttacggcgtaaggttactttaggttttctaggttacctaacggttacgttaaaccttaaggtttaacgaggtttaccgtacgttacttacgggttacggtacttaccggggtcctttggggaacccggggg

SEQ ID NO: 98505 - DNA, 736 bp, Homo sapiens
  misc_feature: GYAE6OF01EMNJR.17.10.A10.1.454.CMB.1.raw
  modified_base (235)..(235): a, c, t, g, unknown or other
  misc_feature (235)..(235): n is a, c, g, or t
  modified_base (299)..(299): a, c, t, g, unknown or other
  misc_feature (299)..(299): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcgcccacgccctaggttcagttggtgcagacgtgggctgaggtgcgagacgccgtggggctatcgatcgtactcgtctcgngtacgacggccagtggattacttatacttacaactaaaatgttaggttagtagtaaggttgggngtaccgacggacccggccccgaaggtaacgggttcgttaggacgggttgggggtggggtcggtacggaggtcggtcgttttagggaacgggtagtcgaacgtaggtctcggacctaacggaagttgacgggtaaggacgtaaggtacgtacgacgttaaacccgtaaccggacccggaaacccgtaccccgaaacgtaacgtaaccgtacgtacctaacgacgtacgacgtaaccgacggtaccggacgtcgtacggacggtaaccgcgttaacggaacccaccggtaaccggtacgtaaccgttacgttacgtacggtcgtaacggttacgttacgtttacgtttcgtagttaccgtaacgtttacgttaacgttagttcgtaagttacgtacttaccgtagttacgtacgttgggtaccgttgggtaacccgggg

SEQ ID NO: 98506 - DNA, 842 bp, Homo sapiens
  misc_feature: GYAE6OF01D8ZWR.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagctatccttttcctggtggcagcaggcacgaggtcgcccacgcccaggttcaggttggtgcagtacgtggggctggaggtgcgagaacgccgtggggacatcgagtgtacttggtcctccgtagacgaacggccaggtggattatattcttaacaaactaaaattagttaggttaataggtaaggttgggtcggacgaccggtaccggacccccggacggtaacgggtcgtttagggtaggggttggggggtagggggttggggtacagggggggggggggtctttcggtttagggtaacgggtaacggacgtaacggtaagttacgtacgaacgaacggtaacgggtaaggtaacgggaagggacgtaaggtacggtaaccgaaaccggtacgttaaaccccgaaccggaaccccaacccccggaaaccgaaaccgtaaccgtaacggttaaccactaacgtacgaaccgtaacggtacgaacccggtacggacccggtaggaagtaaccggtccgtaacggaaccggtaccccggaaccgggtccgtttaccttaggttaccgttggtaaccggttagtaacgttgttttaacggtttcttaccggtttaccgtaacgttttacgtaaacgttaggttttaaggtacgttaacggttccgttacgttaacgggttaggttacccggttcgggttaaccggtttcggggtaaccccgggg

SEQ ID NO: 98507 - DNA, 645 bp, Homo sapiens
  misc_feature: GYAE6OF01D1IS8.17.10.A10.1.454.CMB.1.raw
  modified_base (375)..(375): a, c, t, g, unknown or other
  misc_feature (375)..(375): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtgcagcaggcacaggtgcccacgccctaggttcaggttggtgcagacgtggggctgaggtgcaggaagccgtggggcatcgagtgactgtcctcgtgacaacggccaggtgtatatatcttacaataaatagtaggtatagtaagttgggtcgacgacgaccggaccccggagaacggtcgttggagggtgggggtggggtcggtcgcggcggtcgttacgggaggtaaggacgaacgngtacgcgacgaacggtaaggataggaagggtacaggacgtacgaacgtactaccgaaccggacccaaccccgaacgaaccacgtacgtacaactacgacgacaacgtcgaacgcgacgtgagtcacgacgacgacgcgtcctattacgtctggtacgacgtagttacttgtttactacgtacgtacgttaacgttaacttaattacgtagtttacgtcgtttacgttacgtacggtttcggttacgttccggttacggttacccgggggg

SEQ ID NO: 98508 - DNA, 854 bp, Homo sapiens
  misc_feature: GYAE6OF01ETVFU.17.10.A10.1.454.CMB.1.raw
tcagcgtagactagcacgaccggtgctcgattttagcgtcgatctcaggggacccaaaaaccacacccctccttgggagaatcccctagatcacagcctcctcaccatggactggacctggagcattccttttcctggtggcgagcgaggcacgtaggtcgcccaccgcccgtaggttctaggttggtagctaggacgttgggggcttggaggtcgacgaaggtaacggccggttggggcaagtcgtaggtgtacgttcggttccgttccgtacggaccgaacggtcccgtaggttaggtaacttaacgttaaccttcgtttaactaaaacctaaaagtttagttaggttaagtaggtttaacggtttacggggtcgaaccggtaccggaacccggggtacccccgggaaggtaacggggtcggttaggggtaccggggttggggggttcgggggtagggtcgtacgggtcgggttacggttaggaacgggttagacgtacgagttcgacggaccgaaacggtaggacggtaaggacgggtagtaaggtcgttaaccggacgttaacgtaaccccgaccggaaaccccctaacccgaacgtaacgaacccgttacgtaaccgtaacgtacgtacgacaacggtacgaaccgacgtaccgtaggaacgacgtaccgtaccgaacgccggtaccggacgttacggttaactacgttcggacgtaacgacgtttacgtttcgttaaggttcttacgtacgtttaacgttaacgttaaggttagtcgttaaacggtcgttttaaacggtacggttacgtttacggtaccgggtttaccgtttcgggggtaacccgggg

SEQ ID NO: 98509 - DNA, 671 bp, Homo sapiens
  misc_feature: GYAE6OF01EFKUY.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattcctttttcctggtggcagcaggcacaggtgcccacgcccaggttcagttggtgcagacgtggggctggaggtgcagaagccgtgggacatcagtgactgtctctgcaggccagtgatatatcttacaactaaaatgtaggtatagtaagttgggtgacgacgacgggcccccggagaacgggtcttggagggttgggggtgggggtggtcgaggcggtcgtttggacggtaggcacgtagtacgtgacgaacggaagtagtaggaagggcgaaggtacgtacgacgtacgttaaccgaccggaacccaaccccgaacgaacacgaacgtactaacacgtacgaactaacgtacggaacgacgtaccgtaggaacgacgacgtacggaaccgaaccgtaccggtccgtttaacttacgtttacgtaggtacgacggttaagtacgttttgtttacgtcgttacgtacgtttaacgttacttaagtttaggtacgttacgtcttacgttacgtacgggtacgttcggttaccgttcgggtaccggggg

SEQ ID NO: 98510 - DNA, 608 bp, Homo sapiens
  misc_feature: GYAE6OF01A6Y0S.17.10.A10.1.454.CMB.1.raw
  modified_base (153)..(153): a, c, t, g, unknown or other
  misc_feature (153)..(153): n is a, c, g, or t
  modified_base (221)..(221): a, c, t, g, unknown or other
  misc_feature (221)..(221): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (570)..(570): a, c, t, g, unknown or other
  misc_feature (570)..(570): n is a, c, g, or t
  modified_base (576)..(576): a, c, t, g, unknown or other
  misc_feature (576)..(576): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtncccacgcccaggttcagttggtgcagacgtggggctggaggtgcgagaacgccgtgggacatcgagtnacgtgtcctcgtgcagccgagtgatatatctacaataaatgtagtatgaagttggtagcgacgacggacccgaagacggtctggaggtggggngggtggtcgagtcggtacgttggacggtaagcgaagngtagccgaacacgaagtagtaggaacggcaagtacgtaccgtaacgaacttaccgacggtaaccccaacccgaacgtaacgacaacggtacctaacgacgtacgaacgtaacgtcggaacgtacgacgtaagacgacgtccgtaacgaccgacgtaccggcttactattacgtcggtgactagtattgttacgtgtactagtaccgtaagttagtagtntacgtnttacgtcgtagtacgtacgtgttcggacgggg

SEQ ID NO: 98511 - DNA, 707 bp, Homo sapiens
  misc_feature: GYAE6OF01C4IEG.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgccctaggttcagttggtgcagacgtggggctggaggtgcagaagccgtggggcatcgagtgacgtgtctccgtgcgaaggtcttcgtggtacttctacgtttacctactagtagtatcaacggttgggtcgccgtccgacggccgtcgtacggaaccaaccggaccgtggaggtggagtggggtagtcggggtaccgaaacccctaagtcgtgggtcgtacgtacgtgttacgttcctaccgtaccctaccgtcccggtaccgggaactacgtaaccttaaccgagtaccgaacccgtaacgtaacccgtccctaacctaactaaaccgaactacgtacctacgtaagtacggtagtacgggagccgtacgtacgtacctacgttccgacggtaaccggtaccgtacccgggtaccgttacttacgtttcgtaggtcgacggtaacgtacgtacccgacgtccggtaccggtagaccgcccgtaaggccgtacggtccggtttacgttcggtaaccgttcgggccgggaccggagggtccgtcccgg

SEQ ID NO: 98512 - DNA, 839 bp, Homo sapiens
  misc_feature: GYAE6OF01AVNCJ.17.10.A10.1.454.CMB.1.raw
  modified_base (132)..(132): a, c, t, g, unknown or other
  misc_feature (132)..(132): n is a, c, g, or t
  modified_base (153)..(153): a, c, t, g, unknown or other
  misc_feature (153)..(153): n is a, c, g, or t
  modified_base (349)..(349): a, c, t, g, unknown or other
  misc_feature (349)..(349): n is a, c, g, or t
tcagcgtagactagcacgaccggtgctcgatttagcgtcgatctcagggacccaaaaaccacacccctccttgggagaatcccctagatcacagctcctcaccatggactggacctggagcattccttttcnggtggcagcaggcacaggtcncccacgcccaggttcagttggtcgcgaggacgtggggctggaggtgcaggaacgccgtgggcagtcagtcgacttcgtccctgacacggcgtagtaggatatactcttacgaactaaatagtgtacgtagtagttggacgcgacggaccggacccggacgtaacggtggtcggtagggtggggtggggtcggtcgnggtcggtcgttaggacggtaggactagtagacgtcgacaacggaagtacgaggacggcaagtacgtacacgtaccgtaccgaacccggaccgaacccccgaacgaaccgaccggtataacccgtacgtaacgcgtaaccgtaagaccggtaggtaccggactccgggaaagtaacccgtcgtaacggacccgggtaacccgtaccgggttacccgtttaaacgttaaccgttacccgggtttaacggtacgggtaacggtttaaaacccgtttcggttttttaaccggttaaccggtttccggtaaacttaaccccggggtttttaaaacggttaaacccgttttaaccgggggtttaagttacggggtttttaaaccccgaaacgtttttcccggggtaaacggttttcccggggttaaaacccgggttttccggttttaaacccggggttcccgggggttaaaacccgggggggtaaaccccccgggg

SEQ ID NO: 98513 - DNA, 729 bp, Homo sapiens
  misc_feature: GYAE6OF01A9RTJ.17.10.A10.1.454.CMB.1.raw
  modified_base (338)..(338): a, c, t, g, unknown or other
  misc_feature (338)..(338): n is a, c, g, or t
  modified_base (475)..(475): a, c, t, g, unknown or other
  misc_feature (475)..(475): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcgcccacgcccaggttcagttggtgcagacgtgggctggagtgcgagagccgtgggcagtcgagtgactgtcctcgtgacgaacgccgtaggtggattagttactacttacaaactaaaattagtaggttagtagtaaggttggtcgacgaccggaccggaccccggacgaagggtcgttaggnggtggggtcggggtgggtcgaggtcggttacgtttggacggtaacggacgacgtaggttacgcgaacgacgtaaggagtaggaagggtacgaggtaacgacaacggtactaacccggaaccgacccgaaccccgaanaaccgtacgaccgtactaacgtaacgtcgaaccgtaagtaccggaacgtacgacgtaacggtacgcgtaacgtacggaaccgtaaccgggtaccggttccgttacgttactacggttaggtcgtaaacggtaggtttacgtttcgtttacgtacgttacgtaacgttacgtttaaagttaaggttacgtttacgtaccgggtttatacggttacggttaggtccgttacgggttccggttaccggtaccggggg

SEQ ID NO: 98514 - DNA, 1002 bp, Homo sapiens
  misc_feature: GYAE6OF01ESZNZ.17.10.A10.1.454.CMB.1.raw
  modified_base (187)..(187): a, c, t, g, unknown or other
  misc_feature (187)..(187): n is a, c, g, or t
tcagcgtagactagcacgaccggtgctcgatttagcgtcgatctcaggggacccaaaaaccacaccctccttgggagaatcccctagatcacagcctcctcaccatggactggacctggagctattccttttccgtggtggcagcaggcacgaggtcgcccgacgacccgtaggttctaggtttggngacgacggacggtgggggcttaggagggtcgacgaggaacggtccggtggggacctagtccgaggttgtaccgttcgttcccgtaccgtggaccgaacgggtaccgtaggtaggttaacttacgttaccttaccgtttaacaaaacgttaaaaagttacggttaggttaagttaaggttaacggtttacggggtacgtaacccggaaccggtaaccccgggggaccccccggtaaagggttaacggggttccgtttaagggggttcggggtttcgggggggttacggggggttacgggttaccggaacggggttccgggtttacggttttaaggggaaaccggggttaaggtaccgtaaccggttaaggtacggtaccggtaaccggaaaccggtaagggtacgtaacggggaacgggtaacgaaggtaaccggtacgtaaaccggtaaccgttaacccggaacccggtaacccccgaaaccccggaaacggtaacccgtaacccgtaccgttaaccgtaacgtacggtaagaacccgtaacggtaaccggtaaccggtaaccgccggttaaggaaccggtacggtaccgttaaccgggaaccggtaacccgtaccgggttaccctttaacggtttaaccggttacggttacggtaaccgtttaacgggtaagttttaaccgggtttcgttttaaccggtcttaaccggtaaccgttttaaccggttaactttaaggttacggtaacgtcgggtttacctaccgggttaggtacgggtttagtaccccggggttaagttcccggggtaacggggg

SEQ ID NO: 98515 - DNA, 931 bp, Homo sapiens
  misc_feature: GYAE6OF01A9PTX.17.10.A10.1.454.CMB.1.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtcgcccacgcccaggttcagttggtgcagacgtggggctggaggtgcagagccgtggggcagtcagtgactcgtctctgacgaggccagtggatatactcttacaactaaaatagttaggtaagtagtaagtttggggtacgaccggaaccgaccgggaccccccgggaacgtaacggggccgtttaggggacggggttgggggggttacggggggttggggttaccgacggggtccgggttaccgggttttacgggaacgggggttaaacgggacccgaaacgtaacgggttacggtacgggtaacccgtaaccgggtaaagggtaacggttaacgggaaacggggacgtaacgggtaacggttaacccggtaaccggttaaacccgttaaaccccggaaaccccgggtaaacccccgaaacccccccggtaaacgaaaccccgaaccgtaaccgggttaaccccttaaccggaacgtttaccggaaacccgtaaacggtaccggtaacccgggtaaccggtacccccgtaggggaaaccggtaccgtacccgtaacgggaaccccgggaacccgtaacccggggttccctttaaccgttaccgtttaccggtacgggttaccggtaacgggttaaaccgttagttttaccggttttacacggttaccgtacgttaaaccgtttacgttaagttttacggtaacggtttacggtacctttacgttaaccggttagggttaaccccgtttagggttaccccggtacggggttacccggggg

SEQ ID NO: 98516 - DNA, 719 bp, Homo sapiens
  misc_feature: GYAE6OF01CYCIP.17.10.A10.1.454.CMB.1.raw
  modified_base (123)..(123): a, c, t, g, unknown or other
  misc_feature (123)..(123): n is a, c, g, or t
  modified_base (134)..(134): a, c, t, g, unknown or other
  misc_feature (134)..(134): n is a, c, g, or t
  modified_base (156)..(156): a, c, t, g, unknown or other
  misc_feature (156)..(156): n is a, c, g, or t
  modified_base (184)..(184): a, c, t, g, unknown or other
  misc_feature (184)..(184): n is a, c, g, or t
  modified_base (204)..(204): a, c, t, g, unknown or other
  misc_feature (204)..(204): n is a, c, g, or t
  modified_base (565)..(565): a, c, t, g, unknown or other
  misc_feature (565)..(565): n is a, c, g, or t
  modified_base (594)..(594): a, c, t, g, unknown or other
  misc_feature (594)..(594): n is a, c, g, or t
  modified_base (610)..(610): a, c, t, g, unknown or other
  misc_feature (610)..(610): n is a, c, g, or t
  modified_base (618)..(618): a, c, t, g, unknown or other
  misc_feature (618)..(618): n is a, c, g, or t
tcagcgtagactagcacgaccggtgctcgatttagcgtcgatctcaggggacccaaaaaccaccacccctccttgggagaactcccctagatcacagctcctcaccatggactggacctggancattcctttcnggtgcagcgagcacgcggtccncccgaccgcccgtaggtcgtaggttggngcgaggcggtgggacgtggnggtcgagacggacgtccggtgggcagtcgaggtcacgttcgtcctcgtagacgaacgcggaagtagtagtactattactaacaaactaagttaggtagtaagtttaggtaaggttcggccgaacggtacccgggaccccggggtaccccgacggtacgggtacggttggtacgggggttcggggggtacggggttcggtcggaccgggtttcggttaacgggttaacggggacgtaccgggacgtaaggtagttacggaccgaacggtaacggtaaggtaggaacgggagtacgaacggttacgactaaccgtaacgaaccccgaacgaacccccaacgaacgacgaactactaccaacgngtacgactagcgaacgccaggtacagccngacgacgtccggtacngttacgtntacgtcgagtcgtacttacgtttgtctagtccgtaagtttaccgaaatttgcgtagttctacgttcgtacggacttacggttacgtagggttcggaccggg

SEQ ID NO: 98517 - DNA, 758 bp, Homo sapiens
  misc_feature: GYAE6OF01B20EE.17.10.A10.1.454.CMB.1.raw
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (685)..(685): a, c, t, g, unknown or other
  misc_feature (685)..(685): n is a, c, g, or t
tcagcgtagactagcacgaccggtgctcgatttagcgtcgatctcagggacccaaaaaccacacccctccttgggagaatcccctagatcacagctcctcaccatggactggacctggagctattcccttttccgtggtggcagcaggcacgaggtcgcccacgccctaggttcgaggttggtgcgagtacgtggggtctggaggtcgcgaggaacgtccggtgggactatcgtagtcgacgtgttcctcgtgacgaacgcgagtgatatntctanaagtaaatgtagtatagtagttggngacggaccgtaccgggccccggtaagacggtgttggtagggtgggggttaggggtcggtacggacgggtcggttacggtttagggaacgggtacgacctaggtagtacgtacggacgaacggaggtaggtaggggaaacggacgaacgggtactaaccggtaccgtaaaccgtaaccccggaaccccgaaccccgaaacccccgaacgtaacccgtagtaaccgttacccagtaaccggtaccaacgaaccggtaggtaaccgacgtcgtaacgacggtaccgtaccgtacggaaccgtaacccggcggttaaccccgttagttaacccgttcggtgtaaccggtgtaacgtttgtttacgttcgaacttcgagtttaaccgtnttaaggttgttaacccgtgtacccgttagttaccgggtcgttaagtccgggtttccgggttccgggaacgggg

SEQ ID NO: 98518 - DNA, 809 bp, Homo sapiens
  misc_feature: GYAE6OF01BIUTK.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccgtaggttcaggttggtgcagacgtggggctggaggtgacgagaacgccgtggggcagtcgagttgactcgtcctccgtgacgaacggtccgtaggtaggattacgtacttacgttacaaactaaaatagttaggttataggttaaggttcgggtagtaccggaaccggacccgggacccccggtaacggtaaggggtccgtttagggaggggttggggggtacgggggtagggtccgacgggtccgggttacgttttacgggaaccgggttaagggccgtaaacgtaggttacgacggaccggaaccggtaaggtaaggtacgggaacgggacgtaaggtacggtaacgaacgtacgttaaaccccgaacccgggaacccccaaccccgaaccggaacctaacgtacggttctaacgactacggaacctaacggtacgaaccgtacgaccgtaggaacgacgtaccgacggtaaccgacccgtaccgggtaccttaactttacgttacgtcgggtaacgtacgttacgttacgttttacgtttcgtacgttactacgtttaagttaacgttaagttttacggcgttaacggttcttaaggttacgtacgggttagttaccgggttccgttacgggggtacccggg

SEQ ID NO: 98519 - DNA, 769 bp, Homo sapiens
  misc_feature: GYAE6OF01D1DAD.17.10.A10.1.454.CMB.1.raw
tcagcgtagactagcacgaccggtgctcgatttagcgtcgatctcagggacccaaaaaccacacccctccttgggagaatcccctagatcacagctcctcaccatggactggacctggagctattcctttttcctggtggcagcaggcacgacggtcgcccacgccctaggttcgagttggtgcagtacgtgggctggaggtgcagagccgtgggcatcagtgtacgtcgtccttaccgtgaccgaaggccgtaggtgtatacttactacttacaataaattaggtagttagtagtaggtttggagacggaccgacggacccccggagtacgggtcgttagggagggttgggggttcgggggtgggtcgacgggtcggttacggtttagggacgggtaacgctaacgagttgacggacgaaccggaagtacggtaggaacggtagaagtacggacgacgtaaccgaccgtaaccggaaccccgaaccccgacgtaaaccgaccggttacttaacgactaacggtgtaaccaaccggtgaaccgtcgtacggttacgacggacgtcgaccggaaccggaaccgtccgggtaacctttaccggttattcgggttagccgggttaacgtagtttaggttttccgtttttcgtaccgttaacttccggtttaaacgtttaccgttttaaggttcgtaaccggtttaccgttctttacgtacgggttaccggtaccggtttaacgggttacccggttcccggggtaaccggggg

SEQ ID NO: 98520 - DNA, 726 bp, Homo sapiens
  misc_feature: GYAE6OF01BZ6NR.17.10.A10.1.454.CMB.1.raw
  modified_base (660)..(660): a, c, t, g, unknown or other
  misc_feature (660)..(660): n is a, c, g, or t
  modified_base (686)..(686): a, c, t, g, unknown or other
  misc_feature (686)..(686): n is a, c, g, or t
tcagcgtagactagcacgaccggtgctcgatttagcgtcgatctcaggggaacccaaaaaaccaccacccctccgttgggagaactcccctagatcacagctcctcaccatggactacggaccgtggagtctacttccgttttccgtgggtcggcgagcgaggcacgaggtcgcccaacgccgtaggttacaggttggtacgacgacggacggtgggctggaggtgacgaaggaacgccggtagggactaacgtcgagtcgacgtcgtctcgcgacggacgtcgtaaggtgaattactacgtaccttaagaaactaaaagtagtagtagtagtaacggtgggtacgaccggaccggaccggaacccggtacggaacggtacggtttagggaggggttcgggggtacgggtcgggtacggtacggtaccggtttacggtacgggtaacggacggtaccgaaagtgaacggtacgaacgaacggtaaacgaggtaacgggaagacgtaacggacgtacgaactaacgtaaccgaccggaccctaaccgacgtacaacgtcgactaacgctaacgacgtaacgaacgtacggactcggagtagacgacgtacgacgcgacgttcgtattcgtaccgtgtacgtacgtaagtcttacggttccnggtacaccttaagtactagtggtacncgttaaccgtatacggacgtaccgtgcggttacgggtcgg

SEQ ID NO: 98521 - DNA, 738 bp, Homo sapiens
  misc_feature: GYAE6OF01B5NYQ.17.10.A10.1.454.CMB.1.raw
  modified_base (121)..(121): a, c, t, g, unknown or other
  misc_feature (121)..(121): n is a, c, g, or t
  modified_base (504)..(504): a, c, t, g, unknown or other
  misc_feature (504)..(504): n is a, c, g, or t
tcagcgtagactagcacgaccggtgctcgatttagcgtcgatctcaggggacccaaaaaccacacccctccttgggagaatcccctagatcacagctcctcaccatggactggacctggancatccttttcctggtggcagcaggcacaggtgcccacgcccgaggttcagttggtgcagacgtgggctgaggtgcagagccgtgggcatcagtgacgtgtctctgcaaggccagtgatatatcttacaactaaaatgtagtatagtaagttgggtagcggaacgaccgggacccccggaagaacggggtcgtttaggagggttgggggtgggggttcggtacggacgggtcgggttcgtttacgggaacggggtaacggacgaagttacggtagtacggaccgtaaccggaaagacgtagggaacgggacacggacgtacgaaccggttacgtaaccccgaccggtaacccaacccccgaagaaccacgtacggtacctaacncgtacgacctaaccggtacgaacgtaccggtaccgtaggacgacgtcgtacggaacccgacgacgggtccctacgtttacgtacgtggtacggacgttaacggttagtttacgttttccgaggttaacttacggttaactttaaaccggtttaagtttcggtaaaggttacccggttacttacgttagggtacggttagttccggggttaccgtttccgggggtaacccggggg

SEQ ID NO: 98522 - DNA, 935 bp, Homo sapiens
  misc_feature: GYAE6OF01EGJXH.17.10.A10.1.454.CMB.1.raw
  modified_base (209)..(209): a, c, t, g, unknown or other
  misc_feature (209)..(209): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgccacgcccaggttcagttggtgcagacgtgggctgacggtgcagagccgtgggcntcgagtgactcgtctcgtcgacgtaggccgaggtcgatatacttcgtacaataaatgtagttagtacgtaagttggggtacacggtaccgaccgggccccggaaggtacgggtcgtacgggtaggggttgggggtcgggggtaggtacggtagggtccggtacgtttgggacgggtagcgtaacgagttacgtcggtaccgaaaggtaacgtagggtaggaacgggtacgtaagggtaaccggtaccggtaaacgtacggtttaaccccgaacccgggtaacccccgtaaacccccggaaacggtaacccgtaaaccggttaccggtaaaccgtttaacccggttaacggtaacccggtaaacccgggttaaacggtttacccggggttaaaacccggggacccgttaaacccccggggttttaagggaacccgggtacgggtttaacccggggggttaacaaaccccggggggttaccgttacccgggttaacccggtttaaccgttaacggttaccggggttacgttaaccggggtaaccgggttaacttttaccggtttaggtttttacccgacggttaaacccggttactttaacccggtttaaaacggtttgtttaaaaccgggcggttaaaccgtttaacccgggtttagttaaccggggtacccggggttttaaggttccggggtttaacccgggttgggggggtaaacccccgggggg

SEQ ID NO: 98523 - DNA, 776 bp, Homo sapiens
  misc_feature: GYAE6OF01BI2M3.17.10.A10.1.454.CMB.1.raw
  modified_base (136)..(136): a, c, t, g, unknown or other
  misc_feature (136)..(136): n is a, c, g, or t
tcagcgtagactagcacgaccggtgctcgatttagcgtcgatctcaggggacccaaaaaaccacacccctccttgggagaatcccctagatcacagctcctcaccatggactggacctggagcattccttttccgnggtgcgagcgaggcacgaggtcgcccacgcccgtaggttctaggttggtcgcaggcgtggggctggaggtcgacgaaggtaacgccggtggggactaagtcgaggtcgacttggttcctccgtgacgaacggccgtagtggtattagtacttctaacaaacgtaaagttgtaggtacttaggtaacggttcgggacgccggaacggacccgggacccccggaaggtacgggtcgtttaggggaggggtttggggggtcggggttaggtacgtacggggtccggttacggtttaacgggaacgggtacggtacgtaaccggtaggttaccggacgaccgaacgggtaaagtagggaacggtaacgggacaaggttaccggccgtaaacggtacccgtaaccggacccggtaacccaacccgaacgacgtacgtacggctaacgtacgagaccgtaagacgtacggcacgtggcgacgtcgacggacccgacgtacgggtccttacggttacgtacggtacgtacgaggttaactttacggtttgttagtaccggttacgtaacgtgtttaaaccgttgtttacggtagtccgtaagttcggttaggacgttacggttaccgggtcggttacgggtacgggg

SEQ ID NO: 98524 - DNA, 781 bp, Homo sapiens
  misc_feature: GYAE6OF01CZ83S.17.10.A10.1.454.CMB.1.raw
  modified_base (628)..(628): a, c, t, g, unknown or other
  misc_feature (628)..(628): n is a, c, g, or t
tcagcgtagactagcacgaccggtgctcgatttagcgtcgatctcgaggggacccgaaaaaccacacccctccttgggagaatcccctagatcacagctcctcaccatggactggacctggagctattcctttcctggtggcagcgaggcacaggtcgcccgaccgcccaggttcagttggtgcagacgtggggctgaggtgcagagccgtgggcatcagtgactgtctctgcaaggccagtggatatacgtcttacaactaaattagttaggtattaggaacgtttggggacgaccgaacgtacggggaccccccggaacgtaaagggggtcctttaggacggggttgggggttacgggggtacgggtacgtacggggttccggttacgttttagggaccgggttaaagggacccgtaaccggtaaggttaggttaccggaaccgtaaacccggggtaaacggttaggtaacggggtaaacggggtacgaaacgggtaacggttacccggtaaccgttaacgttaacccccggaacgggtaaccccccaacccccgtaacgggaaacccctaaccgacgttacctaaccgagtcgaactaacgtcgaccggacgtccgtaggaacgngtactacggaccgtaccgacggtccttctaagttaccgttggtacgagttacggttatttgggtttcctaggtactcgttaacggtctaagtttacggtacgtacgggtctacggtttaacgtcgggtactggaaccgttggggtaaccgggg

SEQ ID NO: 98525 - DNA, 941 bp, Homo sapiens
  misc_feature: GYAE6OF01AW17E.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttccgtggtgcagcaggcacgaggtcgccccacgcccgtaggttcgaggttggtcgcgaggacgtggggctggaggtgacgaggaacgtccggtggggactacgtcgaaggtcgtacgttcgtccgttccgtacggaccgaacgggtccgtagggtacggtaatttacgttacttaccttaaccaaaacgtaaaattaggttaacggttaagtaggttaaaggtttcgggtacggtaaccggaacccggaaccccggggtaccccccggaaaggttaacgggggttccgttagggggtacggggttcgggggggtcggggggttcgggtacggtaccgggttcgggtttaccggtttaaggggaaccgggttacggacgtaaccggtaaggtacgtacggaacccgaaacgggtaaggacgtagggaacggtacggacggtacgaaccggtaacgtaaccgtaacccggacccggaaccctacccgaacgactacgacgtacgtacgtacgtaccgaactaccggtaacgaccgaacgtccggtaaggacgtacgaccgtacggaacccgtaccggacccggttccgttaaccgttacgttaaccgggttaggtaccgttaacgggttaacgtttacgtttttacccgggttagttaacccgtttacttaaacgggtttaacccggtttaaacggtttacggtaaacgggttttacggttaacccgttacggtttaaccgggtacggttttaacccggggtaaaccggttttcggttaaacccggggtttaccccggggtaaaccccggggg

SEQ ID NO: 98526 - DNA, 740 bp, Homo sapiens
  misc_feature: GYAE6OF01A7SHC.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatcctttcctggtggcagcaggcacgaggtcgcccgaccgccctagggttaccaggttggtagcaggactggggctggaggtgcagacgccgtgggcatcagtgactgtctctgaccaggcctaggtgatatcttctacaactaaaatggtagtagtaggtaacgttggggtacgacggaccgacccgggacccccggaacgaacgggtcggtaggtacggggtgggggtacggggtgggtcgacgggtcggtcgttagggtacggtaaggctaacggagtagtacggcgaacgtaaggacggtaggaagggtccgaggtacggtacgaacggtaaccgttaaccggaacccgggtaaccaaccccccggtaacgaacctaacgtaaccgttcctaaacgtactacgaacccttaacggtacggacccggacgtaccggtacggacgacggtccgtaacggaacccgtaccggtacggtacccgtacgttaacgttcggagtacggtacgttaaagtatttcgggttactccgttacgtaccttacgtaaacgttagttacggttaaagccgttaagtaccgttgtaccggtaacggtcgttgtccggggtaccgggg

SEQ ID NO: 98527 - DNA, 774 bp, Homo sapiens
  misc_feature: GYAE6OF01DGH4A.17.10.A10.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
tcagcgtagactagcacgaccggtgctcgatttagcgtcgatctcaggggacccaaaaaaccacacccctccttgggagaatcccctagatcacagctcctcaccattgactggacctggagcattccttttccnggtgnagcagcacgaggcgcccacgcccaggttacaggttggcgacaggacgtggggctggaggtcgacgaaggaacgtccggtcggggatacgtacgtaggttacgacgtgttcctccgagacgtaacgccgtaaggtacgtaattactacttaccgttaacaaactaaaattgtaggtaagtaggtaaggtttcgggcgacggaccggacccgggaccccggaaaggtacgggtacgtagggtaaggggttgggggtaggggtcgtaccgaggggtccgtacgtttagggaacgggtacgacgtaagagttagcgaacgaacgaagtaagaggaaggtgtaacggctaaacgaaccggttacgtaaacccggaacccggtaaccccaaccccggaaacgaaccgtaaccgtacgttaaccggaacttaggtaaccgaaccgttaacggacgggaacaccggttcgaaaggacgtactacggacgaaccggaccgacggtcgtatttacgacgtcgtacgacgggttaacttacgtttgtttaccgtacgtacgttaaacgttaaccctaaggttaacttttggaaacttcgggtattacgtagcggtaacgtggttaaccgtcgggggtaacccggg

SEQ ID NO: 98528 - DNA, 805 bp, Homo sapiens
  misc_feature: GYAE6OF01DGFNK.17.10.A10.1.454.CMB.1.raw
  modified_base (138)..(138): a, c, t, g, unknown or other
  misc_feature (138)..(138): n is a, c, g, or t
tcagcgtagactagcacgaccggtgctcgatttagcgtcgatctcagggaacccaaaaaccacacccctccttgggagaactcccctagatcacagctcctcaccatggactggacctggagctacttccttttccgngggtcgcgagcgaggcacgtaggcgacccgacgtccaggtctaggttgtgcgaagtcgtgggctaggaggtgcgaaggacgccggtaggggactacgtacgtaagtgtaccgttcgtcctccgagaccgaacggcgtaggtggtaatattacgttactaagaaactaaagttagttaggttataggttaggttcgggacgaccggaccggaccccgggacccggaaggtacggtcggttagggtacggggttgggggtacggggtggtaccggacgggttcgggttacggttaacgggtaaacggtaccggtacgaaacggttagtaccggttcgaaaccggttaaacggaaggtacgggagggaacggtacgaaggtaccgtaacgtaacgttaaaccgtacccggaacccgaaccccgaacccgtaacgacgtaccgtacggtaacctaacgtacgtacgtaacgtaccggttaccggacgttaccgccggtaagacggtacgtccgaacgtaccggaccgttaccgtaccgttacgttacgtaccgtggtaaccgttagaacggttttattccgtttacattaacccggtagttaaccgtagtttaaggacgttagtacggtacttacggtatacggtaggttacgttgggccgggtaaccggg

SEQ ID NO: 98529 - DNA, 815 bp, Homo sapiens
  misc_feature: GYAE6OF01E0KWC.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtgcagcaggcacaggtgcccacgcccaggttcagttggtgcagacgtggggctgaggtgcagaagccgtggggcagtcgagtgactgtcctcctgcgaacggccagtggattatatcttacaacaaaattagtaggtatagtaattggggtgcgtaacaccgggacccccggaacgtaaggggtcttggtacggttgggggttacgggggtggggtcgaggtccgggtcgttttaggaacggggttaaggacaacgtagttaagtcggaccgtaaccgaaagggtagttacgggaagggcgtaaggaacgtacgtaaaccggtaacgttaaccccgaaccgggaaacccgaacccccccgaaacggaaacccaaccgtaaacggtacctaactacgtacgaaaccgtaaacgtacgggaacccggtacggtacccgttaggaaccgggaacggttacgtaacgggtaacccgtaaaccggtacccggggttccctttaaccggttacttttaaccggtcgggttaacgggtaacgttaacgggttaacggttttcggtttttaccgttacgttaacctacggtttaacggttaacctttaagtttacggtacggttaacggtcctttagttaacggttcggtaaaccgtttcgggttaacgttgggtaaccccgggggg

SEQ ID NO: 98530 - DNA, 631 bp, Homo sapiens
  misc_feature: GYAE6OF01CMTQQ.17.10.A10.1.454.CMB.1.raw
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (342)..(342): a, c, t, g, unknown or other
  misc_feature (342)..(342): n is a, c, g, or t
  modified_base (415)..(415): a, c, t, g, unknown or other
  misc_feature (415)..(415): n is a, c, g, or t
  modified_base (588)..(588): a, c, t, g, unknown or other
  misc_feature (588)..(588): n is a, c, g, or t
tcagcgtagactagcacgaccggtgctcgatttagcgtcgatctcaggggacccaaaaaaccacacccctccttgggagaatcccctagatcacagctcctcaccatggactggacctggagcacttccttttcctggtggcagcaggcacgaggtcgcccacgcccgaggttcagttggtgcgagacgtgggctggaggtgngagaacgcgtgggcagtcaggtgactcgttctccgtgaccgaagccgtaggtagtatacgtnttccttaanaactaaagttagtacgtagttagtaggttggtcgacgaccgaccggcccgaaggtagggtcgttaggnggtgggggtacgggtggtcgaggtcgttacggttggaacggtagcagtagtgagacgacgaagtggagacggngacgacgtacgacgtaaccgtacccggaccgacccaccccgactaactacgtacgtcaacgtcacacgtactagaccgtagtccgtaggacgtcgctacggacgtaccgacgttcctagtttaccgtagtcgtagacgtagttctttgtactcgtaactgttacgattagttntacggtacttgtacgtagttcgagttcgtcgtgggtacccggg

SEQ ID NO: 98531 - DNA, 726 bp, Homo sapiens
  misc_feature: GYAE6OF01B8E96.17.10.A10.1.454.CMB.1.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
tcagcgtagactagcacgaccggtgctcgatttagcgtcgatctcagggggacccaaaaaaccacacccctccttgggagaatcccctagatcacagctcctcaccatggactggacctggagcatccttttcctggtggcagcaggcacaggtgcccacgcccgaggttcagttggtgcagacgtggggctggaggtgcagaagcgtgggcagtcagtgactgtcctcctgcaagccagtggatagtatctacaactaaaatntaggtatagtagttggngacgacgaccggccccggaagagggtcgtaggtagggttgggggtggggtcgggtcgtaggtcggttcgtttagggacgggtaggacgacgtagtagtcggaccgaacgggaagtaggtaaggacggggtacaacgggtagtcccgaacgggtaaccgttaaacccggaacccggtaaccccgtaacccccgaacgaacccgtaacgtacgggttaccacgtacgtacgaaccctaagtcggaaccggtacgtccgtaagggcgaagtaccgaccggaacggtaccggtccggttacccttaacgtttaacgttcgtaaggtacgtaacgtacgtttagtttaccgttttcacgttactaacgttacgtaacgttaagtttccggaaagttccggttacttaggtaagttccggtaggtacggttcggttcgggtaacccggggg

SEQ ID NO: 98532 - DNA, 776 bp, Homo sapiens
  misc_feature: GYAE6OF01BFIXR.17.10.A10.1.454.CMB.1.raw
  modified_base (239)..(239): a, c, t, g, unknown or other
  misc_feature (239)..(239): n is a, c, g, or t
tcagcgtagactagcacgaccggtgctcgatttagcgtcgatctcaggggacccaaaaaccacacccctccttgggagaatccctagatcacagctcctcaccatggactggacctggagcattccttttcctggtggcagcaggcacgaggtcgcccacgccctaggttcgaggttggtgcaggtacgtggggctggagggtgcgaaggacgccgtggggcatcgagtgactgtctcngacaggccagtgtatatactcttacaactaaagtagtgtataggtagttgggcgacgacgaccggaccccggagtaacgggtcgttaggaggggtttggggggtacgggggttgggtacgtacggggtccgggttacggttttagggaaccggggttaaacgggtccgaacggtaggttacggtccggaaccgtaaaccggaaagggtacggtaaggggaaacggggtaagtaacggtaccgtaacggtaaccttaaacccggaaccggtacccccaaaccccgaaccggtaaactaccgtacggtaaacccttacgtaagttaccaacgtacgtcggaacgcgaccggtgacgtacgcgaacggacgtacgaccggtacgttactaacgttacgtcgtaaggtacgtaacggttactttggtttacgtcgtaaccgttaataccgggtttaataacgttacgggtattccggtccgttaagttaggttaccgggtacgtttacgggttaccgtttgggggccggttaaccccgggg

SEQ ID NO: 98533 - DNA, 659 bp, Homo sapiens
  misc_feature: GYAE6OF01AWHPM.17.10.A10.1.454.CMB.1.raw
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaccacacccctccttgggagaatcccctagatcaccagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttacaacaaaatntaggtatgtaagttgggtgcgacggaccggcccccggaagacgggtcgttggaggtggggtgggggtacgggtcgagggcggttcgtttaggacgggtaggctacgtagtacgtggaccgtaaccggaagacgtaagggaacgggacgaggacggtacgtaaacggtaaccttaacccggacccggaaccccgaacccccgaacgaaccaccgtaacgtcctaacacgttacgaccaaccgttgaaccggacgacccgtaggacgtacgacgtacggacgaccgacggttcctactattcgtagtagcgtaatgtttctttgcgttactacgttacgtaacttagttagacgttacgtattcgttacggtcgtagttaccggtgttcgggtaccggggg

SEQ ID NO: 98534 - DNA, 653 bp, Homo sapiens
  misc_feature: GYAE6OF01A13GD.17.10.A10.1.454.CMB.1.raw
  modified_base (395)..(395): a, c, t, g, unknown or other
  misc_feature (395)..(395): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcaggaacgccgtggggcagtcagtgacgtggtcctccgtgacgaacggccaggtggatatatcttacaactaaaatgtaggtagtgtaagttggtgacgacgaccgggcccccggagaacgggtcgttggagggttgggggtgggggttcgggtcgagggtcgggtcgtttagggaacgggttagggccacgtaagtancggaccgaacggaagagtaggaaggacgagagtacgacgtactacccggacgacccaccccgaacgaacacgacgtacaacgtactacgacaacgtagtacgacgtacccgtagtacgagtccgtaggaccggtaccgacggtccgttactacgttacgtacgttggacgtagtaacgtttgtttcgtgttctacgttacgttacttaggttatagttcgattcgtagtacggtagtcgttacggttcgggtacgggg

SEQ ID NO: 98535 - DNA, 719 bp, Homo sapiens
  misc_feature: GYAE6OF01ARU86.17.10.A10.1.454.CMB.1.raw
  modified_base (259)..(259): a, c, t, g, unknown or other
  misc_feature (259)..(259): n is a, c, g, or t
  modified_base (394)..(394): a, c, t, g, unknown or other
  misc_feature (394)..(394): n is a, c, g, or t
tcagcgtagactagcacgaccggtgctcgatttagcgtcgatctcgagggacccaaaaaccacacccctccttgggagaactcccctagatcacagctcctcaccatggactggacctggagcattccttttcctggtggcagcaggcacgaggtgccccacgcccaggttcgagttggtgcaggtacgtggggctaggaggtgacgaggaacgccgtggggctagtcgagtgacgttcgtcctccgtgcgaggccagngtatatatctacaataaattgtggtaagtgtaaggttggtcgacgacgacccgggaccccgagaacgggtcgtggagggttggggtggggtagggtcgtagggtcgtcgttaggacggtaggcgacgtagtacgngacgaacgagagtacggaggcgagctacgaacgtacgtaaccggaaccgacccgaccccgaaagaccgaacggtaacctccgtaataactacggtaacgtaaccgtcgggaaaccgtggccttaagggaacgcggttacccggaaggaacccgggtacccgtacggttacccgttacgttaagtcccggtaggttacgaacgggtttaacttaggtttttcttcccggttagtaaacccgttagtttaaccgtaacgtttagttaccggtagtttcgtctaacggttcgtagggtaaccttgggttacccggtgggttaccgggg

SEQ ID NO: 98536 - DNA, 750 bp, Homo sapiens
  misc_feature: GYAE6OF01D9F29.17.10.A10.1.454.CMB.1.raw
  modified_base (168)..(168): a, c, t, g, unknown or other
  misc_feature (168)..(168): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagcgtagactagcacgaccggtgctcgatttagcgtcgatctcaggggacccaaaaaaccacacccctccttgggagaatcccctagatcacagctcctcaccatggactggacctggagcattccttttcctgatggcagcgagcacaggtgccacgccaggttnagttggtgcagcgtggggctggagtgcgagaacgccgtggggctagtcgaggtcgacgttcgtcctcctggactaacgggcaggtggatttancttcttaacaactaaatagttggtaatggtaagttggcnccggtaaccgaccggaccccggtaacgacgggtgttaggggtggggttacgggggtaggggtcggtacgtagggtcccgggtgtttacggaacggggaacgtcggtactaggtactacgaccggtaaactaaggagtacggaaggtacacggtagtacccgaagttacccggtaaacccgaaccgggaacccctaaccccgaaccgtaacgtaacctcgtaactaccgtacgtacgaacgtaacgtacggaccgtacgtaccaggaacggcacggaaccgaccgggtaccgacccgggttacgtcgttaacgttacgggttcgtacgggtagtacgtttagttcgttttcgacgttaccgttaacgttcgttaaagttacgtttaggtacgttaacgggttcctttaacgttacgttaccggttaacggttcggttcccggttacggggg

SEQ ID NO: 98537 - DNA, 811 bp, Homo sapiens
  misc_feature: GYAE6OF01BEAR5.17.10.A10.1.454.CMB.1.raw
  modified_base (432)..(432): a, c, t, g, unknown or other
  misc_feature (432)..(432): n is a, c, g, or t
tcagcgtagactagcacgaccggtgctcgatttagcgtcgatctcaggggacccaaaaaccacacccctccttggagaatcccctagatcacagctcctcaccatggactcggacctggagcacttcctttcctggtggcagcaggcacaggtcgcccacgcccaggttcagttggtgcaggacgtggggctggaggtcgacgagaacgccgtggggcctaatccgagtgacttcgttctcctagaccacggccgtaggtcggaatagttacttaccgttacaaacgtaaaattagttaggttactaggtaaaggtttgggtacgacgtaaccggaccccgggtacccccggaagtacgggtcgttaggaggggttgggggtcggggtacggtacgacgggtcggtacgtttcgggaacggtaaggcaacgngtacgtcgaccgaacggtaatacggtaagggaacggcggaacgacggttaccgaaaccgttaaccgttaacccgaaacccggtacccccgtaacccccgaacgtaaaccgaacttaccggttaacctaacaccgttacggacctaacggtaccgtaccggacggtacgtacggaaaccgtgtaaccccggtagaacccggaccggtaacccggttcccgttaagttaaaccggttccggtacggtttacggaaccggttaagttaaccggtttttcgtttaaccggtcgttaaacgttaccgtaacgttaccttagttacggtacggacgttctacggttagtacggtaaccttgggtaacccgtttcggggacccggg

SEQ ID NO: 98538 - DNA, 802 bp, Homo sapiens
  misc_feature: GYAE6OF01BD8XC.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcacttccttttcctgggtggcagcgaggcacgacggtcgcccacgcccgtaggttcgaggttggtcgcgaggtacggtggggctggaggtgacgaaggaacggtccggtggggctagtacgtagtcgtacgttcgttcctccgtaggaccgtaacggccgtaggtacggtaattactacgttaccttaacgaaacttaaagtagttacggttagtagtaaggttgggtcgacggacggtacccgggaccccggtaaggtacggtcgttaggggtacgggtggggggtcgggtcgggtacggacggtccgggttacgttagggtaaccgggtaacggacgtaacgttaggtaccgtacggaaaccgtaacggaaaggtacggtaagggaaggtaacgacggtaacgtaaccgtaaccggtaaccgtaacccggaaaccccgtaaccccgaacccgtaaacggaaccgtaccgtaaccggttaacgaactacggtaacccgtaacaacgtaaccggacgtacgtaccgtaaggaccgtagtacgacggaacgaccggtaaccgtcgtttaacgttgtaccgtacggtacgtaagtcgtttattcggttctacgtcgtaactttacgtattagttacggtaatcggttaactgtaggtacgttaggacgttggtcgggtacggg

SEQ ID NO: 98539 - DNA, 763 bp, Homo sapiens
  misc_feature: GYAE6OF01CPG29.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtgcagcaggcacgaggtcgcccacgcccaggttcaggttggtgcagcgtggggctggaggtgcaaggacgccgtggggcatcgagtgacgttcgtctcctgacgaaggccgaggttggatattattacctacaactaaaattagttaggtagtagtaagttgggtggacgacgacccgggaccccggaaggacgggtacgttggaggttcggggtgggggtggtcgtagggtcggttcgtttagggaacgggttaacggacgacgtagtagtcggacgaaccggaagacggtaggaaggacgagacggtacgacgtaacgttacccgaaccggacccaaccccgaacgaacccaagtacggtactaacacgtagaccgaacgttacggaacacgtcgtaacggacggtactacggtaccggaaacggacccgggtaacgggttaccctacggtttaaccgttacgtacgggttacggaacggttaacgttacgtttacggttttcgttacgtaaccttacggtttaaccgttaacgttaacgttttaggaaccggttaggttacccggttttataccgggttttaccggaaggttacgggttacccgtttgggggtaaccccggggg

SEQ ID NO: 98540 - DNA, 786 bp, Homo sapiens
  misc_feature: GYAE6OF01BZXSB.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactgggctgaggtgcagaagccgtggggcatcagtgactgtctcctgcgaaggccaggtggatatatcttacaactaaaatattggtataggtaagtttggggcgacggacgaccggggccccccggaagtaacggggtcgtttaggagggtgggggttgggggttggggtacgagggtcgggtacgttttcgggaacggggtaagggtcgaacgtaggtagttacggacgaaccggtaagaaggtagggaagggcgaaggtcgtaccgaacggtaacttaacccggaaccgggaaacccacccccgaacgggaacctaaccgtacggttacctacgtaacgagtaaccgaacgtacgaaccggtacgtacccgttagggaacgtacggaccgttaacgggaacccggaacggtacccggtcccgtttaacttacgttaaacggtcggttacggaaccggtaacggtaccggtaaccccgacgtaccgggttacccgggacgtaccggtccggttaacgggcctaccggggaccgggtttacccttacgggtaacccggttccggggttaccggggacccgttaacgggggccgttaacccccgggg

SEQ ID NO: 98541 - DNA, 1011 bp, Homo sapiens
  misc_feature: GYAE6OF01EYDYX.17.10.A10.1.454.CMB.1.raw
  modified_base (135)..(135): a, c, t, g, unknown or other
  misc_feature (135)..(135): n is a, c, g, or t
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (410)..(410): a, c, t, g, unknown or other
  misc_feature (410)..(410): n is a, c, g, or t
tcagcgtagactagcacgaccggtgctcgatttagcgtcgatctcaggggacccaaaaaccacacccctccttgggagaatcccctagatcacagcctcctcaccatggactggacctggagcattccttttccngggtgacagcgaggcacgagggtcgacccacgcccgtaggttcaggttggtgacgtaggacgtggggcttggaggtnacaggtaacgccgtggggnactcgagtagacgttgtcctaccgtagacgaaacggccgtaggtaggtaacttaacgtaacttaccttaaccaaacttaaaacgttaggttacgggttaattacggttaaggtttacggggtagaaccggttaaccggaccgggtacccccggaaagtaacggggtccgtttaacgggnggggttacgggggggttacggggggtacggttaccggtagggttaccgggttaccgggtttttagggaaccggggttaaacgggtaccgtaaacggttacgggttaagtccggaaacctaaccggggtaaaggtacgggttaacgggaaacggggtacgtaaacgggtacgttaacggtaacccggtaaaccggttaaccccggaaccgggaaccccgttaaccccccggaaagtaaccctaaccggtaccgtttaaccgaaccggtaaactaccggtaaaccggtaaacgtaaccggttaaccgggaccgttaacccggtaaggggtaaacctaaccgggtacgggttaaacccggtaacccgggaacggttaacccgggtttaccccggtttaagttaaacggttaccggttaaccgggttaacggtttaaacccgaaaggtttttaacgttttcccgggttttaaacggttacggtttaaaccgttaacggttaaacgtttaacccggtttaaggtttaacgggtaaccgtttagggttacctaacggggtttaacgcggttaaacggtcgtttacccggggttaacgtaccgggggg

SEQ ID NO: 98542 - DNA, 641 bp, Homo sapiens
  misc_feature: GYAE6OF01E0P64.17.10.A10.1.454.CMB.1.raw
  modified_base (323)..(323): a, c, t, g, unknown or other
  misc_feature (323)..(323): n is a, c, g, or t
  modified_base (609)..(609): a, c, t, g, unknown or other
  misc_feature (609)..(609): n is a, c, g, or t
tcagcgtagactagcacgaccggtgctcgatttagcgtcgatctcaggggacccaaaaaaccacacccctccttgggagaatcccctagatcacagctcctcaccatggactggacctggagcattccttttcctggtggcagcaggcacgaggtgcccacgcccgaggttcagttggtgcaggacgtgggggctggaggtgcaaggaacgccggtggggcatcgagtgacttgtcctctgacgaaggccaggtggaactatactctacaacaaaatagtggtatgaagttggtagcgacgacggccccgaagaggtcgtggnggtggggtggggtggtcgaggcggtcgttaggtacgggagtacgagagtacgtgacgtacgaagacgtaggaaggacgagacgtacgtaacgacgttaacccgacggtacccaaccccggtaacgaacgtaaccgtaacgtactaacgtacgtacgactaacggtacggaaccgacggtaccgtaggaagacggcgtacggaaccgacgtaccggtacgtacgtacgttacgtgtcgagtagtacgtttgtttctagtccgtaattcgttaactagttgagtggtntacgtacgtcgagtcgttcgtcggtaccgggg

SEQ ID NO: 98543 - DNA, 715 bp, Homo sapiens
  misc_feature: GYAE6OF01BWTG2.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtgcagcaggcacaggtcgcccacgcccaggttcagttggtgcagacgtggggctggaggtgcagaagccgtggggcatcagtcgactgtcctcctgacgaaggccgtaggtcggtattatagttcttacgaactaaaatgttggtatagtaagttgggtgacgacgaccgggacccccggaagtaagggtcgtttggagggttggggtaggggtggtcgaggtcggtgtttcggaacggtagcaacgtagtgtacgacgaacggagaggtaggagggacaggtacgtacgaccgtaagtacccgaccggtacccaacccccggaacgaacctaacctacggttaactaaccgtagtacgaaccgtaacgtacggaaccggtacgtacccggtaggacggtacgggtacctacgggaacccgtaccgaaccgggttccgttaacgtttacgttacggttcggtacgacgttaagttcgtttacgtttctacgtacgtacttacccggtaattaagtttacgacgtttacggtacttacgttacggtccggtaagttccgggtacttcccggggtacgggg

SEQ ID NO: 98544 - DNA, 833 bp, Homo sapiens
  misc_feature: GYAE6OF01BY9J1.17.10.A10.1.454.CMB.1.raw
  modified_base (133)..(133): a, c, t, g, unknown or other
  misc_feature (133)..(133): n is a, c, g, or t
  modified_base (177)..(177): a, c, t, g, unknown or other
  misc_feature (177)..(177): n is a, c, g, or t
tcagcgtagactagcacgaccggtgctcgatttagcgtcgatctcaggggacccaaaaccacacccctccttgggagaatcccctacgatcacagctcctcaccatggactggacctggagcatccttttccnggtgcagcaggcacaggtcgcccacgcccaggttcagttggtancagacgtggggctggaggtcgacgagaacgccgtggggaccagtcgagtcgacgtcgtcctccgtagaccgaaggccgaggtaggattatacttacttaacgaactaaaatgttaggtaagttagtagttgggtcgtacggaaccgaccgggcccccggtaagaacgggtcttagggaaggtcgggggtacggggtcgggtacacgggtcggttaggttacggaacgggtaaggctaaccgtaggttacgtcggacgaaccggtaagacggtacggaacggcgtaaggtacgtaccgaaccggttaaccgtaacccggacccggaaccccgaccccgtaacgaacctacgaccgtactacgacgtacgaactacgacgtaaccgcgtaccgtaggacgtacgtaccggacgaaccgtaaccggtaccgggtaacccgtttacgtaaccgtttaggtaccgggtacgtaaccgggttagtttaaccggttttccggtttacggtaacccgttacgtaaaccggtttaaaccggttaaccgttttaacggttacggtacccgggtttaaccggttaccgtttaaccgttaaccgggttacccgggtttaaaccgttccgggggttttaacccgttaccgggggttaaaccccgggggg

SEQ ID NO: 98545 - DNA, 743 bp, Homo sapiens
  misc_feature: GYAE6OF01B5XQQ.17.10.A10.1.454.CMB.1.raw
  modified_base (193)..(193): a, c, t, g, unknown or other
  misc_feature (193)..(193): n is a, c, g, or t
  modified_base (558)..(558): a, c, t, g, unknown or other
  misc_feature (558)..(558): n is a, c, g, or t
tcagcgtagactagcacgaccggtgctcgatttagcgtcgatctcaggggacccaaaaaccacacccctccttgggagaatcccctagatcacagctcctcaccatggactggaccctggagcattccttttcctgggtggcagcaggcacaggtgcccacgcccaggttcaggttggtgcagacgtggggcnggaggtgcgagaagcgtggggcatcagtgactgtctcctgacgaggcctaggtggatatatccttacaacaaaatagtggttaatagtaaagttcgggtacgccgaacgaccgggtcccccggaacggaacgggtccgttaggaggggttaggggtcgggggttcgggtacgtagggtccggtgtttaggaacgggtaaggcaacgagttacgcggacgtaaccggaagacgtaggaacgggcgaggtacgactacgtaaacctaccggtaacccgggaaccctaaccccccgaacggaaccaaccgtaggtacctaacacgtacggaactaaccgttagaaccggacgtaccgtacgaggtacnccggtaacgtaacggacccgacggtccgtaccgttacgttaaccgtggttacgacggttagtacgtttgttacgttcgtaacggttacttaacgggttacttaagggtttacggtacgtaacggttcttagttaccgttcgggttaaggtttccggttaaccggttggggttaaacccccggggg

SEQ ID NO: 98546 - DNA, 899 bp, Homo sapiens
  misc_feature: GYAE6OF01A0GSJ.17.10.A10.1.454.CMB.1.raw
tcagcgtagactagcacgaccggtgctcgatttagcgtcgatctcaggggacccaaaaaccacacccctccttgggagaactcccctagatcacagctcctcaccatggactggacctggagctacttcctttcctggtcgcagcaggcacgaggtcgcccgaccgcccgtaggttcgaggtttgggtcgcgaggacggtcggggtctggaggtcgacgaaggtacgccggtggggactacgtcgagtgtaccgttcgtccgtcgtacgaccgaacggtcgtaggtacggtattacgttactacttaacgaaactaaaagttaggttaggtaactaggttaaggtttacggggtacgtacggaccggtacccggggaaccccgggaacggtacggggtttacggtacgggtagggggttcggggggttacggggtcggggtaccggacggggttccgggttaccggtttaggggtaaccggggttaacggtaccgtaacggtaggtacggttacggaacccggtaaaccggtaaagggtacgggttaaccggggaaggggtaaccgtaagggttaaccggtaaccggtaacggttaaacccggtaaccccgggaacccggtaaacccccgaaccccggtaaacgaccgaacccgttaacgtaccgaacttacgggtaacctaacccgtacgggtaaaccggaccggtacgtaccgtaagggccgtacggttaaccggacgaacggtaccccgggtagtttcccttaacggagtacccgttgacggtgttaccgtttagttccggttttagacgtacgttacttaaggtacgttagtaccgttagttccgtaactttacggtcgtacggttccttaagggtccgggttaacggtacgggg

SEQ ID NO: 98547 - DNA, 293 bp, Homo sapiens
  misc_feature: GYAE6OF02HFMIM.17.10.A10.1.454.CMB.1.raw
  modified_base (286)..(293): a, c, t, g, unknown or other
  misc_feature (286)..(293): n is a, c, g, or t
tcagcgtagactagcacgaccggtgctcgatttagcgtcgatctcagggttcctgaccgattctctggctccaagtctggcacgtctgccaccctgggcatcaccgcgctccagactgggacgaggccgagtatttctgcgcaacatgggattccagcctgacttctggggtgttcggcagtgggaccaagctgaccgtcctaggtcagcccaaggctgccccctcggtcactctgttcccaccctcctcctagtctacgctgagcgggctggcaaggcgcatagnnnnnnnn

SEQ ID NO: 98548 - DNA, 292 bp, Homo sapiens
  misc_feature: GYAE6OF02JIHP8.17.10.A10.1.454.CMB.1.raw
  modified_base (172)..(172): a, c, t, g, unknown or other
  misc_feature (172)..(172): n is a, c, g, or t
  modified_base (285)..(292): a, c, t, g, unknown or other
  misc_feature (285)..(292): n is a, c, g, or t
tcagcgtagactagcacgaccggtgctcgatttagcgtcgatctcagggttcctgaccgattctctggctccaagtctggcacgtctgccaccctggcatcaccgcgctccagactggggacgaggccgagtattctgcgcaacatgggattccagcctgacttctggggtnttcggcagtgggaccaagctgaccgtcctaggtcagcccaaggctgccccctggtcactctgttcccacctcctcctagtcctacgctgagcgggctggacaaggcgcatagnnnnnnnn

SEQ ID NO: 98549 - DNA, 291 bp, Homo sapiens
  misc_feature: GYAE6OF02G8VSN.17.10.A10.1.454.CMB.1.raw
  modified_base (287)..(291): a, c, t, g, unknown or other
  misc_feature (287)..(291): n is a, c, g, or t
tcagcgtagactagcacgaccggtgctcgatttagcgtcgatctcaggggttcctgaccgattctctggctccaagtctggcacgtctgccaccctgggcatcaccgcgctccagactgggacgaggccgagtatttctgcgcaacatgggattccagcctgacttctggggtgttcggcagtgggaccaagctgaccgtcctaggtcagcccaaggctgccccctcggtcactctgttcccaccctcctcctagtctacgctgagcgggctggcaaggcgcatagnnnnn

SEQ ID NO: 98550 - DNA, 519 bp, Homo sapiens
  misc_feature: GYAE6OF02HG4DX.17.10.A10.1.454.CMB.1.raw
  modified_base (288)..(288): a, c, t, g, unknown or other
  misc_feature (288)..(288): n is a, c, g, or t
  modified_base (450)..(450): a, c, t, g, unknown or other
  misc_feature (450)..(450): n is a, c, g, or t
  modified_base (467)..(467): a, c, t, g, unknown or other
  misc_feature (467)..(467): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacagacccccgganaagggcttggagtggggtggggtgggtcagcggctttggacggtaaggcacagtatgcacgaagatgaagggcagagtcacgattaccacggaccaccccacgaacacagtctaacatgcaactgacgagcctgagagctgacgacacggcctactattacngtgcgagaattgtttcngtctatcgtaactaagtttgattaggctgtagtggactggtacttgtcgggg

SEQ ID NO: 98551 - DNA, 509 bp, Homo sapiens
  misc_feature: GYAE6OF02H8QO4.17.10.A10.1.454.CMB.1.raw
  modified_base (463)..(463): a, c, t, g, unknown or other
  misc_feature (463)..(463): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccagaacacagtctacatgcaactgacgagcctgagagctgacgacacggcctctattactgtgcgagaattgttttcngtcatcgtactaatttgataggctctatggactggacttgtcgggg

SEQ ID NO: 98552 - DNA, 291 bp, Homo sapiens; identical to SEQ ID NO: 98328
  misc_feature: GYAE6OF02HO5PN.17.10.A10.1.454.CMB.1.raw
  modified_base (288)..(291): a, c, t, g, unknown or other
  misc_feature (288)..(291): n is a, c, g, or t

SEQ ID NO: 98553 - DNA, 509 bp, Homo sapiens
  misc_feature: GYAE6OF02I4Z0Q.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtgggtggggtgggtcagcgggctttgacggtaaggcacagtatgcaccgaagatgaagggcagagtcacgattaccacggacaccccacgaacacagtctacatgcaactgacgagcctgagagctgacgacacggccgtctatactgtgcgagaatgtttctgtcatcgtactaatttgatagctctatggactggacttgtacgggg

SEQ ID NO: 98554 - DNA, 582 bp, Homo sapiens
  misc_feature: GYAE6OF02JYKI6.17.10.A10.1.454.CMB.1.raw
  modified_base (457)..(457): a, c, t, g, unknown or other
  misc_feature (457)..(457): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtggtcagcggctttggacggtaaggcacgagtatgcacgaagatgaagggcagagtcacgattaaccgacggaccaccccagaacacagtctaacatgcaaactgaacgagcctagagagctagacgacaacgggcctactacgtttacngtgaccgtaagtaaattcgttttactacggtactaagttccgttaaactaaacgttttggaagttacgggtaccttacgttaacgtacgggtaacttacggggtacctttacggttaccgggggg

SEQ ID NO: 98555 - DNA, 526 bp, Homo sapiens
  misc_feature: GYAE6OF02GOONA.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggaggtgggtggggtgggtcaggcggctttgacggtaaggcacagtatgcacgaagatgaagggcagagtcacgattaccgacggaccaccccacgaacacagtctacatgcaactgacgagcctgagagctgaccgacacggccgtctattactggtgcgagtacttgtttctgttcatcgtaactaatttggattaggtcttactagtggacttggtacttgtcgggg

SEQ ID NO: 98556 - DNA, 523 bp, Homo sapiens
  misc_feature: GYAE6OF02INZF3.17.10.A10.1.454.CMB.1.raw
  modified_base (289)..(289): a, c, t, g, unknown or other
  misc_feature (289)..(289): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccgganaagggcttggaggtggggtggggtgggtcaggcggctttggacggtaaggcacagtatgcaccgaagatgaagggcagagtcacgattaccacggaccacccctagaacacagtctacatgacaactgacgagcctgagagctagacgacgacggccgtactagttactgtgcgagtaattgtttctgtcatcgtaactaatttgatagctctagtgacgtggtacttgtcggg

SEQ ID NO: 98557 - DNA, 526 bp, Homo sapiens
  misc_feature: GYAE6OF02IJ7DM.17.10.A10.1.454.CMB.1.raw
  modified_base (249)..(249): a, c, t, g, unknown or other
  misc_feature (249)..(249): n is a, c, g, or t
  modified_base (368)..(368): a, c, t, g, unknown or other
  misc_feature (368)..(368): n is a, c, g, or t
  modified_base (445)..(445): a, c, t, g, unknown or other
  misc_feature (445)..(445): n is a, c, g, or t
  modified_base (473)..(473): a, c, t, g, unknown or other
  misc_feature (473)..(473): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaaatatggtatgaattgggtgcgacaggcccccggacaagggcttggaggtggggtggggtgggtcagcggctttgacggtaaggcacagtatgcacgaagatgaagggcagagtnacgattaccacggaccaccccagaacacagtctaacatgcaactgacgagcctgagagctgaccgacacgggccgtnttacttactgtgcgaagaattgttttcngtcatcgtactaatttgattaggctacgttatggtactggtactttgtcgggg

SEQ ID NO: 98558 - DNA, 508 bp, Homo sapiens
  misc_feature: GYAE6OF02GGL84.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctgatggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaaggggcttgagtgggtggggtgggtcaggcggctttgacggtaaggcacagtatgcaccgaagatgaagggcagagtcacgattaccacggacaccccacgaacacagtctacatgcaactgacgagcctgagagctgacgacacggccgtctattactgtgcgagaatgtttctgtcagtcgtactaattgataggcttctagtggactggacttcgg

SEQ ID NO: 98559 - DNA, 568 bp, Homo sapiens
  misc_feature: GYAE6OF02H0GXM.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggccccggagaaggcttgaggtggggtggggtgggtacgaggcggtcgtttgacggtaaggcacgagtatgcaccgaagatggaaggcagagtcacgattaccgacggaccaccccagaacacagtcacatgacaactgacgagcctagagagctagacgaccgacggccgttatacttacgtgtgccgtaagtaactttgttttactgttactagttaccgtaacttaagtttgaagttacggtacttacgttagtcggtaaccgtgggttacctttggtaccggggg

SEQ ID NO: 98560 - DNA, 510 bp, Homo sapiens
  misc_feature: GYAE6OF02FWV5X.17.10.A10.1.454.CMB.1.raw
  modified_base (447)..(447): a, c, t, g, unknown or other
  misc_feature (447)..(447): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtacccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtggtgggtgggtcagcggctttgacggtaaggcacagtatgcaccgaagatgaagggcagagtcacgattaccacggacacccccacgaacacagtctacatgcaactgacgagcctgagagctgacgacacgacgtctattactgtncgagaatgtttctgtcatcgtactaattgataggctctatggactggacttcgtgggtacccg

SEQ ID NO: 98561 - DNA, 292 bp, Homo sapiens; identical to SEQ ID NO: 98316
  misc_feature: GYAE6OF02GX4M4.17.10.A10.1.454.CMB.1.raw
  modified_base (288)..(292): a, c, t, g, unknown or other
  misc_feature (288)..(292): n is a, c, g, or t

SEQ ID NO: 98562 - DNA, 292 bp, Homo sapiens
  misc_feature: GYAE6OF02G886I.17.10.A10.1.454.CMB.1.raw
  modified_base (288)..(292): a, c, t, g, unknown or other
  misc_feature (288)..(292): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctgttcccaccctcctcctagtctacgctgagcgggctggcaaggcgcatagnnnnn

SEQ ID NO: 98563 - DNA, 513 bp, Homo sapiens
  misc_feature: GYAE6OF02JE4G9.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgaggtgggtggggtgggtcaggcggctttgacggtaaggcacagtatgcaccgaagatgaagggcagagtcacgattaccgacggaccaccccagaacacagtctacatgacaactgacgagcctgagagctgaccgacacggccgtctattactggtgcgagtattgtttctgtcatcgtaatatttgatagctctatggactggacttcgtcggg

SEQ ID NO: 98564 - DNA, 533 bp, Homo sapiens
  misc_feature: GYAE6OF02IUASF.17.10.A10.1.454.CMB.1.raw
  modified_base (481)..(481): a, c, t, g, unknown or other
  misc_feature (481)..(481): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggagtggggtggggtgggtcaggcggctttggacggtaaggcacagtatgcaccgaagatgaagggcagagtcacgattaccgacggaccaccccagaaccacagtctaacatgacaactgacgagcctgagagctagaccgacacggccgttactagttactgtagacgtaagtaattgtttcngtcatcgtactatttgataggtctacgtagtggactggtacgttgtacgggg

SEQ ID NO: 98565 - DNA, 341 bp, Homo sapiens
  misc_feature: GYAE6OF02IK6QF.17.10.A10.1.454.CMB.1.raw
  modified_base (179)..(179): a, c, t, g, unknown or other
  misc_feature (179)..(179): n is a, c, g, or t
  modified_base (288)..(288): a, c, t, g, unknown or other
  misc_feature (288)..(288): n is a, c, g, or t
  modified_base (295)..(341): a, c, t, g, unknown or other
  misc_feature (295)..(341): n is a, c, g, or t
tcagcgtagactagcacgaccggtgctcgatttagcgtcgatctcagggggttccgtgaccgagttctctggctccaagtctggcacgtctgccaccctgggcatcaccgcgctccagactggggacgaggccgagtatttctgcgcaacgatgggattccagcctgacttctggggtnttcggcagtgggaccaagctgaccgtcctaggtcacgcccaaggctcgccccctcggtcactctcgttcccgcctcctcctagtctacgctgagcggactggcaaggcncatagcnnnnnnnnnnnnnnnnnnnnnnnnnnnnnnnnnnnnnnnnnnnnnnn

SEQ ID NO: 98566 - DNA, 292 bp, Homo sapiens; identical to SEQ ID NO: 98316
  misc_feature: GYAE6OF02IRTNH.17.10.A10.1.454.CMB.1.raw
  modified_base (288)..(292): a, c, t, g, unknown or other
  misc_feature (288)..(292): n is a, c, g, or t

SEQ ID NO: 98567 - DNA, 515 bp, Homo sapiens
  misc_feature: GYAE6OF02F9K70.17.10.A10.1.454.CMB.1.raw
  modified_base (489)..(489): a, c, t, g, unknown or other
  misc_feature (489)..(489): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtggggtggggtgggtcaggcggctttggacggtaaggcacagtatgcaccgaagatgaagggcagagtcacgattaccacggacacccccacgaacacagtctacatgcaactgacgagcctgagagctgacgacacggccgtctattacgtgtcgcgagattgtttctgtcatcgtacaatttgatagntactatggactggtacttcgtcgggg

SEQ ID NO: 98568 - DNA, 632 bp, Homo sapiens
  misc_feature: GYAE6OF02JIUQC.17.10.A10.1.454.CMB.1.raw
  modified_base (287)..(287): a, c, t, g, unknown or other
  misc_feature (287)..(287): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccgganaagggcttgaggtgggtgggtgggtcaggcggcgtttggacggtaggcacgagtatcgacaccgaagatggaagggcagagtcagattaccgacggaccaccccgagaacacagtctaacatacgacaacgtagacgaacgcccgtaaggacgacgtcgtacggaaccggtaccaccggggtacccgttacttaagttaccgttcggttacggaccgtaaggtaaactttcggtttttactacgggttactaacgtttccggtaaacttaacggttttgtaaacggttacggttacttacgttaagtcgggttaaccgtttggttacccgttcggtaacgggggg

SEQ ID NO: 98569 - DNA, 292 bp, Homo sapiens; identical to SEQ ID NO: 98316
  misc_feature: GYAE6OF02G1B3D.17.10.A10.1.454.CMB.1.raw
  modified_base (288)..(292): a, c, t, g, unknown or other
  misc_feature (288)..(292): n is a, c, g, or t

SEQ ID NO: 98570 - DNA, 514 bp, Homo sapiens
  misc_feature: GYAE6OF02GPRIA.17.10.A10.1.454.CMB.1.raw
  modified_base (462)..(462): a, c, t, g, unknown or other
  misc_feature (462)..(462): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcacgaagatgaagggcagagtcacgattaccacggacacccccagaacacagtctacatgcaactgacgagcctgagagctgacgacacggccgtctattactgtgcgagtatgttttcngtcatcgtaactaatttgattaggcttactagtggactggtacttgtcgggg

SEQ ID NO: 98571 - DNA, 521 bp, Homo sapiens
  misc_feature: GYAE6OF02GEXNY.17.10.A10.1.454.CMB.1.raw
  modified_base (289)..(289): a, c, t, g, unknown or other
  misc_feature (289)..(289): n is a, c, g, or t
  modified_base (468)..(468): a, c, t, g, unknown or other
  misc_feature (468)..(468): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccgganaagggcttggagtgggtggggtggtcagcggctttgacggtaaggcacagtatgcaccgaagatgaagggcagagtcacgattaccacggacaccccacgaacacagtctacatgcaactgacgagcctagagagcctgacgacacggccgtactattactgtgcgagaattgttttcngttcattcgtactaatttgattaggctctatcggactggtacttcgtacgggg

SEQ ID NO: 98572 - DNA, 540 bp, Homo sapiens
  misc_feature: GYAE6OF02GGJNH.17.10.A10.1.454.CMB.1.raw
  modified_base (288)..(288): a, c, t, g, unknown or other
  misc_feature (288)..(288): n is a, c, g, or t
  modified_base (480)..(480): a, c, t, g, unknown or other
  misc_feature (480)..(480): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtgggtgggtgggtcaggcggctttgacggtaaggcacagtatgcaccgaagatggaagggcaggagtcgacgattaccacggaccacccccgagaacacagtcacatgcaactgacgagcctagagagctagacgtacgaccggccgggtactagttactgtcgacgagaattgttttcngtcagttcgtaactaattttgaattaggcttctagtggtaactggtaccttgtacggggg

SEQ ID NO: 98573 - DNA, 637 bp, Homo sapiens
  misc_feature: GYAE6OF02FE7CA.17.10.A10.1.454.CMB.1.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
  modified_base (426)..(426): a, c, t, g, unknown or other
  misc_feature (426)..(426): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttcctggtggcagcaggcacaggtgcccacgcccaggttcagttggtgcagactggggctgaggtgcagaagcctggggcatcagtgactgtctcctgcaaggccagtggatatatcttnacaaatatggtatgaattgggtgcgacgacggcccccgganaacgggtcttggaggtggggtaggggtggtcgaggcggtcgtttggacggtaaggcacgagtagtgcgaccgagagtaggaagggcagagtacgacgtacttacccgacggacccaaccccacgaaccacagtcaacngtacgacaacgtgacgacgccgtagacgagccgtaggaaccgaccgtaccgggtcccgtacttacgttacgttggtacgtacggtaagttaaacgttttcgttttaccgtagttacaacgttaccggttaaactaagttttacggaacgtttacgggtaccttacgttacggtaccggtacgttacgggttaccgttcgggtacccggggg

SEQ ID NO: 98574 - DNA, 513 bp, Homo sapiens
  misc_feature: GYAE6OF02IB8D4.17.10.A10.1.454.CMB.1.raw
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (465)..(465): a, c, t, g, unknown or other
  misc_feature (465)..(465): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaaggcttgagtgggtgggtggtcngcggctttgacggtaaggcacagtatgcaccgaagatgaagggcagagtcacgattaccacggaccacccccgacgaacaccagtactacatgacaacgtgacgagcctgagagctgacacacggcctactatactgtgcgagaattgtttcngtctatcgtaactatttgattaggctctatggactggacttgtcgggg

SEQ ID NO: 98575 - DNA, 511 bp, Homo sapiens
  misc_feature: GYAE6OF02HKNNA.17.10.A10.1.454.CMB.1.raw
  modified_base (420)..(420): a, c, t, g, unknown or other
  misc_feature (420)..(420): n is a, c, g, or t
  modified_base (485)..(485): a, c, t, g, unknown or other
  misc_feature (485)..(485): n is a, c, g, or t
tcagcgtagactagcacgaccggtgctcgatttagcgtcgatctcaggggacccaaaaaccacacccctccttgggagaatcccctagatcacagctcctcaccatggactggacctggaggatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcaggcggctttgacggtaaggcacagtatgcaccgaagatgaaggcagagtcagattaccacggacaccccacgaacacagtctacatgcaactgacgagcctgagngctgacgacacggctctattactgtgacgagaattgtttctgtcatcgtactaatttgatagctntatggactggacttcgtgggtaccgg

SEQ ID NO: 98576 - DNA, 528 bp, Homo sapiens
  misc_feature: GYAE6OF02G5FC2.17.10.A10.1.454.CMB.1.raw
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (414)..(414): a, c, t, g, unknown or other
  misc_feature (414)..(414): n is a, c, g, or t
  modified_base (466)..(466): a, c, t, g, unknown or other
  misc_feature (466)..(466): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggcttctggattcacgtttaccncctatagtatcaactgggtgcgccaggccgctggacaacgacctgagtggatggatgggcaaccctaanactggtgtcacagtgtcttcaccatcctcgggacagactaccatgaccacgaactcctaccataaacacagcctacagtggacgttgacggancctgacatctgacgacgacggccgtactattactgtacgcgagagtcccganagtccggtgacgcctacggcaggccggtcctttggaccttcgtggggcctagggactcccgg

SEQ ID NO: 98577 - DNA, 531 bp, Homo sapiens
  misc_feature: GYAE6OF02HIWNV.17.10.A10.1.454.CMB.1.raw
  modified_base (475)..(475): a, c, t, g, unknown or other
  misc_feature (475)..(475): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtgggtggggtgggtcaggcggctttggacggtaaggcacgagtatgcaccgaagatggaagggcagagtcacgattaccacggacaccccacgaacacagtctaacatgcaactgacgagcctagagagctagaccgacacggccgtactagttactgtgcgaagtattgtttcngtcatcgtaacaatttgaataggctacgttatcggacttaggtaccttggtcgggg

SEQ ID NO: 98578 - DNA, 602 bp, Homo sapiens
  misc_feature: GYAE6OF02IHV61.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttcacaaaatatggtatgaattgggtgcgacaggcccccganaagggcttgaggtggggtggggtggtcagcggtctttgacggtaaggcacgagtatgcaccgaagataggaagggcaaggagtcgaacgacttaaccacggaccacccccgagaacacagtctaacatgacaactggaacgacgcccgtagacgagacctagaaccgacgacggcccgtactagttacgtggtcggaccgaaggtaaagtttcgttttacgtcgttactaacgttccggttaaactaagttttggaacgttaggtccttacgttacgtacgggttactacgggttacctttcggtaccgggggg

SEQ ID NO: 98579 - DNA, 554 bp, Homo sapiens
  misc_feature: GYAE6OF02JDDN2.17.10.A10.1.454.CMB.1.raw
  modified_base (483)..(483): a, c, t, g, unknown or other
  misc_feature (483)..(483): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcaggcggctttggacggtaaggcacgagtatgcaccgaagatggaagggcagagtcacgataccgacggacacccccagaaccacagtctacatcgcaactgacgacgcctagagagctagacgaccgacggccgttactacttactgtcgacgtagtaacttgttttcngttacagtcgttaactaacgttttgaattacggtcttacgtagtcggtactggtacctttcggtacggggg

SEQ ID NO: 98580 - DNA, 550 bp, Homo sapiens
  misc_feature: GYAE6OF02IHR4E.17.10.A10.1.454.CMB.1.raw
  modified_base (398)..(398): a, c, t, g, unknown or other
  misc_feature (398)..(398): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggagtggggtggggtgggtcaggcggctttgacggtaaggcacagtatgcaccgaagatggaagggcagagtcacgattaccacggaccacccccagaacncacgtactacatgcaactgacgagcctgagacgctagacgacgacggccgttactattactgtgcgtaagctacccgagacgtccggtgacggtccgtaacggcacggtccggtcctttaggacctttcggcggggccagggacgtccccgg

SEQ ID NO: 98581 - DNA, 522 bp, Homo sapiens
  misc_feature: GYAE6OF02II8O5.17.10.A10.1.454.CMB.1.raw
  modified_base (451)..(451): a, c, t, g, unknown or other
  misc_feature (451)..(451): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggaggtggggtggggtgggtcgaggcggctttggacggtaaggcacagtatgcaccgaagatggaaggcagagtcacgattaccgacggacaccccacgaaccacacgtctacatgacaactgacgagcctgacgagctgacgacacggccgtntatactgtgcgagattgtttcngttacagttcgtatatttgataggtntactagtggactgtctgtcgggg

SEQ ID NO: 98582 - DNA, 519 bp, Homo sapiens
  misc_feature: GYAE6OF02GIV6A.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtgggtggggtgggtcagcggcgtttgacggtaaggcacagtatgcaccgaagatgaagggcagagtcacgattaccacggacaccccacgaacacagtctacatgcaactgacgagcctgagagctagacgacacggccgtctattactgtgcgagtaatgttttactgtacattcgtaactaatttgattaggctctatggactggacttcgtcgggg

SEQ ID NO: 98583 - DNA, 556 bp, Homo sapiens
  misc_feature: GYAE6OF02GUQCW.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccggacgaagggcttggaggtggggtggggtgggtcgaggcggtcgtttggacggtaaggcacgagtatgcaccgaagatggaagggcagagtcacgattaccgacggaccaaccccgacgaacacagtactacatgaccaacgtgaacgacgcctgagacgctgacgacgacggtccgtacttagttactggtcgacgtaagtaacgttgtttactgttcagttccgtaataatttgattagctactagtggactcggtactacgtcgggg

SEQ ID NO: 98584 - DNA, 435 bp, Homo sapiens
  misc_feature: GYAE6OF02JUVSC.17.10.A10.1.454.CMB.1.raw
  modified_base (414)..(435): a, c, t, g, unknown or other
  misc_feature (414)..(435): n is a, c, g, or t
tcagcgtagactagcacgaccggtgctcgatttagcgtcgatctcagagtcacgattaccacggacacccccacgaacacagtctacatgcaactgacgagcctgagagctgacgacacggccgtctattactgtgcgagaatgttttctgtcatcgtacaatttgataggctctatggactggacttctggggccaggggaccacggtgatcgtctcatcagcctccaccgaagggcccatccggtccttccccctggccaccctcctccaagacgccacctcgtcgggggccacgacggtccggccccgtcggggcctcggcccgtgggtaccgaacggaccttacctttccccgtagttccgtaccgctaggacggccggggcgtcgggacgaacgggccgacgataggcnnnnnnnnnnnnnnnnnnnnnn

SEQ ID NO: 98585 - DNA, 291 bp, Homo sapiens
  misc_feature: GYAE6OF02FM8AG.17.10.A10.1.454.CMB.1.raw
  modified_base (288)..(291): a, c, t, g, unknown or other
  misc_feature (288)..(291): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtctaggtcagcccaaggctgccccctcggtcactctcgttcccaccctcctcctagtctacgctgagcgggctggcaaggcgcatagnnnn

SEQ ID NO: 98586 - DNA, 543 bp, Homo sapiens
  misc_feature: GYAE6OF02JAWDZ.17.10.A10.1.454.CMB.1.raw
  modified_base (287)..(287): a, c, t, g, unknown or other
  misc_feature (287)..(287): n is a, c, g, or t
  modified_base (443)..(443): a, c, t, g, unknown or other
  misc_feature (443)..(443): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacaggcccccgganaagggcttggaggtggggtggggtgggtcaggcggctttggacggtaaggcacgagtatgcaccgaagagtgaagggcagagtcacgactaccacggaccacccccagaaccacacgtctacatgccaactgacgagcctaggagagctgacgacncggccgtctattactgtgacgtaggtaatttgtttctgtctatcgtaactaatttgaagttaggcttagttacgtggtacgtggtaccgttcgtcggggg

SEQ ID NO: 98587 - DNA, 544 bp, Homo sapiens
  misc_feature: GYAE6OF02GJ4GK.17.10.A10.1.454.CMB.1.raw
  modified_base (288)..(288): a, c, t, g, unknown or other
  misc_feature (288)..(288): n is a, c, g, or t
  modified_base (436)..(436): a, c, t, g, unknown or other
  misc_feature (436)..(436): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggaggtgggtggggtgggtcaggcggtctttggacgggtaaggcacgagtatgcaccggaagagtggaagggcagagtcacgattaccgacggaccaccccgacgaacacagtctacatcgacaactgacgagccgtganagctgacgacacgccgtctacttactgtgcgagtaattgtttactgtctctacgttaactaatttgattacggcttacgtagtggtacgtggtacgttcggtacgggg

SEQ ID NO: 98588 - DNA, 546 bp, Homo sapiens
  misc_feature: GYAE6OF02JE6C5.17.10.A10.1.454.CMB.1.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacaggcccccgganaagggcttggagtgggtggggtggtcgagcggctttgacggtaaggcacagtatgcaccggaagatggaagggcagagtcacgataccacggacaccccagacacagtctacntgcaactgacgagcctagacgagctgacgacacgggcctactattacnggtagcgtaagtaacttgtttactgtactagtcgttaactaagttttgaacgttaggtccttacgtagttggacttgggtaccttggtaccgggggg

SEQ ID NO: 98589 - DNA, 620 bp, Homo sapiens
  misc_feature: GYAE6OF02GQHEP.17.10.A10.1.454.CMB.1.raw
tcagcgtagactagcacgaccggtgctcgatttagcgtcgatctcagggggacccgaaaaaccacacccctccttgggagaatcccctagatcacacgctcctcaccatggactggacctggagcatccttttcctggtgacaggcaggcacaggtgtcccacgcccaggttcagttggtgcagactggggctgaggtgcaggagcctggggcatcagtgactgtctcctgcaagggccagtggatatatctcacaaatatggtactgaattgggtgcgacacggccccccggacaagggcttggagtgggtggggtgggtcaggcgggcgtttgacgggtaaggcgacagtatgcaccgaagatgaagggcagagtacacgacttaccgacggaccacccccgacgaaccacgacgtacctacactagaccaacgtgaaccgacgacccgttaggaacgacgaccgtggaccgaacgtaccgggaccgtactaatttaccgtggtacggaccgaaggtaacgtttgttttcgagttacgacgttacgtaacttaagtttcggtaagttacggtccttactaggttacggtacgttacgggtaccttcggtacccggggg

SEQ ID NO: 98590 - DNA, 592 bp, Homo sapiens
  misc_feature: GYAE6OF02G526J.17.10.A10.1.454.CMB.1.raw
  modified_base (290)..(290): a, c, t, g, unknown or other
  misc_feature (290)..(290): n is a, c, g, or t
  modified_base (427)..(427): a, c, t, g, unknown or other
  misc_feature (427)..(427): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgacggcccccgganaagggcttggaggtggggtggggtgggtcgaggcggtcgtttggacgggtaaggcacgagtatgcaccgaagatggaaggcagagtcacgattaccacggacaccccgacgaacacagtctacatgacaactgacgngcctgacgagctagacgaccgacggtacccgtacttacttacgtggtacggaccgtaagtaatttcgtttttcgaggttcctaacgttccgttaaacttaagttttaggaactttagggtaccttacgttacgtagggtaccgttaggtacgtttcggtcggggg

SEQ ID NO: 98591 - DNA, 574 bp, Homo sapiens
  misc_feature: GYAE6OF02IUQHT.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggaggtggggtgggggtggggtcaggcggctttggacgggtaaggcacagtatgcaccgaagatgaagggcagagtcacgattaccacggaccaacccccagaaccacagtctacatgacaactgacgagcctagacgacgctacgacgacgaccgggccgttactacgtttactgtagcgtaagtaattcgttttctgttcctagttaccgttaactaattttggaacttagggtcttacgtagttacggtacgttggtaccgttcggtaccggggg

SEQ ID NO: 98592 - DNA, 612 bp, Homo sapiens
  misc_feature: GYAE6OF02HEEQW.17.10.A10.1.454.CMB.1.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccgganaagggcttggagtggggtggggtgggtcaggcggtctttggacgggtaaggcacgagtatgacaaccgaagagtggaagggcaaggagtacgaacgtaacttaacccgaaccggtacccaaccccccgaacgaaaccaacgacgtacctaacattcgacctaaacgtgaaccgagcccgttaggagacgctacggaaccgacgaccgggccttacgtacgtttacgtgtcgacgtaagtactttcgttttctagttactagttccgtaataatttggaattacggcttacgttagtcggtactgggtacttcggtacgggg

SEQ ID NO: 98593 - DNA, 562 bp, Homo sapiens
  misc_feature: GYAE6OF02HW7Q8.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggaggtggggtggggtggggtcaggcggtctttggacggtaaggcacgagtatgacacgaagatggaagggcagagtcacgattaccacggaccaccccagaacacagtctacatgcaactgacgagcctagagagctagacgtacgacggccgtactaacttacgtgtcgacgtaagtaattgttttctgtactacgtacgtaacttaagtttgaagttaggtccttacgtagttaggaccgttaggtaccttcggtaccggggg

SEQ ID NO: 98594 - DNA, 526 bp, Homo sapiens
  misc_feature: GYAE6OF02GSH4A.17.10.A10.1.454.CMB.1.raw
  modified_base (288)..(288): a, c, t, g, unknown or other
  misc_feature (288)..(288): n is a, c, g, or t
  modified_base (471)..(471): a, c, t, g, unknown or other
  misc_feature (471)..(471): n is a, c, g, or t
  modified_base (499)..(499): a, c, t, g, unknown or other
  misc_feature (499)..(499): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtggtcagcggctttgacggtaaggcacagtatgcaccgaagatgaagggcagagtcacgattaccgacggaccaccccacgaacacagtctacatgcaactgaacgagcctgagagctagacgacacggcctactattaccgtgtcgcgtagaattgttttcngttcatccgtaataatttgattacggtntctagtcggactggtacttgtacgggg

SEQ ID NO: 98595 - DNA, 549 bp, Homo sapiens
  misc_feature: GYAE6OF02JYWOG.17.10.A10.1.454.CMB.1.raw
  modified_base (291)..(291): a, c, t, g, unknown or other
  misc_feature (291)..(291): n is a, c, g, or t
  modified_base (419)..(419): a, c, t, g, unknown or other
  misc_feature (419)..(419): n is a, c, g, or t
  modified_base (487)..(487): a, c, t, g, unknown or other
  misc_feature (487)..(487): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtgcgacgacggcccccgganaaggggctttggaggttggggtggggtgggtcaggcggctttggacggtaaggcacagtatgcacggagagtgaagggcagagtcaagataccgacggaccaccccgagaacacagtcacatgcaacngacgagcctgagagcgtagacgacgacggtccgtactattacgtgtacgcgtaaggtaattgttttcngttcatcgtaactagtttagacttaggcttacgtagtacggactcgggtacttaggtcgggg

SEQ ID NO: 98596 - DNA, 530 bp, Homo sapiens
  misc_feature: GYAE6OF02F7DO5.17.10.A10.1.454.CMB.1.raw
  modified_base (288)..(288): a, c, t, g, unknown or other
  misc_feature (288)..(288): n is a, c, g, or t
  modified_base (360)..(360): a, c, t, g, unknown or other
  misc_feature (360)..(360): n is a, c, g, or t
  modified_base (433)..(433): a, c, t, g, unknown or other
  misc_feature (433)..(433): n is a, c, g, or t
  modified_base (479)..(479): a, c, t, g, unknown or other
  misc_feature (479)..(479): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggaggtggggtggggtgggtcgaggcggtctttggacgggtaaggcacgagtatgcacgaagangaagggcagagtcacgataccgacggaccaccccacgaacacgagtcacatcgacaactgacgagcctagagngcgtgacgacacggccgtatattacgtgtgcgaagtattgttttcngtcagttcgtactaatttgatagcttatgtaggactggtacttggtcgggg

SEQ ID NO: 98597 - DNA, 554 bp, Homo sapiens
  misc_feature: GYAE6OF02IVZ7T.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtggtcagcggcttgacggtaggcacagtatgcaccgaagatgaagggcagagtcagattaccacggaccaccccagaacacagtctacatcgcaactgacagcctagagacgctagaccgacgaccgggccgttactacgttactggtcgcgtaagaattcgttttactgtacacgttccggttaactaagttttggaacttagggtcttacgttagtggtactacgggtacgttcgtaccggggg

SEQ ID NO: 98598 - DNA, 553 bp, Homo sapiens
  misc_feature: GYAE6OF02GLE5M.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggagtgggtggggtgggtcaggcggctttggacggtaaggcacgagtatgcaccgaagatgaagggcagagtcgacgattaccgacgaccaccccagaacacagtctacatgacaactgacgagcctagagagctagacgacgacggcctactattacgtgtcgacgtaagtaacgttgttttactgttactagttacgtaactaatttcggagttacggtcttacgtagtcggtactcgggtacttcggtacgggg

SEQ ID NO: 98599 - DNA, 568 bp, Homo sapiens
  misc_feature: GYAE6OF02IJU76.17.10.A10.1.454.CMB.1.raw
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtaatgaattgggtgcgacaggcccccggacaagggcttggaggtggggtgggggtgggtcgaggcggtctttggacggtaaggcacgagtatgcaccggaagagtggaagggcagagtacacgattaccacggaccaccccagaacacagtcaacatgacaactgacgagcctagacgagctagacgacacggccgtacttatactggtagacgtaagtaagttgttttctgtactagttacgttaactaagttttgaattacggtacttacgttagtcggtacgttgggtaccgttcggtacggggg

SEQ ID NO: 98600 - DNA, 763 bp, Homo sapiens
  misc_feature: GYAE6OF02HA254.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatcctttttcctggtggcgagcgaggcacgaggtcgcccaccgcccgtaggttctaggttggtgcgagacggtggggctggaggtgacgaaggaacgccggtgggggactagtcgaggtcgacgttcggttccttccgtgacgaacgggccaggtggtatatattcttacaaactaaaatgtaggtatagtaagttgggtgacgacgaccgggcccccggaagaacggggtcttggagggttgggggtgggggtcgggtcgagggtccggttgtttagggaacgggttaacgggcaacgtaggttagtcggaccgaaccgggtaaagtacggtaggggaaacgggcgaaggtacggtacgaacggttaacttaacccggaacgggaccccaaccccgaacgaaccacgtacgtaacctaacagtcggaacctaaacggtacgaacggacgccgttaggaaggacgtacgtaacggaaccgaaccggaccgggtccgttaacgtttacgttacgttcgggttacggaacgttaagttaacgttttcggttttacacggttactacgttacgtaaacttaggtttacgaacgttacggtcttacgtagtacggtaacgttcggttaccgttcggggaccgggg

SEQ ID NO: 98601 - DNA, 533 bp, Homo sapiens
  misc_feature: GYAE6OF02I4J9N.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgtgacaggcccccgganaagggcttggagtggggtggggtgggtcaggcggctttgacggtaaggcacagtatgcaccgaagatgaagggcagagtcacgattaccgacggaccaccccgagaacacagtctacatcgcaactgacgagcctgacgagctcgacgacgacggtccgtactattacgtgtagcgagaattgtttctgtcattcgtaactatttgaatacggtcttcgtagtggactcggtacttcgtacgggg

SEQ ID NO: 98602 - DNA, 533 bp, Homo sapiens
  misc_feature: GYAE6OF02G4OGR.17.10.A10.1.454.CMB.1.raw
  modified_base (288)..(288): a, c, t, g, unknown or other
  misc_feature (288)..(288): n is a, c, g, or t
  modified_base (435)..(435): a, c, t, g, unknown or other
  misc_feature (435)..(435): n is a, c, g, or t
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaaggccagtggatatatcttcacaaaatatggtatgaattgggtgcgacagggcccccgganaaggggcttggaggtggggtggggtgggtcgaggcggctttggacgggtaaggcacgagtatggcaccgaagagtaggaagggcaggagtcacgattaccgacggaccaaccccgacgaacacactactacatgcaacgtgaaccgngcctgagagctgacgacaccggcgtctagttactgtgcgagagttgttttcngtcatcgtaactaatttgatgnttcagtgactgtactggtacgggg

SEQ ID NO: 98603 - DNA, 586 bp, Homo sapiens
  misc_feature: GYAE6OF02ILH2U.17.10.A10.1.454.CMB.1.raw
  modified_base (292)..(292): a, c, t, g, unknown or other
  misc_feature (292)..(292): n is a, c, g, or t
  modified_base (326)..(326): a, c, t, g, unknown or other
  misc_feature (326)..(326): n is a, c, g, or t
  modified_base (416)..(416): a, c, t, g, unknown or other
  misc_feature (416)..(416): n is a, c, g, or t
  modified_base (500)..(500): a, c, t, g, unknown or other
  misc_feature (500)..(500): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaattggtgcgacgaggcccccggaanagggcttgaggtggggtggggtgggtcagcggtntttggaggtaaggcacgagtatgcaaccgaagagtggaagggcagagtcaacgtataccacggaccaccccaagaacacgtagtcacatnactaacgtgacgagcctaggagacgctagaacgccgaccggccgttactacttaccgtgtagaccgagtaacgtttcgttttancgttacttaacgtcggttaaacttaagtttggtaacgttacggtcttacgtagttacggtacttggttaccgttcggtaccggggg

SEQ ID NO: 98604 - DNA, 527 bp, Homo sapiens
  misc_feature: GYAE6OF02GJH33.17.10.A10.1.454.CMB.1.raw
  modified_base (504)..(504): a, c, t, g, unknown or other
  misc_feature (504)..(504): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttggaggtggggtggggtggggtcgaggcggcgtttggacgggtaaggcacgagtatgcaccgaagatgaagggcagagtcacgattaccgacggaccacccccacgaacacagtctacatgacaactgacgagcctgagagctgacgacacggccgtacttattactgtgcgagtatgtttctgtcatcgtactaatttgataggtctntatggactggtacttgtacgggg

SEQ ID NO: 98605 - DNA, 564 bp, Homo sapiens
  misc_feature: GYAE6OF02F1UWH.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacgacggcccccggagaagggcttggaggtggggtggggtggtcgaggcggtctttggacggtaaggcacgagtatgcacgaagataggaacgggcagagtacaacgtactacccgacggacccaacccccgagaaccacgacgtactacatcgacaactgacgacgcctgagagctagacgacgacggtccgtactacgttacgtgtcgacgagtagtttgtttactgttacagttcgtaactagtttagattaggcttacgtagtggtactggtacttcggtcgggg

SEQ ID NO: 98606 - DNA, 564 bp, Homo sapiens
  misc_feature: GYAE6OF02I72ER.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctgggcatcagtgactgtctcctgcaaggccagtggatatatcttcaacaaatatggtatgaattgggtgcgacgacggcccccggagaagggcttggaggtgggtgggtgggtcaggcggtcgtttggacggtaaggcacgagtagtgcaaccgaagagtaggaagggcaggagtcgaacgtagtaaccacggaccaacccccagaacacagtctaacatcgacaactgacgagcctagagacgctgaccgacgacggcccttatacttactggtgcgaagtagttcgttttgcgttcattcgtaacttaatttgaagttaggtcttacgtagttacggactagggtaccttggtaccgggg

SEQ ID NO: 98607 - DNA, 658 bp, Homo sapiens
  misc_feature: GYAE6OF02G2PMJ.17.10.A10.1.454.CMB.1.raw
  modified_base (502)..(502): a, c, t, g, unknown or other
  misc_feature (502)..(502): n is a, c, g, or t
  modified_base (539)..(539): a, c, t, g, unknown or other
  misc_feature (539)..(539): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatataggtatagtaattggggtgcgacgacgggcccccggacgaagggcttggaggttggggtggggtgggtcaggcggtcgtttggacgggttaaggcacgtagtagtcgacgaccggaagagtaggaaggggcgaggacggtcaacgtacttaacccgaaccggaacccgaaccccccgaacggaaaccaaccgtaacgtacctaacgatacgacctaaactcggaacgacgtaccctggaaggacncgtacgaacgaccgacggacccgttatactttaccgngtgaccggtagtaacgttcgttttactcggtactacgttacggttaactaagttttacgagtttaacggtccttacgttaggttcggaacgtttacggtaccggttcggtaccgggggg

SEQ ID NO: 98608 - DNA, 685 bp, Homo sapiens
  misc_feature: GYAE6OF02HPSRV.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaaatatggtatgaattgggtgcgacacggccccggacaagggcttgaggtggggtggggtgggtcagcgggtctttaggacggtaaggcacaggtatgacacgaagagtaggaagggcagagtacacgattaccgacggaccacccccacgaacacgatctaacatgacaactagaacgtagcctaggacgagccgtaagacccgaacgaccgggtaccccgttacgttacgtttaacgtcggttacggaccggtaaagggttaaactttcggtttttttaccgtaggtttacccgtaacgttttaccggtaaaccgttttaaacgtttttacgggaaagtttacccggggtaccttttaaccggttacggttaccgggttaaaccggtttacggggttacccgttttttaccggggtaaccccgggggggg

SEQ ID NO: 98609 - DNA, 543 bp, Homo sapiens
  misc_feature: GYAE6OF02IGY7V.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgaggtgggtgggggtgggtcgagcggctttgacggtaaggcacagtatgcaccgaagatggaaggcagagtcacgattaccacggaccacccccacgaacacagtctaacatgacaacgtgacgagcctgagagctgacgacgacggccgtactagttactgtagccgaagtaatttgttttctgtctagttacgtaataatttgaattaggcttcgtagtggtactggtacgttcgtaccggggg

SEQ ID NO: 98610 - DNA, 549 bp, Homo sapiens
  misc_feature: GYAE6OF02F8D28.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttaggaggtgggtggggtggtcgaggcggcgtttgacggtaaggcacgagtagtgcaccgaagagtgaagggcagagtcaacgattaccacggaccaccccgacgaacacagtactacatgacaacgtgaacgagcctagacgagctaggaccgacaccggccgtatacgttacgtgtgcgagattgtttctgtcagtacgtactaagtttcgattacggcttacgttagtcgtacgtcggtacgtcgtacgggg

SEQ ID NO: 98611 - DNA, 606 bp, Homo sapiens
  misc_feature: GYAE6OF02FK22W.17.10.A10.1.454.CMB.1.raw
  modified_base (449)..(449): a, c, t, g, unknown or other
  misc_feature (449)..(449): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccggaagaagggcttgaggtggggtggggtggtcgaggcggtcttggacggtaaggcacgagtatgcaacgaagatggaagggcaggagtcacgattaaccgacggaccaccccgaacgaaccacacgtactacatcgacaactggacgacgccgtagagagcgngaccgacgaccggtccgtacttagttacgtgtcgaccgaagtaacttggttttactgttacctacgttacggttaacttaagttttaggaacgttagggtaccttacgttaacggttacgggtaaccgtttcgggtacctttccgggtaccgggggg

SEQ ID NO: 98612 - DNA, 536 bp, Homo sapiens
  misc_feature: GYAE6OF02HRN34.17.10.A10.1.454.CMB.1.raw
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (516)..(516): a, c, t, g, unknown or other
  misc_feature (516)..(516): n is a, c, g, or t
tcagcgtagactagcacgaccggtgctcgatttagcgtcgatctcaggggacccaaaaaccacacccctccttgggagaatcccctagatcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctanactggtgtcacagtntcttcacccatcctccgggacagactaccatcgaccacgactcctaccaataaacacagacctacatgagttgaggagcctgacatctagacgacgaccggccgtactacttactgtcgacgagacgtcccaacgtatccggtagacgtaccgtacggcaggtccgtcctttgacttcgngggccagggtcgcccgtcgg

SEQ ID NO: 98613 - DNA, 542 bp, Homo sapiens
  misc_feature: GYAE6OF02IUK7C.17.10.A10.1.454.CMB.1.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacgaggcccccgganaagggcttggaggtgggtggggtgggtcgaggcggctttggacggtaaggcacgagtatgcaccgaagactggaaggcagagtcacgataccacggaccaccccagaacacagtctacatcgacaactggacgacgcctaggagacgactcgacgacgaccggccgtctattacgtgtgacgagtaagttgtttctgtcatcgtataagttgataggcttacttagtcggtactcgggtacttgtacgggg

SEQ ID NO: 98614 - DNA, 508 bp, Homo sapiens
  misc_feature: GYAE6OF02FGOZ8.17.10.A10.1.454.CMB.1.raw
  modified_base (288)..(288): a, c, t, g, unknown or other
  misc_feature (288)..(288): n is a, c, g, or t
  modified_base (358)..(358): a, c, t, g, unknown or other
  misc_feature (358)..(358): n is a, c, g, or t
  modified_base (436)..(436): a, c, t, g, unknown or other
  misc_feature (436)..(436): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtgggtggtcagcggctttgacggtaaggcacagtatgcacgagatgaagggcagngtcacgattaccacggacaccccagaacacagtctaacatgacaactgacgagcctgagagctgacgacacggccgtntacttactgtgcgagtaattgtttcngttcatcgtanaatttgattagctctatggactggtacttgtcggg

SEQ ID NO: 98615 - DNA, 568 bp, Homo sapiens
  misc_feature: GYAE6OF02GAAQR.17.10.A10.1.454.CMB.1.raw
  modified_base (291)..(291): a, c, t, g, unknown or other
  misc_feature (291)..(291): n is a, c, g, or t
  modified_base (493)..(493): a, c, t, g, unknown or other
  misc_feature (493)..(493): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacgggcccccgganaagggcttggaggtggggtggggtgggtcgaggcggtctttggacggtaaggcacagtatgcaccgaagatggaagggcagagtcaacgataccacggaccaccccacgaacacagtacacatcgacaacgtgacgacgcctgagacgctagaccgacgacggccgtactattacgtgtcgacgtaagtatttcgttttacngttactattaccggtaactaagtttgaagttaggtcttacgtagttcggaacgttcggttacgttcggtaccggg

SEQ ID NO: 98616 - DNA, 568 bp, Homo sapiens
  misc_feature: GYAE6OF02IX9MJ.17.10.A10.1.454.CMB.1.raw
  modified_base (360)..(360): a, c, t, g, unknown or other
  misc_feature (360)..(360): n is a, c, g, or t
  modified_base (432)..(432): a, c, t, g, unknown or other
  misc_feature (432)..(432): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacgaggccccccgggacaaggggcttggaggttggggtgggggtggggtcgaggcgggtcgtttggacggtaagggcacgagtangcacgaagatgaagggcaggagtcgacgattaccacggaccacccccacgaacacagtactacatgacaacngaacgagccgtgagagctcgacgacgacggccgtactattacgtgtgcgaaggtaattcgtttcttgtcagtacgttaactaatttgaattaggtcttacgtacgttaggtactcgggtacttcggttaccggggg

SEQ ID NO: 98617 - DNA, 625 bp, Homo sapiens
  misc_feature: GYAE6OF02IBW0A.17.10.A10.1.454.CMB.1.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (294)..(294): a, c, t, g, unknown or other
  misc_feature (294)..(294): n is a, c, g, or t
  modified_base (436)..(436): a, c, t, g, unknown or other
  misc_feature (436)..(436): n is a, c, g, or t
  modified_base (466)..(466): a, c, t, g, unknown or other
  misc_feature (466)..(466): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (528)..(528): a, c, t, g, unknown or other
  misc_feature (528)..(528): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcagtcagtgactgtctccgtgcaaggccagtggatatatctcaanaaaatntgtatgtaatgggtagcgaacgacggccccggtaanaacgggcttggaggttgggggtggggtcggtcgacggtcggcgtttggaacgggtaaggacgacgtagtagtgacgaaccggtaagagtggaacgggcagagtcaacgtaattaccgcgggaccaccccgaacgaacgtacncgttacacatgaacacgtacgacgactcgngaacgtagctagaccgacgtaacggtccgagtattaccgngtacgngaagtagtttacgttntcggtataaccgttacgttaaacctaagtttcgtaaagtaccggtatttaccgtaacggtaggtaacccggttggtaaccgtttcgggtaaccgggg

SEQ ID NO: 98618 - DNA, 608 bp, Homo sapiens
  misc_feature: GYAE6OF02HO7CL.17.10.A10.1.454.CMB.1.raw
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (435)..(435): a, c, t, g, unknown or other
  misc_feature (435)..(435): n is a, c, g, or t
  modified_base (511)..(511): a, c, t, g, unknown or other
  misc_feature (511)..(511): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatntggtatgaattgggtgcgacacggcccccgganaagggcttggaggtggggtggggtgggtcaggcggctttggacggtaaggcacgagtatgcacgaagatggaaggcagagtcacgataccgacggaccaccccagaacacagtctaacatgactaaactgaaccgagcctggagngcctaggaccgaacgaccgggtcccgttatacgtttacgtggttacgaccggtaagtaaactttcggtttttaccnggttacctaagtttaccggttaaactaatttttcggaattacgggtccttacgttagtcgggttaaccgttgggtaaccctttcggtaccggggggg

SEQ ID NO: 98619 - DNA, 524 bp, Homo sapiens
  misc_feature: GYAE6OF02FFCQZ.17.10.A10.1.454.CMB.1.raw
  modified_base (411)..(411): a, c, t, g, unknown or other
  misc_feature (411)..(411): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaatttgggagcgacacggcccccggacaagggcgttgagtgggtggggtgggtcgagcgggcttggtacggtaaggcacgagtagtgcacgagatggaagggcagagtcacgataccacggaccaccccacgaacacagtcacatnacaactagacgagccgtgagagctgacgacgacggcctctattactgtgacgataattgttttctgtcatcgtaacatttagatagtctctagtggactggtactcgtcgggg

SEQ ID NO: 98620 - DNA, 629 bp, Homo sapiens
  misc_feature: GYAE6OF02HJIJG.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttacaacaaaatatggtaatgtaattgggtgcgacgacggcccccggacgaagggcgttggaggtggggtagggggtgggtcgaggcggtcgtttggacggtaaggcacgagtatgcgacgaagagtaggaagggcgagagtacgaacgtaattacccgacggaccacccccgaacgaaccacacgtacacatacgacaactgaaccggacgaccgttaggacgacgccgtacggaaccgaccgaccgggtacccgttacgttaacgttacgtagtacggtacgtaagtaacgtttgttttcctagtctaacgttaccgttaataagtttaggtacttacgggtctagttacgtaggtacgttacggtacggttcggtaccgggg

SEQ ID NO: 98621 - DNA, 294 bp, Homo sapiens
  misc_feature: GYAE6OF02HNOS1.17.10.A10.1.454.CMB.1.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (286)..(294): a, c, t, g, unknown or other
  misc_feature (286)..(294): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtctaggtcagcccaaggctgccccctggtcactctgttcccaccctcctctagtctacgcctgancgggntggcaaggcgcatagnnnnnnnnn

SEQ ID NO: 98622 - DNA, 657 bp, Homo sapiens
  misc_feature: GYAE6OF02GK772.17.10.A10.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (454)..(454): a, c, t, g, unknown or other
  misc_feature (454)..(454): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcagagccgtggggcatcgagtgactgtcncctgcaaggcagtggatatntcttacaacaaatatgttatgaagttgggtgngactacggcccccggagaagggcttaggnggtgggcggggttgggtcaggtcggtctttggaacgggttaaggctacgagtntcgcaacgagatggaaggnagagtcagtactacgacggaccctaccccgagaacaacgctactaactactacgtcaacgtcgacggacgtaccgnggacgtagcgtacggaacgaccgaccgggtcccggttaatacgtttaccgtaggtcgtaaccggtaagttaaaccgtttggttttaaccgtggtttaaccttacggtaacccgtttaaaccgttaaagttttggaacgttaacgggttcttacggttaaagttcgggtaccgtacgggtttacgttccgggtaacccgggggg

SEQ ID NO: 98623 - DNA, 594 bp, Homo sapiens
  misc_feature: GYAE6OF02HGIYY.17.10.A10.1.454.CMB.1.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaatntggtatgaattgggtgcgacgacggcccccggagaagggcttggaggtggggtgggggtggtcgaggcggtcgtttaggacgggtaagcgacgagtatgacaccgaagagtaggaagggcaaggacgtacgaacgtacgtacccgacggacccacccccgacgaaccacgacgtactacatcgacaacgtgacgacgccgtagacgacgctagaccgacgaccggccgtactattacgtgtcgacgaagtacttgtttcgtcgttactacgtacgttaacttagtttgaagtacgtcttacttaggtcggtacgttacggtacgttcggtaccgggg

SEQ ID NO: 98624 - DNA, 579 bp, Homo sapiens
  misc_feature: GYAE6OF02IY2BC.17.10.A10.1.454.CMB.1.raw
  modified_base (288)..(288): a, c, t, g, unknown or other
  misc_feature (288)..(288): n is a, c, g, or t
  modified_base (445)..(445): a, c, t, g, unknown or other
  misc_feature (445)..(445): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatctacacaaaatatggtatgaattgggtgcgacaggcccccgganaagggcttggaggtggggtgggggtgggtcgaggcggtctttggacggttaaggcacgagtatgcgaccgaagatgaagggcagagtcaacgattaccgaacggacccaaccccgacgaacaacaggtcacatgacactgacgacgcctgagagtcngaaccgacgacgggcctacgttacttactggtcgcgtaagtactttgtttctgtactattaccgttaattaatttgaagttacggtaccttactaggttacggacgttacgggtaccgtttcggtaccgggggg

SEQ ID NO: 98625 - DNA, 566 bp, Homo sapiens
  misc_feature: GYAE6OF02FHM7O.17.10.A10.1.454.CMB.1.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatcctttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaatttgggtgcgacagggcccccgganaagggcttggagtggggtggggtggtcgaggcggtcgtttggacgggtaaggcacgtagtatgcaccgaagagtggaagggcagagtcaacgacttaaccgacggaccaacccccgaacgaaccacgacgtctacactgaccaacgtgacgagccgtagacgagcgtagacgaccgacggtcctactattacgtgtcgacgaagtaagttgtttctgtacagtccgtaataatttgagtacggtcttgtactggtactcggtacttcggtcgggg

SEQ ID NO: 98626 - DNA, 607 bp, Homo sapiens
  misc_feature: GYAE6OF02IEJTR.17.10.A10.1.454.CMB.1.raw
  modified_base (502)..(502): a, c, t, g, unknown or other
  misc_feature (502)..(502): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaactaaaattataggttatagtaagttgggtgacggaacgaccgggaccccggaacgaagggtcttagtaggtggggtggggtggtcgagcgggtctttaggacggtaaggcacgtagtatgacgaccgtaagagtaggaagggcgagagtacacgtactaaccgacggaaccaccccaagaacacgactctacgattcggactacgtagacgagtcctagacgatccgagacgactcggactacttagtacnggtcgacgtagtaagttacgttttcagttcgtacgtacgttaactaagtttgacgttaacgtcttacggtactacggtacgtcggtttacggtcgtaaccggggg

SEQ ID NO: 98627 - DNA, 572 bp, Homo sapiens
  misc_feature: GYAE6OF02FII2D.17.10.A10.1.454.CMB.1.raw
  modified_base (273)..(273): a, c, t, g, unknown or other
  misc_feature (273)..(273): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacaggcccccggacaagggcttggagtgggtggggtggtcaggcggctttgacggtaaggcacgagtatggacaccggaagagtgaagggcagagtcagtattaccacggaccacccccgagaaccacacgtcctaacgatcgaccaacgtgaacgacgccgttgaggacgctggaaccgtaccgacgggccgtactacgttacgtgtgacgaagtaattgttttactgtacagttacgtaacgtaattttggacttaggtccttacgtagtcggtactggtaccttacggtcgggg

SEQ ID NO: 98628 - DNA, 566 bp, Homo sapiens
  misc_feature: GYAE6OF02HAF6C.17.10.A10.1.454.CMB.1.raw
  modified_base (420)..(420): a, c, t, g, unknown or other
  misc_feature (420)..(420): n is a, c, g, or t
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacaggcccccggacgaagggcttggaggtggggtggggtgggtcgaggcggcgtttgacggtaaggcacaggtatgcaccgaagatggaagggcagagtcacgattaccgacggaccaccccgacgaaccacagtctacatgacaacngacgacgcctgagacgctagaccgacgacggcccgtactatttacgtgtgacgaagtagttgttttctgtactagttacgttaactaagtttagaagttacggacttacgttagttggtacgtggttaccgtttcggtaccggggg

SEQ ID NO: 98629 - DNA, 701 bp, Homo sapiens
  misc_feature: GYAE6OF02GGFUV.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagcctggggcatcagtgactgtctcctgcaaggccagtggatatatcttcaacaaaatatggtatagtaattgggtgcgacgacgggcccccggacgaagggtcttggaggttggggtggggtgggtcgaggcggtcgtttaggacggtaaggcacagtagtgacacgaaagagtaggaagggcaaggacgtacgaacgtaactacccgaccggtacccaacccccgaacgaacactacgtacctaacgactacgacctaaacgtcggaaccgacgcccgtaggaacgtacggtacctacgggaccgaaccggtaccggccgttaaccttaagttaccgtggtaacggtaccgtaagttaaggttttcgttttacgtacgtttactacgtttaaccggttaacgtttaaagttttacgggtaacgttacgggttcctttaacgttacgggttacgggttacccgttaacggggtttacccggtttacgggtacccgggggg

SEQ ID NO: 98630 - DNA, 952 bp, Homo sapiens
  misc_feature: GYAE6OF02IT7MI.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctcctgcaaggccagtggatatatcttacaacaaaatatggtatgaagttgggtgcgacacgggcccccggacgaagggcttggaggttggggtgggggtgggtcaggcggtcgtttaggacgggttaaggcgaacgtaggtagtcggactaaccggaaacggtagtagggaaacggggacgaaacggtacggtaccgaaaccgggtaacgtttaaaccccggaaaccgggtaacccccgaaccccccccgtaaaccggaaaacccaaacccggtaaaccggtttaccccgtaaaccgtaaaccgttaacggtaacccgtaaaaccggtttaccggggaaaacccggtaacccgggttaacccggttaacgggtaaaacgggtaacggttaacccgttaaacccggggaaaccccggggtaaacccggtaaacccgggggttacccccgtttaacgttttaaaaccctttttaaccgggttaaccggggtttacccggggtaaccgggtttaaaacgggttaaacggtttttttacggttttttttaccccgttacgggtttacccgttaaaacggtttttcccgggttttaaaaccgttaaaacggtttttttacgggaaaccggttttaacggggttccctttaaccggttttaacgggttttaccgggggttaaccggttttaccggggtttaaccggttttacccgggtttaaccccggggggggg

SEQ ID NO: 98631 - DNA, 586 bp, Homo sapiens
  misc_feature: GYAE6OF02GOLPZ.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatataggtatgtaagttgggtgcgacgacgggcccccggacgaagggcttggaggtggggtgggggtgggtcgaggcggtcgtttggacgggtaaggcacgtagtagtgacgaaccgaagagtagaagggcaggagtcaacgtataacccgacggtaccaacccccgaacgaaccacagtaccacatcgacaactacggacgagcgtagacgacgctagacgaccgaccggtcctacttattacgtggtcgacgtagtattgttttctgtctagtcgtaactaagtttgacgttagcttactagtcggtactcggtacgttcggtacgggg

SEQ ID NO: 98632 - DNA, 679 bp, Homo sapiens
  misc_feature: GYAE6OF02GOTJH.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatgaagttgggtgacgacgacggcccccggacgaagggcttggaggttggggtggggtgggtcgaggcggtcgtttaggacggtaaggcgtacgtagtagtgacgaaccgaagtagtaggaagggacgaaggacgtacaacgtaacttaacccgaaccggacccaacccccgaacgaaccaacacgtccaactagtcgaccaacgtcggaaccgacgtccgtaggaacggacgaccgtacggaaccggaccgtaacccgggtacccgttacttacgtttaccgtggtacgacggtaaagtaacgttttcgtttttacgtacggttactacgttaccgttaacgttaagtttggtaacgttacggtactttacggttacgttaggttaccggtacggttaccgttaggtacccggggg

SEQ ID NO: 98633 - DNA, 652 bp, Homo sapiens
  misc_feature: GYAE6OF02IETJJ.17.10.A10.1.454.CMB.1.raw
  modified_base (534)..(534): a, c, t, g, unknown or other
  misc_feature (534)..(534): n is a, c, g, or t
  modified_base (567)..(567): a, c, t, g, unknown or other
  misc_feature (567)..(567): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatagtatcttacaacaaaatagtggttataggtaattggggtgcgacgacgggccccggtaacgaagggtcttggaggtgggggtggggtgggtcgaggcggtctttaggacgggttaaggcaacgtagtatgacgaccggaagagtaggaagggcaaggagtcaacgtacgttaacccgaccgggaacccacccccgaaagaacgactaacgtactaacatgaccaagtcgaaggacgcctaggaacgcgtaccgtaggaccggaactacgggtcccgttattaacgtttacgnggttacggacgtaggttaacgttcgtttttacncgttacgtagtaccgttaacgtaagttttaggacgttacggtcttacgtagttaccggtagttaacgggtcttacggtacggggg

SEQ ID NO: 98634 - DNA, 298 bp, Homo sapiens
  misc_feature: GYAE6OF02GZ50O.17.10.A10.1.454.CMB.1.raw
  modified_base (289)..(298): a, c, t, g, unknown or other
  misc_feature (289)..(298): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctgttcccgccctcctcctagtctacgctgagcgggctggccaaggcgcatagnnnnnnnnnn

SEQ ID NO: 98635 - DNA, 718 bp, Homo sapiens
  misc_feature: GYAE6OF02JSFL3.17.10.A10.1.454.CMB.1.raw
  modified_base (292)..(292): a, c, t, g, unknown or other
  misc_feature (292)..(292): n is a, c, g, or t
tcagcgtagactagcacgaccggtgctcgatttagcgtcgatctcaggggacccaaaaaccacaccctccttggagaatccctagatcacagctcctcaccatggactggacctggagcatccttttcctggtggtagcaggcacaggtgcccacgccccaggttcagttggtgcagactggggctgaggtgcagaagcctggggcatcagtgactgtctcctgcaaggccagtggatagtatcttcaacaaaatatggtatgtaattgggtgcgactacgggcccccgganaaggggtcttaggaggtggggttcggggtagggtcgaggtccggcgtttggacggggttaaacggcgtaaccgtagttaacgtggccaaccggaaaggacgttagggaaacggggtccaaggtaacggttacgaacgggtaactttaacccggaaccggggaaccccaaaccccccgaacggtaaaccgaccgaacgggtttaccctaacgtaacgtacggacctaacgtacggaacgtaacggccctaaggacgacgctaggaaccgacgaccggtccgtacttagttaccgtgtaggccgtaaagtaatttggttttaccagtcctacttcgggttaactacgtttacgtaagtaaggttccgttaacctttaggttcccgggtaattacccgggttagtttaccgggtcggggtaaccccggg

SEQ ID NO: 98636 - DNA, 595 bp, Homo sapiens
  misc_feature: GYAE6OF02IZ670.17.10.A10.1.454.CMB.1.raw
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaatatggtatgaagttgggtgcgacacggcccccgganaagggcttggaggtggggtgggggtgggtcgaggcggcgtttaggacgggtaaggcacagtatgcacgaagatgagggnagagcagataccgacgaccacccgacgaaccacagtcacatgacaactgacgagcctagagacgctacgaccgacgaccgggtccgtacgttactttacgtggttacgaccggtaagtaacttttcgttttacgtagttactaagtttaccggttaacttaacgttttaggaagttacgggtcttacgttagttacggtacgtggttaccgttcgggtaccggggg

SEQ ID NO: 98637 - DNA, 546 bp, Homo sapiens
  misc_feature: GYAE6OF02HRAFF.17.10.A10.1.454.CMB.1.raw
  modified_base (256)..(256): a, c, t, g, unknown or other
  misc_feature (256)..(256): n is a, c, g, or t
  modified_base (483)..(483): a, c, t, g, unknown or other
  misc_feature (483)..(483): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattgggtgcgacgacggccccggagaagggcttgaggtgggtggggtggtcagcggtctttggacggtaagcacgagtagtgcaccgaagagtagaagggcagagtcacgtatacgacgaccaccccagaacacacgtactacatgacaacgtcgacgacgacctgacgagctgacgacgcggtacctcgttactacgtgacgtacgagaattgtttcngtctatacgtaactaagtttgagttacgcttacgtagtcggacgtggtacttcggtaccgggg

SEQ ID NO: 98638 - DNA, 667 bp, Homo sapiens
  misc_feature: GYAE6OF02JMRVP.17.10.A10.1.454.CMB.1.raw
  modified_base (256)..(256): a, c, t, g, unknown or other
  misc_feature (256)..(256): n is a, c, g, or t
  modified_base (330)..(330): a, c, t, g, unknown or other
  misc_feature (330)..(330): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (512)..(512): a, c, t, g, unknown or other
  misc_feature (512)..(512): n is a, c, g, or t
tcagcgtagactagcacgaccggtgctcgatttagcgtcgatctcgtaggggaccgaaaaccgacaccctccttagggagtaagtccctagacgtcacagctccgtcgaccagtggactggaccttggacgtcgattccttttccgtgggtggacacggcacggcaactagggtcgcccacgcccgaggttcctaggttggtcgctagactggggctggaggtgcaggagtccgtgggcagtcaggtgactgtccnctagcgaacggccagtggatatgtcttcgactaaaatgtggtaactgaagttgggtgcgacgacggccccgganaacgggtcgttggagtggggtagggttcgggacgaggtccggtcgtttaggagggttaagggctacggtaggtatggcaccggaagagtggaaaggggccaaggtagttccgaaggactttaccgacgggacccaaccccgaggaaccacgacgtcgtaaccntaaccggnaacgtgaccgnacccgagacgacgacctgaaccgagaccggtaccggtactaacgtttagttacggacgttcggaacgttatttacgttcgtttccggatagtcgtaaacgttatttaggcttagggcttacggaggtcgtacgttacgggtctttaggaccgggg

SEQ ID NO: 98639 - DNA, 694 bp, Homo sapiens
  misc_feature: GYAE6OF02FRQ5M.17.10.A10.1.454.CMB.1.raw
  modified_base (251)..(251): a, c, t, g, unknown or other
  misc_feature (251)..(251): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctctgcaggccagtgatatatctcacaaatntggtatgaagttgggtgcgacgacgggcccccggagaagggtcttggaggtggggttgggggtgggtcagggcggtcgtttggacgggtaaggcacgagtagtgcaaccggaagagtaggaagggcgaaggacgtacgaacgtaacgttaaccgaaccggacccaacccccgaacgaaaccaccgtacgtacctaacagtacgacctaaacgtcggaaccgacgtacccgtaggaggacggtacctagggaacccgtaacgacccgggtacccgttacgtttacgttaccggttaggtcgggaccggtaaggtaacgttttcgtttttccgtagttactaacgtttacgttaacttaacggtttttagaacggtttacggaccgtttacgttaaggtttccgggtaagtttacgggttacccggtttcggtaacccggggggg

SEQ ID NO: 98640 - DNA, 592 bp, Homo sapiens
  misc_feature: GYAE6OF02GAZES.17.10.A10.1.454.CMB.1.raw
  modified_base (289)..(289): a, c, t, g, unknown or other
  misc_feature (289)..(289): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggaggtggggtggggtgggtcaggcgggtctttggacggtaaggcacgagtatgacaccgaagatgaagggcagagtcacgactaccgacggaccaccccgacgaacacgagtctacatgacaacgtgacgacgcctagagacgctggaaccacgaccggtccgtacgttagttacgtggtcgacgtaagtaacgtttgttttactcgttactacgttaccgtaactaagttttcggaagttacgggtcttacgttagttacgggtaccttacgggttacttcggtaccgggggg

SEQ ID NO: 98641 - DNA, 606 bp, Homo sapiens
  misc_feature: GYAE6OF02G145E.17.10.A10.1.454.CMB.1.raw
  modified_base (260)..(260): a, c, t, g, unknown or other
  misc_feature (260)..(260): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatntggtatgtaagttgggtgcgacgacggcccccggagaagggtcttaggaggtggggtggggtgggtcgaggcggtcgtttaggacgggttaaggcgacgagtatgacgacgaagagtaggaagggcagacgtacgacgtactaccgacgaccaccccgacgaacacagtcacatcgacaacgtgaccgagcctaggacgcgcgtacgacgacgaccggtccgttacgtacgttacgtggtcgacgtaaggttactttcggttttctagtactacgttacgtaacttagttgtaacgttagtcgttacgttggtacggttacgtcggttacgttacggtaccggggg

SEQ ID NO: 98642 - DNA, 650 bp, Homo sapiens
  misc_feature: GYAE6OF02GG748.17.10.A10.1.454.CMB.1.raw
  modified_base (265)..(265): a, c, t, g, unknown or other
  misc_feature (265)..(265): n is a, c, g, or t
  modified_base (528)..(528): a, c, t, g, unknown or other
  misc_feature (528)..(528): n is a, c, g, or t
tcagcgtagactagcacgaccggtgctcgatttagcgtcgatctcagggggacccaaaaaccacacccctccttgggagaatcccctagatcacgagctcctcaccatggactcggacctggagcactccttttcctggttggcagcaggcacaggtgcccacgcccaggttcagttggtgcagactggggctgaggtgcagaagcctggggcatcagtcgactgtctccgtgcaaggccagtggaatatatcttcaacaaaatntagtatgaagttgggtgcgacacgggcccccgagaacggtcttggaggttggggtggggtggtcgaggcggtctttggacggtaggcacgagtatgactaccgagagtaggaacgggcaaggtagtacaacggtacttaacccgaacggacccaacccccgtaagaacctaacgacgtacctaacgagttacgactaaacgtacggaacgacgacctaggtacgacgctaagaccgaaccgacggtaccgtacttagttacgngttacggacgtaagttaacgtttcgtttacgtcgttactcgtaccgttaattaaggttttcgaacgttaaccggtcttacgtacggttaccggtacgtcggtaccgtttccggtaaccgggg

SEQ ID NO: 98643 - DNA, 535 bp, Homo sapiens
  misc_feature: GYAE6OF02JC6LW.17.10.A10.1.454.CMB.1.raw
  modified_base (465)..(465): a, c, t, g, unknown or other
  misc_feature (465)..(465): n is a, c, g, or t
  modified_base (510)..(510): a, c, t, g, unknown or other
  misc_feature (510)..(510): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcacaaaatatggtatgaattgggtgcgacacgggcccccggacaagggcttggaggtggggtggggtgggtcaggcggtctttggacggtaaggcacgagtatgcaccgaagatggaagggcagagtcacgattaccacggaccaccccgacgaacacgagtctacatgacaacgtgaacgagcctaggagagctgaccacgacggccgtactattacngtagacgtagattgtttctgtcagtcgtaatattgagtagtcttntagtgactggtaccttgtaccgggg

SEQ ID NO: 98644 - DNA, 568 bp, Homo sapiens
  misc_feature: GYAE6OF02GQP2T.17.10.A10.1.454.CMB.1.raw
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatntggtatgaattgggtgcgacacggcccccgganaacggggcttggaggtggggtaggggtgggtcgaggcgggtcgtttggaccgggtaaggcgacaggtatggcaccgaagatggaagggcagagtcaacgtattaccgacggaccaccccagaacgacacgtctacatgacaactgaacgagtctagagacgctgacgaccgcggccgtacttagttactggtcgngtaagtacttgtttcngtcngtaccgtaactagtttacgattaggccttcgtaattcgggacttagggtaccttggtaccgggg

SEQ ID NO: 98645 - DNA, 564 bp, Homo sapiens
  misc_feature: GYAE6OF02FMZQD.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacaggcccccggagaagggtcttggaggtggggtggggtgggtcgaggcggtcgtttggacgggtaagggcacgtagtatggcaccggaagagtggaagggcaggagtcacgacttaccgacggaccaccccgagaacacagtctacatgacaactcgacgagcctagagagctagacgacacggtccgtactattacgtgtcgacgtagtacttgtttcgtgttcagtcgtaactaagtttagacttaggacttacgtagtacggaactcggtacttcggtacgggg

SEQ ID NO: 98646 - DNA, 594 bp, Homo sapiens
  misc_feature: GYAE6OF02FTWLK.17.10.A10.1.454.CMB.1.raw
  modified_base (290)..(290): a, c, t, g, unknown or other
  misc_feature (290)..(290): n is a, c, g, or t
  modified_base (374)..(374): a, c, t, g, unknown or other
  misc_feature (374)..(374): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacgggcccccgganaagggcttggaggtggggtggggtgggtcgaggcggtcgtttggacggtaaggcacgagtatgcaccgaagagtaggaaggganaggagtacgacgtagtaaccgacggacccaccccgacgaaacacgtagtacctacattcgacaacgtggacgacgccgtagagacgctagacgacgacggtcccgtattacgtacgtgtacgacgtaagtacttgttttcgagttactagttacgtaactagtttacgtaagttacggtcttactagttaccggattcgggtacctttcggtaccggggg

SEQ ID NO: 98647 - DNA, 545 bp, Homo sapiens
  misc_feature: GYAE6OF02G6RPA.17.10.A10.1.454.CMB.1.raw
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (485)..(485): a, c, t, g, unknown or other
  misc_feature (485)..(485): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcganacggcccccgganaagggcttggagtggggtgggtgggtcgaggcggctttggacggtaaggcacgagtatgcaccgaagatggaagggcaggagtcacgacttaccgacggacacccccagaaccacacgtcacatgacaactgaacgagcctagagacgctacgacgacacggccgtatacttaccgtgtcgacgagtactgtttcngtcatcgtaactatttgagttacggacttcgtagtcggactacggtacttcgtaccgggg

SEQ ID NO: 98648 - DNA, 598 bp, Homo sapiens
  misc_feature: GYAE6OF02HDWN4.17.10.A10.1.454.CMB.1.raw
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (423)..(423): a, c, t, g, unknown or other
  misc_feature (423)..(423): n is a, c, g, or t
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttacacaaaatntggtatgaattggtgcgacgacgggcccccggaanaagggtcttggaggttgggggtggggtgggtcgaggcggtcgtttggaacggtaggcacgtagtatgacacgagagtaggaagggcagagtacacgtataccgacggaccaccccgacgaacacagtctaanatacgactaactggacgacgtccgtagagagctagaccgtacgaccgtccgttactatttacgngttacgacgtagtaacttcggttttcngtacttacgttacgtaactaggttttacgaagttaggttaccttgttaacgtcgggtaacgttgggtaccgttcgtacgggggg

SEQ ID NO: 98649 - DNA, 691 bp, Homo sapiens
  misc_feature: GYAE6OF02GIANV.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgaattgggtgcgacgaggcccccggacaagggtcttggaggtggggtggggtggtcgaggcggtctttaggacgggtaaggcacgagtatcgcgaacgaaagagtaggaaacggggcaaggtacgtaccgaacgtaacgtttaacccgacggaaaccccaccccccgaaacggaaaccaccaggtacctacacgtcgacaaaccgtcggaacgacgccgtagagacgtcgtacgaccgaaccgccgggacccgttacttacgttttacgtggtacggaccgtaaaggtaattttcggtttttactcgggttttacacgtttaccggttaaacgttaaacgtttttggaaacgtttaacgggtccgtttaccgtttaggtaccgggtttacggtacggggttacccgttttcgggtaacccggggggg

SEQ ID NO: 98650 - DNA, 551 bp, Homo sapiens
  misc_feature: GYAE6OF02GSRGA.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttggaggtggggtggggtgggtcaggcggctttggacggtaaggcacgagtatgcacgaagatgaagggcagagtcacgataccgacggaccaccccagaacacagtcacatagcaactgacgacgcctagagacgctgacgacacggcgtactattactgtcgcgaagtattgtttctgtactagttacgtaactaagtttcgaagttacggtcttacgttagtcggtacgttaggtaccgttggtaccggggg

SEQ ID NO: 98651 - DNA, 535 bp, Homo sapiens
  misc_feature: GYAE6OF02G4235.17.10.A10.1.454.CMB.1.raw
  modified_base (352)..(352): a, c, t, g, unknown or other
  misc_feature (352)..(352): n is a, c, g, or t
  modified_base (438)..(438): a, c, t, g, unknown or other
  misc_feature (438)..(438): n is a, c, g, or t
tcagcgtagactagcacgaccggtgctcgatttagcgtcgatctcaggggacccaaaaaccacacccctccttgggagaatcccctagatcacagctcctcaccattgactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacacggccccggacgaagggtcttggaggtggggtggggtgggtcgaggcggcgtttggacggtaaggcacgagtangcaccgaagatgaagggcaggagtcacgattaccgacggaccaccccgagaacacagtcacatgacaactgacgagctagagagcngacgacgacgccgtactatacgtgtacgcgaagtattgtttctcgtctactcgtactagttgagtagtctcgtagtagtacgtgtacgttgtacggg

SEQ ID NO: 98652 - DNA, 610 bp, Homo sapiens
  misc_feature: GYAE6OF02JGQY1.17.10.A10.1.454.CMB.1.raw
  modified_base (462)..(462): a, c, t, g, unknown or other
  misc_feature (462)..(462): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagagccgtgggcatcagtgactgtctccgtgacaaggccagtggatatatcttcaacaaatatggtatgaagttgggtgacgacgacggccccggagaagggtcttaggaggtggggtggggtggtcgaggtcgggtcgtttaggacggtaagcacgtagtagtgacgacgaaggagtacggaagggcaggagtacaacgtactaccacggaccaaccccaagacacgtagtactaacgatacgacaacgtagacgacgctagganagacgtagaccgtaacgccggtacgttaccgtacgtaacgtcgtacgacgtaagtacgtttgtttccgtaggtctaacggttacgtaacttaagtttgtaacgtacggtacttcgttagtacgtcgttaggtaccgttcggtaccggg

SEQ ID NO: 98653 - DNA, 649 bp, Homo sapiens
  misc_feature: GYAE6OF02I06EO.17.10.A10.1.454.CMB.1.raw
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatctcaacaaatatgtatgaagttgggtgcgacgacgggacccccggagaagggtcgttaggacgggtggggttgggggtggggtcgaggtcgggtcgtttaggacgggttaaggcacgtaggttatcggcaccggaaagtgtaggaagggcaaggtagtaccgaacgtacttaacccgaacggaccccaaccccgaacgaaccaaccgtacgtacctacatcgacaacgtgaccgagcctagagacgctacgacgacgccggtaccgttacctactttacgtggtagtcgtaagtacgtttacgtttctacgttactagttaccgttaattaacgttttagtaacggtcggttacttacgttaggttacgggtacgtttagggttaccggtttcggtacccggggg

SEQ ID NO: 98654 - DNA, 637 bp, Homo sapiens
  misc_feature: GYAE6OF02I9MM8.17.10.A10.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcgcccacgcccaggttcaggttggtgcaggactggggctggaggtgnagagccgtgggcatcgagtgactgtctcctgcaaggccagtggatatatcttacacaaaatntaggtataggtaattggtgacgacacgggcccccgaagacgggcttgaggtggggtggggtggtcaggcggtctttaggacgggtaagcgacgagtatgcgtaacggaagatagggaaggacgaggacgtcgaacggtaacttacggaacggacccaaccccgacggtaaaccacgacgtacttaccgatcgaactaatacggacgacgtacctagacgacgcgtacgaccggaaccgacggcccggttattaacggtacttggttacgacggtagtaaagtttcgtttaactcggtaccttagttcgtaaacgttaatttcggaatcggtccttaagttccgtaggaccgtttaggtacgtcggttacggggg

SEQ ID NO: 98655 - DNA, 615 bp, Homo sapiens
  misc_feature: GYAE6OF02INTE2.17.10.A10.1.454.CMB.1.raw
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttggaggtgggtggggtgggtcaggcggctttgacggtagcacagtangcacgaagatgaagggcagagtcacgattaccacggaccaccccagaacacagtcacatgacaactgacgagcctggagacgcgtcgacgacaccgggtccgtacttacgttacgtgtcggaccgtaagtaaacgtttgtttttacgtaggttacctaacgtttaccggttaacttaaagttttacggaacgtttaacggggtaccctttacgtttaacggttacgggtaaccgtttacggggttacccgttttcggggtaacccggggggg

SEQ ID NO: 98656 - DNA, 561 bp, Homo sapiens
  misc_feature: GYAE6OF02GLAX2.17.10.A10.1.454.CMB.1.raw
  modified_base (294)..(294): a, c, t, g, unknown or other
  misc_feature (294)..(294): n is a, c, g, or t
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaacggccagtggatatatcttcaacaaaatatggtatgtaattgggtgcgacgacggcccccggaanaacgggcttggaggtggggtggggtgggtcgaggcggtctttggacggtaggcacgagtagtgcgaccgaagagtggaaggcgagacgtcaacgactaccgaccgaccaccccgacgaacacacgtactaacatcgacaacgtgacgacncgtacgacgngctagacgaccgacggccgtactacttactgtcgacgatagttcgtttctgtactacgtacgtactatttgattagacttatacgtgacgtcggtacgttcgtcggg

SEQ ID NO: 98657 - DNA, 691 bp, Homo sapiens
  misc_feature: GYAE6OF02HANL6.17.10.A10.1.454.CMB.1.raw
  modified_base (290)..(290): a, c, t, g, unknown or other
  misc_feature (290)..(290): n is a, c, g, or t
  modified_base (601)..(601): a, c, t, g, unknown or other
  misc_feature (601)..(601): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacacggcccccgganaagggcttggaggtggggtggggtgggtcaggcggtcgttttggacgggttaaggcgtacgaggtagtgaccgaaccggaaagagtaggaacgggcaaggtagtaccaacgtaacttaacccgaccggtaacccaaccccccgaacgaaccaacgacgtacctaacgacgtcgaacctaaacgttcggaaccgtacggaccgttaacggacggaacggccgtaacggaacccgaaccgtacccgggacccgttacgttaacgtttaccgtaggtacggtaacccgtaagtaaaccgtttcggtttttaccnggttacctacgttaccggtaattaaacgtttgaacgttaggtccttacgttagttacggtacgttacgggttaccttcgggtaccggggg

SEQ ID NO: 98658 - DNA, 621 bp, Homo sapiens
  misc_feature: GYAE6OF02HUJBX.17.10.A10.1.454.CMB.1.raw
  modified_base (210)..(210): a, c, t, g, unknown or other
  misc_feature (210)..(210): n is a, c, g, or t
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcancagtgactgtctcctgcaaggccagtggatatatcttcacaaaatatggtatgaattgggtgcgacgacggcccccggaacaagggcttgaggtggggtggggtgggtcaggcggtctttggacggtaaggcacaggtatgtacaccgaagngtagaagggcagagtacgagtaataccgacggtaccacccccgagaacacacgtctaacatacgacaactagacgacgcctgacggancgtagacgaacgccggtacccgtcttaacgttacctaggtcggaccgtaaggttaaacgttcggtttttacttagttccgtagtttaccggttaacgttaagtttacgaacgtttacggactttacggttaacgttaggtaccggtcgttaccgttacggttacccggggg

SEQ ID NO: 98659 - DNA, 731 bp, Homo sapiens
  misc_feature: GYAE6OF02IIL5B.17.10.A10.1.454.CMB.1.raw
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagacgtggggctgaggtgacagaagccgtggggcatcgagtgactgtctcctgacaggcagtgatatatcttacaactaaaattgtaggtatgtaagttggggtnacggacgacgggccccgagtaacgggtnttacggngggttgggggttggggtcggtcgaggtcggttcgtttggaacgggtagcgaacgagttagcgaccgaacggtaagaggtaggaagggtgaagcgtacaacggtaactaaccgaaccggaacccaaccccgaagaaccacgtacgttacctaacgatacggactaacgtacggacgtaacggtacctagggaagacgggtacctacgggaaaccgggtcgaacccgggtacccgttacttaaccggttacttacggtacgggtaccgtaagggttttaactttcggtttttaccgtacggttacgttaccgtttaacggtaaactttacgtttacgggtaaactttacggggttacttacgggtttagttacccggggtaggtttaacggtaccggttcgggttaacccggggg

SEQ ID NO: 98660 - DNA, 770 bp, Homo sapiens
  misc_feature: GYAE6OF02F8JGR.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctgatggcagcaggcacaggtgcccacgcccaggttcagttggtgcagactggggctgaggtgcagaagcctggggcatcagtgactgtctcctgcaggccagtgatatatcttacacaaaatatgtatgaattgggtgcgacacggccccgacgaagggcttggaggtggggtggggtgggtcgaggcggtcgtttaggacgggtaaggcgacgaggtatcggaccgaaccggaaggagtagggaacgggcgaaggacgtacgaacggtaacgttacccgacccgggtaacccaaccccccgaaacggaaacccaaccgtaacggttacctaaaccgtagtacgacccgtaaaccgttacgggaaccggtaaccggaccgttagggaaccggtacgggtacccgtaacggaacccgggtaacccggaacccggggtaccccgttaccgtttaaacggttttacccgttagggttaccggtaccggtaaacggtttaaacgttttcgtttttttaccgtacggtttactaaccgttttacccggttaaccttttaaaggttttcggtaaacggtttaacgggttcctttacgtttaacgggttacgggtaacgttttcgggtaaccgttttcccggggg

SEQ ID NO: 98661 - DNA, 625 bp, Homo sapiens
  misc_feature: GYAE6OF02IOPLT.17.10.A10.1.454.CMB.1.raw
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (509)..(509): a, c, t, g, unknown or other
  misc_feature (509)..(509): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgatatatcttcacaaatatggtatgaattgggtncgacaggcccccgganaagggcttggaggtggggtggggtgggtcaggtcggctttggacgggtaacggcacgaggttatgcaaccggaagacgtggaagggcaaggagtcaacgattacccacggtaccaacccccgacgaaacgaccaagtccaacgacttagaccaaacgtggaaccgacgccttaggacgacggctacgggaacgtacgaccggtaccgttactatttaaccgnggttacgacgttagtaagttcgttttacgtcggtactaagttcggtaaccttaagtttggtaaacttcgggtacctacgtttacgtcggtaacgtcggtacgttcggtaccggggg

SEQ ID NO: 98662 - DNA, 664 bp, Homo sapiens
  misc_feature: GYAE6OF02GUGXD.17.10.A10.1.454.CMB.1.raw
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (427)..(427): a, c, t, g, unknown or other
  misc_feature (427)..(427): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcaggttggtgcagactggggctggaggtgcagaagccgtggggcatcagtgactgtctcctgacaaggccagtggatatatcttacaacaaaatatggtatgtaagttgggtgcgacgacgggcccccggagagggcttggaggtggggtggggtgggtcgaggtcggtctttggacggtaagcagagtancgacaacgagagtaggaaggnagacgtcaacgactaaccgacggaccacccacgaacacacgtcaacngtacgacaacgtgaccgacgtccgaggaacgacgccgtacggaaccgaccgaaccgggtcccgttacgttaacgttcgtaggtcgtaaccgtaagttaacgttttcggtttaccttaggttaccttaacgtttaccggttaattaacggtttttacggaacgtttaacggtacctttacggttaacggttaccggttaccggtttacgggttaccgtttccgggttaaccggggggg

SEQ ID NO: 98663 - DNA, 657 bp, Homo sapiens
  misc_feature: GYAE6OF02FNQR2.17.10.A10.1.454.CMB.1.raw
  modified_base (291)..(291): a, c, t, g, unknown or other
  misc_feature (291)..(291): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcacaaaatatggtatgaattgggtgcgacacgggcccccgganaaggggcttggaggtggggtggggtgggtcaggcggtctttggacggtaggccanagtangcaccgaagagtaggaagggcaaggacgtcgaacgacttaaccgacggacccacccccacgaaccacacgtacctaacgatcgactaacgtgaacccggagcccgtagacggtacgcgtagaccgaaccgtccgggacccgttacttacgttaccgtggttacgggacgtaacggtaaactttcggtttttaccgttacggttaccgtagtaccgttaaacgttaacgttttagggtaacttaacgggtactttacgttacgggttacggtaaccggtttcgggtaccgtttccggtaccgggggg

SEQ ID NO: 98664 - DNA, 643 bp, Homo sapiens
  misc_feature: GYAE6OF02I8KL6.17.10.A10.1.454.CMB.1.raw
  modified_base (289)..(289): a, c, t, g, unknown or other
  misc_feature (289)..(289): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactgggactgaggtgcagaagcctggggcatcagtgactgtctcctgcaaggccagtggatatatcttcacaaaatatggtatgaattgggtgcgacaggcccccgganaagggcttggagtgggtgggtggtcagcggctttgacggtagcacagtatgcacgaagagtgaagggcaggagtcagattaccgacggacaccccgagaacacagtctaacgatacgactaacgtagacgtagcccgttagaacgtacgacttacggaacgaccggaacggtcccgttaccgttaacgttaccgttggtaaccgtaccgtaaaggtaaacgtttaggtttttaccgtacggttaccgtaaggttaccggttaacccgttaaagtttttcggaacgtttacgggtaccgtttacgttaaggttaccggtaacgtttacgggtaccgtttcgggtaacccgggggg

SEQ ID NO: 98665 - DNA, 580 bp, Homo sapiens
  misc_feature: GYAE6OF02IFQ49.17.10.A10.1.454.CMB.1.raw
  modified_base (408)..(408): a, c, t, g, unknown or other
  misc_feature (408)..(408): n is a, c, g, or t
tcagcgtagactagcacgaccggtgctcgatttagcgtcgatctcaggggacccaaaaaaccacacccctccttgggagaatcccccagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttacacaaaatatggtatgaattgggtgcgacaggcccccgaacgaagggcttgaggtgggtgggggtgggtcgaggcggtctttaggacgggtaaggcacgagtatgcacgaagagtaggaaggcagagtcacgattaccgacgaccaccccacgaacacanctacatgacaactgacgagccgtgacgagcgtagaccgaacgaccggaccgtacttacgttacgtcgtacgacgtaagaacgtttgttttcgtgtactagttacggttaactaacgtttagtaacgtacgtacttcgttaagtcggtacttacggtaccgttgtaccggggg

SEQ ID NO: 98666 - DNA, 704 bp, Homo sapiens
  misc_feature: GYAE6OF02H5NYL.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctctgcgaaggccagtggatatatcttacaacaaaatagtgtatgtaagttgggtgacgacgacggcccccggagaaggtcgttggaggtgggggttaggggtgggtcgaggcggtcgtttggacggtaaggcacgagtatcggaccgaaccggaagagtagggaacgggtacgaaggtacgtacgtaaaccgtaacgtttaacccggaaccggaacccctaaccccccgaacgaaaccaaccgtaacgtactaaccgacgtacgactaacgtcggaaccgacgtaccgttacggagtacgacgttacgaccggtaccgaccgggtcccgtacgttacgtttaccgtggtacggtaccgtaaggttacgtttacgttttacgtgttacctaacgttacgttaacgttaacgtttagtaagttacgtaccgttacgtacggttacggtacggttacgggttaccgttacgggtacccggggg

SEQ ID NO: 98667 - DNA, 676 bp, Homo sapiens
  misc_feature: GYAE6OF02H26FH.17.10.A10.1.454.CMB.1.raw
  modified_base (261)..(261): a, c, t, g, unknown or other
  misc_feature (261)..(261): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagccgtggggcatcagtgactgtctcctgcgaaggccagtggatatatcttcaactaaaatntagtatagtaagttgggtgacgtacgacggtcccccggaagaacgggcgtttaggagggttgggggtagggggtcggggtcgaggccgggttcgtttaggacgggttaaggcacgtaggtatggactaccggaagagtaggagggacaggatacgacgtaacttacccgaacggacccaacccccgaacgaacaaccgtataccgtacaatcgacaacgtggaaccgacgccgtaggaagcgtacgtacggaccgaacgccggtaccgttacttacgtttactggttacgaccgtaaggtactttacggttttactcggttactacggttccgtttaacgttaacgtttaggttaacgttacggttcttacggttacgtacggttacggttacggttccgttcggtaacccgggg

SEQ ID NO: 98668 - DNA, 639 bp, Homo sapiens
  misc_feature: GYAE6OF02GWOS8.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatagaattgggtgcgacaggcccccgganaagggctgaggtggggtggggtgggtcgaggcggtcgttggacggtaaggcacagtatgcacgagatggaagggcagacgtacacgattaccgacggaccaaccccgacgaacacagtactagagtcgacaacgtggaacgacgaccgtaggacgacgtcgtacggaaccgaacgtaaccgggtaccgttaccgttaattttaccgtggttacggaccggtaaaggtaacgttttggttttccgtaggtttaccgtacgttaaccggttacttaagttttaacggaacgttacggtaccttacgtttaacggtacggtacgttcgggttaccttcgggttaccgggggg

SEQ ID NO: 98669 - DNA, 606 bp, Homo sapiens
  misc_feature: GYAE6OF02HB595.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggccccccggacaacggggcttggaggtggggtggggtgggtcaggcggctttgacggtaaggcacagtatgcaccgaagatgaagggcaggagtcacgattaccacggaccaccccagaacacagtctacatcgcaacgtgacgagcctagagagctgaccgacgaccgggccgtacgttaactttaccgtggtacggaccggtaagtaaagtttcgtttttacttcggttaccgtactttccggtaacttaacgttttaggtaacttaacgggtccttacggttacgttcgggtaaccgtttagggtaccgtttcggtaccgggggg

SEQ ID NO: 98670 - DNA, 618 bp, Homo sapiens
  misc_feature: GYAE6OF02ITB7F.17.10.A10.1.454.CMB.1.raw
  modified_base (515)..(515): a, c, t, g, unknown or other
  misc_feature (515)..(515): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagaagcctggggcatcagtgactgtctcctgcaaggccagtggatatatcttacaacaaaatataggtatgtaagttgggtgacgacgacggcccccggacgaagggtcttaggaggtggggtggggtgggtcaggcggtgtttggacggtaggcgaagagtatgacaccgaagactaggaagggcaggacgtcaacgacttaccgaaccggtaccaaccccgacaaaccgacaacgttccaacgtacgtagacaacgtagacgacgcctagagacgccgtagaccgaccgacggaccgttactacgttactggtacgngtaagtaacgtttgtttacgttgtactagttaccgttaattaacgtttggtaagtacggtacttacgttacgtggtacgttcggttacgttcggtaccggggg

SEQ ID NO: 98671 - DNA, 780 bp, Homo sapiens
  misc_feature: GYAE6OF02HD8SN.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctggaggtgcagaagccgtggggcatcagtgactgtctcctgcaacggccaggtggatatatcttacaactaaaattgtaggtataggtaagttggggtgaccgtacgaccggggccccccggaagtaacggggtctttacgggagggttggggggttgggggtagggggtccgtaaggggtccgggtacgtttttacgggaacggggttaaagggcccgtaacgtagggttacgtcggacccgaaacccgggtaaaggaacgttagggaaacggggcaagggaacggtaccgaaaccgtaaacgtttaacccggaacccgggtaaccccaacccccccgaacggaaacccaaccgtaacgttacccaaaccgtaagttaccggaacctaaaccgtagggaaccgtacgtacccgttaggaaacggaccgtcgtaacggaaccggaccgaacccgggtaccttaccgttacgttacgttacggtacgaacgttacgtaaaggtttcgttttactagtcctagtttaccgtaattaagtttgaagttccgtacttagttagtacggtacgttggttaccgttcggtaccggggg

SEQ ID NO: 98672 - DNA, 586 bp, Homo sapiens
  misc_feature: GYAE6OF02FY4P4.17.10.A10.1.454.CMB.1.raw
  modified_base (290)..(290): a, c, t, g, unknown or other
  misc_feature (290)..(290): n is a, c, g, or t
  modified_base (494)..(494): a, c, t, g, unknown or other
  misc_feature (494)..(494): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccgganaagggcttggagtggggtggggtggtcaggcggctttggacggtaaggcacagtatgcacgaagatgaagggcagagtcagattaccgacggaccaaccccgacgaacacagtctaacatgacaactgaccgagcctggagagctagacgtaccacgggtcccgtacttacttacgtgtacggcgaataacgttgtttttacgngttacgtattcggttaacttaagttttacggtaacgttaggtcctttacgttagttagggacgttacgggttaccgttggttacccgggggg

SEQ ID NO: 98673 - DNA, 559 bp, Homo sapiens
  misc_feature: GYAE6OF02IQP36.17.10.A10.1.454.CMB.1.raw
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
  modified_base (461)..(461): a, c, t, g, unknown or other
  misc_feature (461)..(461): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcacaaaatatggtatgaattagggtncganaggccccgacaaagggcttgagtgggtgggtgggtcaggcggntttgacggtaagcacagtatgcaccgaagatgaagggcagagtcacgattaccacggaccaaccccaggaaccncaacgtctacatacgcaactgaacgagccttgagacgctgacgtaccagggtccgtactacgttacgngttgaccgtaagaaacttagttttcagttacgattccggtataaaccgtttgaattacgggcttacgtacttggaaccttggtaccttgtaccggggg

SEQ ID NO: 98674 - DNA, 652 bp, Homo sapiens
  misc_feature: GYAE6OF02F4J3F.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagagcctgggcatcagtgactgtctcctgcaggccagtgatatatctacacaaaatataggtatgaatttgggtgcgacgtacgggaccccccggaagaacgggtcttggaggttgggggtagggggttgggtcgaggcgggtctttggacggtaggcacgagtatgcgaacggaagagtaggaagggcaggtagtacgaacgtacgttaacccgaccggtacccaacccccgaacgaaccaacgtacgtcctaacgacgtacgacctaacgtcgaaccggtacgccgtaggacggacgccgtaggaccgtacgacggtcccgtagttacttacgtgtacgagtaacgtagtttgttttcctgtcgtaacgttcggttaacttagttttacggaacgttacggtacgtttacgtaggttacgtacggttacggttacgtttcggtaacccggggg

SEQ ID NO: 98675 - DNA, 550 bp, Homo sapiens
  misc_feature: GYAE6OF02FILPL.17.10.A10.1.454.CMB.1.raw
  modified_base (288)..(288): a, c, t, g, unknown or other
  misc_feature (288)..(288): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatctcacaaaatatggtatgaatttgggtgcgacaggcccccgganaagggcttgaggtggggtggggtggtcgaggcggctttggacggtaaggcacgagtatgcactagatgaagggcagagtcacgattaccacggaccaccccacgaacacagtcacatgacaactgacgagctgagagctgacgacacggcctatacttactgtcgcgaataagtttcgttttcgtgttaccagttaccgttaacttaattttcggaagttacggtcttacgtacgtggtactcggtacgttcgtaccggggg

SEQ ID NO: 98676 - DNA, 674 bp, Homo sapiens
  misc_feature: GYAE6OF02HBABA.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccaggtggatatatcttcacaaaatatggtatagaagttgggtgcgacgaggcccccggacaagggctggaggtggggtggggtgggtcgacggcgggcgtttaggacgggttaaggcgacaggtaatggacaccggtaagagtaggaagggtcaggagtacaacgtacttaacccgacggacccaacccccgacgaaccaccgagtacctacagttcgacaactacggaccgacgtccgtaggaacgacggcctgggaaccgaaccgaacccgggtccgttaccgtattttaaccgtggttacggaccgtaaggtaaactttcggtttttccgagtttaccgaactttaccggttaaacttaacgttttaggtaacgttacggttcctttacgttacggttcggtaacggtttcgggttaccgttttaccggtaccgggggg

SEQ ID NO: 98677 - DNA, 612 bp, Homo sapiens
  misc_feature: GYAE6OF02IW6YZ.17.10.A10.1.454.CMB.1.raw
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (521)..(521): a, c, t, g, unknown or other
  misc_feature (521)..(521): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgccccacgcccgaggttcggttggtgcagactggggctggaggtgcagaagcctggggcatcagtgactgtctcctgcaggccagtggatatatcttacaacaaatatggtatgaattgggtgcgacacggcccccggacaagggctgagtggggtggggtgggtcgaggcggtctttggacggtaaggcacngtatgcgaccgaanagtaggaagggcagagtacgacgtataccgaccggtaccacccccgaacgaacacaacgtactacatacgacaacgtacgaacgacgctaggagtacgactgaacgacgaccggccgtacttacttacgttagtcggacggaataacgtttgtttttaccgngtttaccagttaccgttaactaacggttttagaagttacgtcgttaagttctagggttaccgtgggtacgtttacggtcgggtacccgggg

SEQ ID NO: 98678 - DNA, 679 bp, Homo sapiens
  misc_feature: GYAE6OF02F3BKL.17.10.A10.1.454.CMB.1.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcaggttggtgcagacgtggggctggaggtgcagagccgtggggcatcagtgactgtctcctgcaacggcaggtgatatntcttanaacaaattntggtatgaagtttgggacgcgtacgaccgggaccccgaagtaagggtcgttaggagggttgggggttaggggtacgggtnacgggtcgggttactttacgggaacgggttacggctaacgtaggtacgtcgacgtaacgaagtagtaggaacgggtcaaggtcgacgaacggtacttaacccggaaccggtacccaacccgacgaanaccgtntacgactacgtcgactaacgtagacgagtccgtagagacgctacggaccgacgaccgggtccttagttacgttacgtggacgacggttaagtacgtttttgttctacggttataccgtttacgggtaactttaggtttacgtacgttaacgggtctttaacggtgtaccggttacggttccgtaacggtttcgggacccgggg

SEQ ID NO: 98679 - DNA, 630 bp, Homo sapiens
  misc_feature: GYAE6OF02HHMF5.17.10.A10.1.454.CMB.1.raw
  modified_base (260)..(260): a, c, t, g, unknown or other
  misc_feature (260)..(260): n is a, c, g, or t
  modified_base (397)..(397): a, c, t, g, unknown or other
  misc_feature (397)..(397): n is a, c, g, or t
  modified_base (551)..(551): a, c, t, g, unknown or other
  misc_feature (551)..(551): n is a, c, g, or t
tcagcgtagactagcacgaccggtgctcgatttagcgtcgatctcaggggacccaaaaccacaccctccttgggagaatccctagatcacagctcctcaccatggactggacctggagcatccttttcctggtgcagcaggcacgaggcgcccacgccctaggttcaggttggtgacagacgtggggctggaggtgacgaggaagccgtggggcagtcagtgactgtctactgacaaggccagtggatatatcttacaanaaaatatggtatagtaagtttcgggagcggacacgggcccccggaagaagggtctagtagggtggggtagggtggtaggacggtcggtcgttttacggaacgggttaaggaccagtaagtagtcgactaaccggaanagtaggagggacaggtacgctaacgtaacgtacgaacgacccaaacccgagaacacgacgtactacgatagacaacgacgaacgacgtacgtaggactagacgagacgacacgggaccttactagttatcgtagtacgtaagtaattcgttttnagtacgtagttactaattactttaggaaccgttggtactacgttaggtacggtacgtagttaccggttcggaaccgggg

SEQ ID NO: 98680 - DNA, 311 bp, Homo sapiens
  misc_feature: GYAE6OF02HDPXW.17.10.A10.1.454.CMB.1.raw
  modified_base (293)..(311): a, c, t, g, unknown or other
  misc_feature (293)..(311): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggcctgccccctggtcactctcgttccccgccctcctcctacgtctacgcctgagcgggctggcaaggcgcagtagnnnnnnnnnnnnnnnnnnn

SEQ ID NO: 98681 - DNA, 300 bp, Homo sapiens
  misc_feature: GYAE6OF02GME11.17.10.A10.1.454.CMB.1.raw
  modified_base (176)..(176): a, c, t, g, unknown or other
  misc_feature (176)..(176): n is a, c, g, or t
  modified_base (289)..(300): a, c, t, g, unknown or other
  misc_feature (289)..(300): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagccctgacttctggggtnttcggcagtgggaccaagctgaccgtcctaggtcagcccaaggctgccccctcggtcactctgttcccgccctcctcctagtctacgctgagcgggctggcaaggcgcatagnnnnnnnnnnnn

SEQ ID NO: 98682 - DNA, 692 bp, Homo sapiens
  misc_feature: GYAE6OF02GI9DM.17.10.A10.1.454.CMB.1.raw
  modified_base (298)..(298): a, c, t, g, unknown or other
  misc_feature (298)..(298): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccagtggatatatcttacaacaaaatataggttatgtaagttgggtgcgacgacgggcccccgganaacggggcttggaggtgggtggggtgggtcaggcggtcgtttggacggtaaggcacgagtatgacaaccggaagagtaggaagggacagacgtcgaacgtacttacccgaaccggaacccaacccccgtaacggaaacccaccgtaacgtacctaacgacgtacgactaaccgtacggaaccgacggccgttacggagacgtctacggaccgtaaccgccgggtacccgtacttaattaccgttggtacggtaccgtaaggttaaactttcggtttttcgtacgttaccgtaatttaccggttaattaaacgttttagggtaacgtttagggttacccctttaggtttaacgtaccggttacggtttacgggttaccgttcccgggtacggggg

SEQ ID NO: 98683 - DNA, 559 bp, Homo sapiens
  misc_feature: GYAE6OF02IS9K1.17.10.A10.1.454.CMB.1.raw
  modified_base (361)..(361): a, c, t, g, unknown or other
  misc_feature (361)..(361): n is a, c, g, or t
  modified_base (534)..(534): a, c, t, g, unknown or other
  misc_feature (534)..(534): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcaggaagcctggggcatcagtgactgtctcctgcaaggccagtggatatatcttacaactaaaatattggtatagtaagttgggtgcgacacggacccccggagaacgggtctggaggtgggggtggggtgggtcgaggcggtctttggacggtaaggcacgagtntgcaaccgagtatggaaggcagagcagataccgacgaccaacccgacgaacacagtactacatacgacaacgtgaacgacgacgtgaagagcgtacgacgaccgacggtccctcttagtactggtacacggtaatctttagttctagtctagtactagttaattgatacggtntacgtagtcgagtcgtctggacggg

SEQ ID NO: 98684 - DNA, 577 bp, Homo sapiens
  misc_feature: GYAE6OF02GDYTP.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacacaaaatatggtatgaattgggtgcgacgacggcccccggagaagggcttggaggtggggtggggtggtcgaggcggctttggacggtaaggcacgagtatgcacgaagagtggaaggcagagtcagactaccgacggaccaccccgacgaacacagtcacatgcaactgacgacgctagagacgctgaaccgacgaccggtccgtatacttacgtgtcgacgaagttaacttcgttttacgtcgttactaacgttaccggttaacttaagtttacgaagttaggtccttagtacgtcggtagttacgggtacgttcggtaccggggg

SEQ ID NO: 98685 - DNA, 799 bp, Homo sapiens
  misc_feature: GYAE6OF02IIHU1.17.10.A10.1.454.CMB.1.raw
  modified_base (627)..(627): a, c, t, g, unknown or other
  misc_feature (627)..(627): n is a, c, g, or t
  modified_base (743)..(743): a, c, t, g, unknown or other
  misc_feature (743)..(743): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcgcccacgcccgtaggttctagttggtgacagacgtggggctggaggtgcgagaagccgtggggcagtcgagtgacttgtctccgtgacgaacggccgaggtggaattatatcttacaaactaaaattagtaggtataggtaagttgggacgacggacgaccgggacccccggaagtaacgggcgtttaggacgggttgggggtggggtacggtcgacggtccgggtcggttttagggaaaccgggtaaggtccgaagtaggtacgtacggaccgaacgggtaaagtaggtaacggaaacggggacaaggtacggtaacgtaaacggtaaacccgttaacccggaaaccccggtaacccgaaaccccccggaaacgaaaccgtaaccggtaacccgttaaccgtaaacgacgttaccgggaaacctaaaccgggttacccggaaagggtcccgtacgtaacgggacggtaacnccgggtaaacgaccggtaaccgaccggggtaccctttataaacgtttcggtagggtacgtaacggtaacgttaagttttccgtttcgtacgtacgttagtacggttaataggttanaaggttcgaccgttagtttacggcggttaaggtacggttaccgtcggggtaccggg

SEQ ID NO: 98686 - DNA, 572 bp, Homo sapiens
  misc_feature: GYAE6OF02JDEGH.17.10.A10.1.454.CMB.1.raw
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttacaacaaaatatggtatagaattgggtgcgacaggcccccggacaagggcttgacgtggggtgggtgggtcgaggcggctttggacggtaaggcacagtntgcacgagatgaaggcagnacgagattacacgtacacccgacgaacacagtcacatgacaatcgacgtacgaccttgaaggagaccgtgaacgaccgacggacccgttactacgttacctaggtcgacgtaagtaattcgttttactagtctaagttacgtaacttaatttacgtagtaacggtactcgttacgtacggtactcggtactttccggtaccggggg

SEQ ID NO: 98687 - DNA, 603 bp, Homo sapiens
  misc_feature: GYAE6OF02GWZ19.17.10.A10.1.454.CMB.1.raw
  modified_base (524)..(524): a, c, t, g, unknown or other
  misc_feature (524)..(524): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatagaatttgggtgcgacacggcccccggacgaagggcttggaggtggggtggggtgggtcgaggcggtcgtttggacggtaaggcgacagtagtgacacggaagagtggaagggcaggagtacgacgtacttaccgacggaccaacccccgaacggaaccaacgagtacctaacactacgacaaacgtgaaccgagcctagagacgcgtagaccgaccgacggtccgtattactacgtgtacgcgtaagtaattcgttttncgttactagttcgtaacttaagtttacgaagttacgtcttacgttagtcggtaactcgggttacttacggtaccggggg

SEQ ID NO: 98688 - DNA, 682 bp, Homo sapiens
  misc_feature: GYAE6OF02HKQGI.17.10.A10.1.454.CMB.1.raw
  modified_base (381)..(381): a, c, t, g, unknown or other
  misc_feature (381)..(381): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttcaacaaaatatggtatgtaattgggtgcgacgacgggccccggacgaagggtcttggaggttgggggtggggtgggtcaggcggtcgtttggacggtaaggcacgagtatgaccaacgaagagtaggaacggnaggacgtacaacgtacttaccgaaccggacccaacccccgtaacgaaccacgtacgtacctacacgtacgactaacgtacgacgacgccgtagacggtacgacctaggaaccggaaccgaccggtcccgttaacgttaacgttaccgttcgggtacgaccggtaagttaacgttttcggtttttaccgtacgttacttacgtttaccgttaacgtttaagttttacggaacgttacggtacccttacggttaacggttcgggttaaccgttacgggttaccggtttccgggtacccggggg

SEQ ID NO: 98689 - DNA, 688 bp, Homo sapiens
  misc_feature: GYAE6OF02GJZ82.17.10.A10.1.454.CMB.1.raw
  modified_base (173)..(173): a, c, t, g, unknown or other
  misc_feature (173)..(173): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
tcagcgtagactagcacgaccggtgctcgatttagcgtcgatctcagggggacccaaaaaccaccaccccgtccttgggagaacgttcccctagatcacagctcctcaccattggactggacccgtaggaggcaagttccttttcctgggtcggcagcacggcaccaacggtncccgacgcccaggttcacgttcggtcgtccagtaccgtggggctggacgggtgcaggaagccggtggggcatcgagtgactgtctcctgcaaggccagtggattatatcttcaactaaaatntaggttanagtaattggggtnacggacacggccccggagaacgggcttggaggtggggtggggtgggtcaggtcggcgtttaggacgggtacgcacgtagtaancggactaaccggaagntaggaaagggcaaggagtacgaacgtaactaacccggtacggaacccaaccccgaacggtaacaacacgtacacgatgactaacgtcggacgacgccgtagacgtagcctacgggaacaaccggaccggtaccgtacttacgtacgtcggttcgaggtaaactgtttacggtttcacgttacctgttaaccggttaataacggtttacgaacgttacggtacttacggtaggttaccggaacgtttaccgggtcgtttacgggtacccggggg

SEQ ID NO: 98690 - DNA, 533 bp, Homo sapiens
  misc_feature: GYAE6OF02FWO4X.17.10.A10.1.454.CMB.1.raw
  modified_base (289)..(289): a, c, t, g, unknown or other
  misc_feature (289)..(289): n is a, c, g, or t
  modified_base (483)..(483): a, c, t, g, unknown or other
  misc_feature (483)..(483): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaatttgggtgcgacaggcccccgganaagggcttggagtggggtggggtgggtcaggcggtctttggacggttaaggcacgagtatgcacgagatgaagggcagagtacacgattaccgacggaaccaccccgacgaaccacagtctaacatgacaactgaacgagcctgagagctgacgacgaccgcgtactagttctgtcgcgaagtattgttttacngttcatcgtaacaatttgagttacgctatagtgactggtactggtacggg

SEQ ID NO: 98691 - DNA, 620 bp, Homo sapiens
  misc_feature: GYAE6OF02FYEQY.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttacaacaaaatatggtatgaattgggtgcgacaggccccccggagaacggcttggagtggggtggggtgggtcgaggtcggtcgtttggacgggtaaggcaacgaggtagtgccgaaccggaagagtggaaagggtcaaggagtacgacgaacttaccgaacggacccaacccccgacgaaccaacacgtacctaacaactgacaaactcgaaacgcgccttaggacgtacgctacgaccgaacgcgggtaccctatacgttacgttggcgacgtaagtaagtttgtttcgtacgtcaagtttccgtaattaaagtttcgaacgttaggccttacggtaagttacggactcgggttaaccgttcggtaccggggg

SEQ ID NO: 98692 - DNA, 643 bp, Homo sapiens
  misc_feature: GYAE6OF02F1L5N.17.10.A10.1.454.CMB.1.raw
  modified_base (291)..(291): a, c, t, g, unknown or other
  misc_feature (291)..(291): n is a, c, g, or t
  modified_base (562)..(562): a, c, t, g, unknown or other
  misc_feature (562)..(562): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctcctgcaaggccagtggatatatcttcaacaaaatatggtatgtaattgggtgcgacgacggcccccgganaagggtcttggaggtggggtggggtgggtcgaggtcggtcgtttaggaacgggtaacggcgaacgtaggttagtggacgaaccggaaaggagtaggaaacggggcaaggtaacgtacaacgtaacgttacccgaacggacccacccccgaacgaaccaacgacgtactaacagtacgacgtaacgtaggacgacgccgtaggacgacgcgtagacgaccgacgggtcctacgttacttacgtgtacgacgtaagtaagtttcgttttacgngttactagttaccgtaactaattttaggaacttaggtcttagttacggttaggacgttagggttaccttgggtaccggggg

SEQ ID NO: 98693 - DNA, 666 bp, Homo sapiens
  misc_feature: GYAE6OF02FQ2ND.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcatcagtgactgtctcctgcaaggccagtggatatatcttcaacaaatatggtatagaagttgggtgcgacgacggcccccggacgaagggcttggaggtgggtgggggtgggtcgaggcggtcgttggaacggtaggcacgagtatgcacgagatggaagggcgagagtacaacgacttaccgacggacccaacccccgaacgaaccgacgaagtacctaacgacgtacgacaaccgtacggaccgacggtacccgtaggaacggacggtaccgtaggaaccgtaccgaacccgggtcccgtacgttacgtttaacgttggtacggacgtaaggttaaacgttttcgtttttacgtcgtttacgtagttaccgttaaccgtaattttacggtaagttacggtacttacgttaaggttcgggttacgtcggggttacgtttaccggttaccggggg

SEQ ID NO: 98694 - DNA, 603 bp, Homo sapiens
  misc_feature: GYAE6OF02IWLSO.17.10.A10.1.454.CMB.1.raw
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
tcagcgtagactagcacgaccggtgctcgatttagcgtcgatctcagggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtgggcatcagtgactgtctcctgcaaggccngtggatatatctcactaaaatatgtatgaattgggtgcgacnggcccccgganaacgggcttggaggtggggtggggtgggtcaggcggtcgtttggacggtaaggcacagtagtgacacgaagagtggaaggnaagaggtcaacgattaccacggacccaaccccgagaaccacgtaanctaacagtnacaacgtgaacgngcctagagacgntcgaaccgacgaccggccgtacttacttagtgtcggacgtaacgtaagtttcgtttacgtgttaccaagtttaccggtaactttaagtttacgtaagttaacggactttacttaggtaccggtacggttcggttacgttcggggtaaccgggg

SEQ ID NO: 98695 - DNA, 589 bp, Homo sapiens
  misc_feature: GYAE6OF02FPUNJ.17.10.A10.1.454.CMB.1.raw
  modified_base (273)..(273): a, c, t, g, unknown or other
  misc_feature (273)..(273): n is a, c, g, or t
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcctcagtgaaggtcctctgcaaggcttctggattcacgtttacctcctatagtatcaactgggtncgcaggccgctggacaccgacctggagtggagtgggatgggaccgaaccctaacgacgtggtcgtcacgagttgtcttcaccctntcccgtacgggacaggtaccttacagtcgaaccgacgaacctcctaccaataaccactacgcctaacngtgagtgaggcgccngacagtcagacgacncggtcctntattactggtcgcgtagacgtcccgtaggtacgtccgggtacgacgtacccgtacgggacgacggccggttcctttggaccgtttccggcggggtacccgaggggccttcccggtacggttcccg

SEQ ID NO: 98696 - DNA, 610 bp, Homo sapiens
  misc_feature: GYAE6OF02HUZ8T.17.10.A10.1.454.CMB.1.raw
  modified_base (275)..(275): a, c, t, g, unknown or other
  misc_feature (275)..(275): n is a, c, g, or t
tcagcgtagactagcacgaccggtgctcgatttagcgtcgatctcagggggacccaaaaaccacacccctccttgggagaactcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattggggtncgacacgggccccccggagaagggcctttggaggttgggggtgggggtaggggtcgaggtcggcgttttggacgggtaaggcacagtatgcaccgaagatggaagggcaggagtcaacgtattaccgacggaaccaaccccaagaacacacggtactaacatcgacaaacgtgaacgagccttagacgagctagacgacacgggccctactagtttacctgtcgacgtaaggaatttcggtttttactagttcctaagttaccgttaacttaacgttttgaacgttaggtaccttcttaggtacggtacttacgggtacttccggtaccgggggg

SEQ ID NO: 98697 - DNA, 656 bp, Homo sapiens
  misc_feature: GYAE6OF02GHT5Y.17.10.A10.1.454.CMB.1.raw
  modified_base (522)..(522): a, c, t, g, unknown or other
  misc_feature (522)..(522): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaaatataggtatagaagttggggtgcgacgacgggccccccggaagaagggtcttaggaggtggggtggggtgggtcgaggcggtcgtttggaacggtaaggcacgagtatgacaacggaagagtaggaagggcaggtagtacaacgtattacccgaccggacccaacccccgaagaaccactacgtcctaacattacgactaaccgtggaaccgacgacctaggaacgagctacggaccgacgacccggtacgttacttagttacgnggttagaccggtaaagtactttacggttttccagttaccgtaacgtttaccggtaattaagttttacgaacgttacgttaccgttacgtttaggttacgggaccgtttagggtaccgtttcgggtacccggggg

SEQ ID NO: 98698 - DNA, 783 bp, Homo sapiens
  misc_feature: GYAE6OF02HH1EW.17.10.A10.1.454.CMB.1.raw
  modified_base (692)..(692): a, c, t, g, unknown or other
  misc_feature (692)..(692): n is a, c, g, or t
tcagcgtagactagcacgaccggtgctcgatttagcgtcgatctcagggacccaaaaaccacaccctccttgggagaatcccctagatcacagctcctcaccatggactggacctggagcatcctttcctggtggcagcaggcacgaggtgcccacgcccgaggttcaggttggtgcagttcgtggggctgaggtgaagagccgtggggcctcgagtgaaggtctccgtgccgaaggtcttctaggtacttcgtaccgtttaccctcctaatcgtaacttccgaaccgtgggttcgccggtacccgacgggtcccgcgttacgggaacctaaacgtaccccgttaggacgggttaggggacgtagggggtacgtcgggtaacccggaaacccctaacgtacggtggggttacgtcgaacgtagggttccgtccttaccaccctacgttcccgtacgggactaaccgtactttaaccgagttaccgaaccctaggtaaaccctccctaccaacgtaaaccaccgtacgtaaccctaacagtacggacggttaggaaacggtcgtcccgtaagtaacttaaggtaccgtacggtaacccggtaccgtaacccgggtaccttaaccgttagtttaacctagggtaccgtacgggaactaaccggttaccccgaaacggtaggtttaaccccgggngtaaccgtcggttacccgaccgtacggtccgttacgtttcggaaccgttcggcggtaccggacgggtcccgtccgtacggtaccctaccgg

SEQ ID NO: 98699 - DNA, 778 bp, Homo sapiens
  misc_feature: GYAE6OF02GNMJM.17.10.A10.1.454.CMB.1.raw
  modified_base (214)..(214): a, c, t, g, unknown or other
  misc_feature (214)..(214): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
tcagcgtagactagcacgaccggtgctcgatttagcgtcgatctcaggggacccaaaaaccacgacccctccttgggagaatcccctagactcacagctcctcaccatggactggacctggagcatccttttcctggtggcagcaggcacaggtgcccacgcccaggttcagttggtgcagactggggctgaggtgcgagagccgtgggcatcngtgactgtactcctgcaacggccagtggactatactacttacaacaaatagtagtatacgtaagttgggtcncgacgacgggacccccgganacgggtcgttggagggttcggggtgggggtgggtcgaggcggcgtttcggacggttaacggcgacgtagtagtacggacgaccggtaaggaatacgggaacgggtacaagggacgttaccgaaaccgtaacttaaccccggaacccggaacccctaaaccccccggaaccgtaaaccgaaacccgtaacgttaacccgttaacgaacgttaggaaaccttaaccgtacggaaaccggtaccgtaccggttaaggacggaacgtaccgttacggaaccgtaacccgacgggttcccgtactttaacggtttaccgttcggtacggtaaccggtaagttaaacggtttttccgttttagttaccggttacgttaacgtttaccggtaactttaaaggtttaccgtaagttaaccggttcgtttacgttaggtaccggttacgtacggttttacccgtccgggttaacccggggg

SEQ ID NO: 98700 - DNA, 729 bp, Homo sapiens
  misc_feature: GYAE6OF02HZONJ.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagacgtggggctggaggtgcagaagccgtggggcatcagtgactgtctcctgcaaggccagtggatatattctacaacaaaatagtaggtataggtaagttggggtagacgacgacgggaccccccggaagaagggtcttaggagggttggggggtggggtgggtacgacggcgggtcgttttacggaacgggttaagggcaacgtaggtatggaccaaccggaagtaacgtaggaagggtcaagggaagtacgaacgtacttaacccgaacggaacccacccccgaaagaaccaactacgtactactaatgaactaacgtcgaacgacgtacgtaggagtacggtacgtacgaacgaccggaccggtaccgttacttaagtttaccggtaggtccgaacgggttaacgttaaagtttcggttttttacgtacgttaacgttaacgtttaacccggttaaactttaaagttttacgggtaagttaaccggttcctttaagttacggttaccgggtaacgtttacgggtttaccgtttagggtacccggggg

SEQ ID NO: 98701 - DNA, 671 bp, Homo sapiens
  misc_feature: GYAE6OF02J079G.17.10.A10.1.454.CMB.1.raw
  modified_base (277)..(277): a, c, t, g, unknown or other
  misc_feature (277)..(277): n is a, c, g, or t
  modified_base (425)..(425): a, c, t, g, unknown or other
  misc_feature (425)..(425): n is a, c, g, or t
  modified_base (591)..(591): a, c, t, g, unknown or other
  misc_feature (591)..(591): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcaggttggtgcagacgtgggggctggaggtgcaaggaacgtccgtggggcagtcagtgactgtcctccgtgacgaacggccaggtaggatatatcttacaaataaaagtntaggtataggtaagttcgggtacgcgtaaccggaccggaccccggaagacgggtcgtagggtaggtggggtggggtggtcgacggcggtcgtttaggacgggtagacgacgtagtacgtgaacgtaacggaagtaggtaggaacgggntaaggtactacgaactaccggtaaccgaaccggaacccctaacccaacgaccgtaagtaccgtaccgtaagagtacgaacgtacggacgaccgtagcgtagagtacggacgtacgaccggtacacggtccgttatacgttcgagtcgaagtgttaacgttgtttancgttaccgtaagtttaccgttaacgtattacgagttcgtagttacgtagttacgtaggtcgttacggttcgggaaccggg

SEQ ID NO: 98702 - DNA, 647 bp, Homo sapiens
  misc_feature: GYAE6OF02HPMX1.17.10.A10.1.454.CMB.1.raw
  modified_base (153)..(153): a, c, t, g, unknown or other
  misc_feature (153)..(153): n is a, c, g, or t
  modified_base (176)..(176): a, c, t, g, unknown or other
  misc_feature (176)..(176): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtncccacgcccaggttcagttggtncagactgggctgaggtgcagagcctgggcatcagtgactgtctcctgcaaggccagtggatatatctacacaaatatggtatagaattgggtcgacgtacgacggacccccggaagaacgggtcgttaggaggttgggggtggggtggtcgaggcggtcgtttggacgggtaagctacgagtactgacgaccgaagagtaggaacggggcagacggtcaacgtacttaccgacggtaccaacccccgaagaaccacacgtactaacatcgactaactgaacgagtcctaggtacgagtacgacgtaacgaccgaccgggtcccgtacgttaacgttaccgtgtacggtacgtaaggtaactttggttttacctggttactacggttaccgttaaacgttatttacggtaacgttaacggttactacgtttaagtacggtacgtttacggtaccgtttgggtaacccggggg

SEQ ID NO: 98703 - DNA, 721 bp, Homo sapiens
  misc_feature: GYAE6OF02I24ZU.17.10.A10.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcaggttggtgcagacgtggggctggaggtgcgagagcctgggcatcagtgactgtctcctgcaaggccagtggatatntcttanaacaaatatgtatagaagttgggtgacgacgacggccccggagaagggcttggnggtggggtgggtggtcgaggcggtcgttaggacggtaggacagtagtagtcgacgtacgaagagagaaggnagagcagtactaccgacgaccaacccacgaacncgaacgttacaacgacgttcgactaaacgtcggaacgtaacgccgtaacggtacggaacgtccggtaagggacccgtaaacgggaccggtaccccggtttaataaccgttttacgggttaccggttcggaaaccggttaacggtttaacgttttaccgggtttttaccttacggggtttacccttaaggtttaacccgttaaggttttaaacgtttacgggtaacggttttaacggttaaccgtttacggtttaacgggtttcgggttaaccggttttacgggtaccggtttaccggggttaaccggggggg

SEQ ID NO: 98704 - DNA, 775 bp, Homo sapiens
  misc_feature: GYAE6OF02HTT0G.17.10.A10.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctgggtggcgagcaggcacagggtcgcccacgcccaggttcaggttggtgcagcgtggggctggaggtgcagaagtccgtggggcctgagtgaggtcnctgcaggcttcgngtattcacgttactctatagtatacacttgggngccgaccgcggccgtatcggaaccaacgtccgttaggacggttggaacggttggggacgtacggggaccgtaaacccgtaaacggacgtttggggttcgtaccgtaacggacggttacgttccttaccgacccgtaccgtccgttaccccggggaactaaccgggttaacctttaaccgagttaccgggaaccctaacggtaaaccctccttaaccgaaacttaaaccacgacccgtaaccttacggagttacggagttacggaaacggtcggacccgttaagacctaagggttccctaaggacccgaaacggtaccggtcccgtttaacgttacgtttaccgtcgggtaccgtacggaccggttaactccccgaaagggtccgttaccgggtacgggacttacccgggtacgggtaccacgggttacccggttcgttttacggcccggttgggtcccgggaacggtaccggggttaccgccccggttaagggtccccg

SEQ ID NO: 98705 - DNA, 632 bp, Homo sapiens
  misc_feature: GYAE6OF02ITY4V.17.10.A10.1.454.CMB.1.raw
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatctcaacaaaatatggtatagaagttgggtagcgacacggacccccggacaaagggcttggaggttgggggtggggtgggtcgaggcggcgtttaggacggtaagcacgagtangcacgagatggaaggnagatacgaacgtacgtaccacgaccaaccccagaacactagtacanatgactaacgtgaacgcgcctaggacgagtaccgtacgaacccgtacgaccgggacccgtttacttaagttaccggtggttacgaccgggtaaagtaacttttcggttttaccgtagttaccgtaaagtttacccggttaaattaacgttttaggtaacgttaggtaccttagttacgttagggtaccttagggtacctttcggtaccggggg

SEQ ID NO: 98706 - DNA, 705 bp, Homo sapiens
  misc_feature: GYAE6OF02HIHVA.17.10.A10.1.454.CMB.1.raw
  modified_base (428)..(428): a, c, t, g, unknown or other
  misc_feature (428)..(428): n is a, c, g, or t
  modified_base (508)..(508): a, c, t, g, unknown or other
  misc_feature (508)..(508): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtgcccacgcccaggttcagttggtgcagacgtggggctggaggtgcgagaagccgtggggcatcgagtgactgtctcctgcaaggccagtggatatatcttcaacaaatataggtataggtaagttgggtcgacgacggacgggaccccccggaacgaagggtcgttggaggttgggggtcgggggtagggtcgaacgggtcggtcgttttacgggaacgggttaaggaccaacgtaggtatcggacaaaccggtaagacgtaagggaacgggtnaacggtacgtacgaaccgttaacgttaacccgaaccgggaacccctaacccccgaacgaaaccgacctagttcctaacgngttaccgaacaacgtagaaccgtacggaccgttaggacggtacgcgtacgggaaccgacccgtaccggacgttacttagtaccgtggtacgacggtaagttactttcggttttaccgagttcagtttaccgtaattacgtttagtacgtaggtaccttacgtaggttaggacggttaccggtatttcgggaccgggg

SEQ ID NO: 98707 - DNA, 697 bp, Homo sapiens
  misc_feature: GYAE6OF02IBATT.17.10.A10.1.454.CMB.1.raw
  modified_base (474)..(474): a, c, t, g, unknown or other
  misc_feature (474)..(474): n is a, c, g, or t
tcagcgtagactagcacgaccggtgctcgatttagcgtcgatctcaggggacccaaaaccacacccctccttgggagaatcccctagatcacagctcctcaccatggactggacctggagcatccttttcctggtggcagcaggcacgaggtcgcccacgccctaggttcagttggtgcagacgtgggctgaggtgcgagaggccgtggggcatcgagtgacgtgtcctcgtgcaaggccgaggtcggatatacgttcttacaactaaaattagtggtaatagtaagtggtcgcgacgaccggccccggagaacgggtcgtgaggtggggtggggtggtcgaggtcggtcgttttggaacggttaggcacgtagtatggaccaaccggtagtagtaggaagggtacagagtacgtaacgtacgtaacccgaacggaccctacccccgaagaacacgtacgtacgtaacacgtanaccgaacgtagacggacgtactggaagacggctaacgacggaccaccgggtaccgttacgttacgttaacgtcggtaagaccggtaagttaacgttttcggttacgttacgtacgttaacgttaccgtttaaacggtaattttacggtacgttaacggtcctttaacggtttacggttaccggttaacggttacggttaccggttaccggtttaaccgggggg

SEQ ID NO: 98708 - DNA, 579 bp, Homo sapiens
  misc_feature: GYAE6OF02GXAP1.17.10.A10.1.454.CMB.1.raw
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (322)..(322): a, c, t, g, unknown or other
  misc_feature (322)..(322): n is a, c, g, or t
  modified_base (403)..(403): a, c, t, g, unknown or other
  misc_feature (403)..(403): n is a, c, g, or t
  modified_base (428)..(428): a, c, t, g, unknown or other
  misc_feature (428)..(428): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaggccagtggatatatcttcacaaaatatggtatgaattgggtncgacaggcccccgganaagggcttggagtggggtggggtggtcgaggcggntttggacggtaaggcacagtatgcacgaagatgaagggcagagtcacgattaccgacggaccaccccacgaacacagtcanatgacaactgaccgagcctaggagngacgtgacgacgaccgggcctacgttacttacgtggtgaccgtaaggtaacttcgttttactcggttactattccggtaaacttaagttttggaacgttacgggccttacgttagtcgggtaacgtttgggtaccgttcggtaccgggggg

SEQ ID NO: 98709 - DNA, 595 bp, Homo sapiens
  misc_feature: GYAE6OF02FMEQ7.17.10.A10.1.454.CMB.1.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (508)..(508): a, c, t, g, unknown or other
  misc_feature (508)..(508): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtncgacaggcccccgganaagggcttggaggtggggtggggtgggtcaggcggcgtttggacggtaaggcacgagtatgcacgaagatggaaggcagagtcaacgattaacccgacggaccaccccgagaaccacacgtcacatgacaacgtgaacgacgcctaggacgagctagaaccgacgaaccgggtccgttactaactttacgtggtcgacgtaagtaaacgtttgttttacncggttctagttcgtaaacttaattttcggaagtttacggtccttacgttacgttacgggtacctcgggtacctttcggtaccggggg

SEQ ID NO: 98710 - DNA, 583 bp, Homo sapiens
  misc_feature: GYAE6OF02HMFNP.17.10.A10.1.454.CMB.1.raw
  modified_base (429)..(429): a, c, t, g, unknown or other
  misc_feature (429)..(429): n is a, c, g, or t
  modified_base (493)..(493): a, c, t, g, unknown or other
  misc_feature (493)..(493): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatggtatgaattgggtgcgacacgggcccccggacaaggggccttggaggttggggtggggtggggtcgagcgggtcttttgacgggtaaggcacgagtatgacaccgagagtgaagggcagagtcacgattaccgacgacaccccgagacacagtacacatgacaactgacganccgtagagagctagacgacgaccggccgttactacttacgtgtagtacgaagttatgtttttcngttacctagttcccgttaactatttacggaattaggtaccttacgttagttccgggtaacttacgggttccgtttacggtacccgggggg

SEQ ID NO: 98711 - DNA, 673 bp, Homo sapiens
  misc_feature: GYAE6OF02JFMZN.17.10.A10.1.454.CMB.1.raw
  modified_base (557)..(557): a, c, t, g, unknown or other
  misc_feature (557)..(557): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagcctggggcatcagtgactgtctctgcaaggccagtggattatatcttacgaacaaaatatggtatgaagttgggtgcgacgacggcccccggaagaacgggcttaggaggttcgggggtaggggtgggtcgaggtccggtacgttttaggacggttaaggcctaacgaggttatcgacgaaccggaagagtaggaacgggtcaaggacgtacgaacgtaacgttaacccgaccggacccaacccccgacgaaaccgtccagttacctaacagtacgacctaacgttagaaccgggacgtccgttaggaacggagaccgttgaacccgacgaacccggtccgttacgtattttaccggngttacggcggaagttaacgtttgtttacctcggttacacgtttacgtaaccgttatttaacggagttaggtccttacgttaggtacgttacgtcgggtaacctttgggacccgggg

SEQ ID NO: 98712 - DNA, 707 bp, Homo sapiens
  misc_feature: GYAE6OF02HF7W4.17.10.A10.1.454.CMB.1.raw
  modified_base (135)..(135): a, c, t, g, unknown or other
  misc_feature (135)..(135): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttccgnggtggcagcaggcacgaggtcgcccacgcccgtaggttcagttggtgcaggtacgtggggctggaggtgcaagagtccgtgggcatcagtgatgttcctcgtgacaacggtcaggtggatatatccttacaactaaaatgtaggtaataggtaagtttgggcgcgacgaccgggacccccggaagtaagggtcttggagggtgggggtggggtcggtcgacggcggtcggtttagacggggtaaggcaacgtagagtcgacgacggaaagcgtgggaagggacgagtacgacgactaaccggtaccgaaccgggacccaacccccgaacgtaaaccgacgtaacggttacctaaacgcgttacgaaccgaaacggaggaacccgtacggcttacggacgtacgtcgacgaacggacccggtaccggtccgtacgttaactttcggtacggtacgcggtaagttagttaccgtttagtgtaccgttaagtcccgttaagttaacttaggtacgttaacgttcgtacgttacggttaccgggtaggttccgttacggttacggtaacccggggg

SEQ ID NO: 98713 - DNA, 674 bp, Homo sapiens
  misc_feature: GYAE6OF02HJLOS.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcgaaggccagtaggatatatcttacaacaaatatggtaatgaagttgggtgcgacgaccggacccccggagaagggtcgttggagggttggggtgggggtgggtcgaggtcggtacgtttgggacgggtaaggcgaacgtaggttagtggacccgaacggtaagagtaggaagggacgagacgtacgacgtactaacccgaccgaaccaccccgaacgaacacgtacgtacactagtacgactaacacgaccgacgtccgtagtacggactcgtacgaccgaccggtaccggaccgttaacttaacgtacgtaggtacgacggttaagttacgttttcgtttacttcgtaccttagttacccgttaagttaacgtttagtaacgttcggtaccgttacgttacggtacggttcggtttacggtttaccgttacgggtacccgggggg

SEQ ID NO: 98714 - DNA, 768 bp, Homo sapiens
  misc_feature: GYAE6OF02IX71E.17.10.A10.1.454.CMB.1.raw
  modified_base (254)..(254): a, c, t, g, unknown or other
  misc_feature (254)..(254): n is a, c, g, or t
tcagcgtagactagcacgaccggtgctcgatttagcgtcgatctcaggggacccaaaaaccacacccctccttgggagaatccctagatcacagctcctcaccatggactggacctggagcatccttttcctggtggcagcaggcacaggtgcccaccgcccaggttcagttggtgcagactggggctggaggtgcgagaagccgtggggcatcgagtgactgtctctgcaggcagtgatatatctcacaaatntggtatggtaagttggtcgcgtaacgtcgggccccggaagaaggtcgttggaaggtggggtgggtgggtactaggtcggtacgtttggaacgggtaaggcgtagtaggtgtacgcgtaaccgggaaagttagtagggaaacggggcgtaaaggtacggttaccgaaagtaacccggttaacccggaacgggacccccgaacccccggaacggtaaaccaacccgtaacgttaccttaacgaacgttacggacctaaacgttacgggaaccgacgtaccgtacggtaagtacgaaccgtacggaaccgaacccggtacgggtaccgtttaccgttaaccgttttacggttacggtacggtacgtaacggttaaaccttttggttttaccgttcggttaccttaacggtttaccgttaaagtttaaccggttttaacggtaaggtttaacccggttccggtttaacgttacgggttaacggttcggtttaacggttcgttttaccgggaccggggg

SEQ ID NO: 98715 - DNA, 292 bp, Homo sapiens
  misc_feature: GYAE6OF02HG7D5.17.10.A10.1.454.CMB.1.raw
  modified_base (284)..(292): a, c, t, g, unknown or other
  misc_feature (284)..(292): n is a, c, g, or t
tcagcgtagactagcacgaccggtgctcgatttagcgtcgatctcaggggttcctgaccgattctctggctccaagtctggcacgtctgccaccctgggcatcaccgcgctccagactggggacgaggccgagtatttctgcgcaacatgggattccagcctgacttcgtggggtgttcggcagtggaccaagctgaccgtcctaggtcagcccaaggctcgccccctggtcactctcgtcccgcctcctctatctacgctgagcgggctggcaggcgcatagnnnnnnnnn

SEQ ID NO: 98716 - DNA, 710 bp, Homo sapiens
  misc_feature: GYAE6OF02I255G.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgacagaagccgtggggcatcagtgactgtctccgtgcaacggccaggtggatatatcttacaactaaaatagtaggtatagtaagttgggtgacgacgtaccgggacccccggaagaacgggtcttaggagggttggggggtcgggggtggggtcgagggtccgggttcgtttacgggaacgggttaagggcctaacgtaaggttagtcggacaacccgggaaaggtagtagggaacgggtacgaaggtaacgtaccgaacgtaacgttaaccccggaacccggaaccccaaccccccgtaacggaaaccaaccggaagttacctaacgagtccgaaccgtaaacgtcggaaccgacgtccgtagaacggtacgcgtacgaacgaccgaccggtccttacgttacttacgtgtaggacgtaagtcgttttcgttactcgtactagttacgtaattaaggttgaagttacgtcttacgtaggttccggtacggtcggttaccgtttagggaccgggg

SEQ ID NO: 98717 - DNA, 689 bp, Homo sapiens
  misc_feature: GYAE6OF02HBK05.17.10.A10.1.454.CMB.1.raw
  modified_base (265)..(265): a, c, t, g, unknown or other
  misc_feature (265)..(265): n is a, c, g, or t
  modified_base (403)..(403): a, c, t, g, unknown or other
  misc_feature (403)..(403): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtgggcagtcagtgactgtctcctgacaaggccaggtggatatatcttacaacaaaagtntaggtatgtaagttggtgcgacgacggaccccggagaacgggtcttaggacggtggggtaggggtgggtacaggtcggtacgtttaggaacgggttaggacacgtaggtactcgacgaaccgaagagtaggaacgggngaagagtacgacgtaactaccgaaccggacccaacccccgaagaaccacgtaacggtactaacgtacgtcgaactaacgtacgtaaccgacgtaccgaggaacggacgacgtacggaccgtaccggacggtaccgttacgttaacgttacgtggtacggacgttaaggttacgtttcgtttacgtaggttacaaggttaccgtaattaacggtttagtaacggtacggttaccttacggttacgtaccgggttacttacgggttaccgttacggggtacccggggg

SEQ ID NO: 98718 - DNA, 631 bp, Homo sapiens
  misc_feature: GYAE6OF02HVQIT.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctcctgacaggccagtggatatatcttacaataaatgtagtatgtaagtggtgcgacgaccgggccccggaagacgggcgttaggaggtgggggtggggtggtacgaggtcggtgttagggacggtagcgacgtagtagagtaccgacgaagagtaggaagggcaggacgtacgtaacgtacgtaccgaaccggacccacccccgaacgaaaccactacgtactaacacgtcgactaacgtacggaacgtacgcgtaggagacgtcgagaccgacgccggtacgttactagtacgttcggagagtaagttagtttccgtttgacgttcgttaacgttacggtaaacttgttacgtagtacgtaccgttagttacggtcggttaccgtaggttccgttcgggaccggggg

SEQ ID NO: 98719 - DNA, 882 bp, Homo sapiens
  misc_feature: GYAE6OF02IT1C0.17.10.A10.1.454.CMB.1.raw
  modified_base (133)..(133): a, c, t, g, unknown or other
  misc_feature (133)..(133): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttccnggtggcagcaggctacaggtgcccacgcccaggttcagttggtgcgagtactggggctgaggtgcaggaagccgtaggggccagtcgaggttacgtacgtggttcctccgtgaccgaaacgggtccaggttagggtacttaattacttaccttaacgaaacctaaaaagttagttaggtacttaaggtaaggttagggtacggtaccggaacggtaccggggtacccccggaacgtaaacggggtctttcgggtaagggttggggggttacggggggtacggggttcgaaggggtcgggttacttttagggggaaccgggtttaaacgggccgtaaaccggtaggttaacgtacggtacccggtaacgggaaacggtaacggtagggtaacgggacgtaaggtaacggtaccggtaaacgtaaaccgttaaacccgggaacccggtaaccccgaaccccccgtaaagtaaacccgtacgtaaaccgggttacttaaccgaaacggttcgaaacggttaaaccgtaccggaacggaacgtcccgttacggaaacgggttcgaaccggtttacgggaaacccggtacccgtacccgggtaccgtttaccgtttaacgttaccgtggtacgggtaactaggttaaacgtttcggtttattacgacgtttccgtaaggtattaaccggttagtaacgttacggttacgtagttacggtaccggtcgtacggttaccgttgggtaacccggggg

SEQ ID NO: 98720 - DNA, 589 bp, Homo sapiens
  misc_feature: GYAE6OF02HV8PJ.17.10.A10.1.454.CMB.1.raw
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccagccccaggttctagttggtgcagacgtggggctgaggtgcagaagccgtggggcatcagtgactgtctcctgcagccagtgatatatcttcacaaatatggtatgaattgggtgcgacacgggccccccggacaagggtcttgaggtggggtgggggtgggtcagcgggtctttggacggtaaggcacagtatgcaccgaagatggaagggcagagtcacgattaccacgggtaccacccccgacgaacacagtactacatacgcaaacgtcgaacgagccttggacgaggctcggacgacgaccgggccgttcctacgtttactggtgccgtagtaatgttttctagttccgtattccggtaacttaagtttagtaacgttaggacttacgttacgttaggacgttacggtaccgtttcggttccggggg

SEQ ID NO: 98721 - DNA, 588 bp, Homo sapiens
  misc_feature: GYAE6OF02HN44W.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatataggtatgaattgggtgcgacaggcccccggacaagggcttggaggtggggtggggtgggtcgaggcggcttttggacgggttaaggcacagtatgacacgaagagtaggaagggcagagtcgaacgtacttaaccgaccggtaccaacccccgaacgaaccacacgtactacatcgacaactcgaacgtacgcctagtacgagtctagaccgacgaccggtccgtacttacttacgtgtacgcgaagtacttcgttttactgtactagtacgtaactaatttgaagttacggtctacgttagtaggtaccgtaggtacttcggtaccgggg

SEQ ID NO: 98722 - DNA, 778 bp, Homo sapiens
  misc_feature: GYAE6OF02HBOOE.17.10.A10.1.454.CMB.1.raw
  modified_base (255)..(255): a, c, t, g, unknown or other
  misc_feature (255)..(255): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactgggctgaggtgcagaagccgtggggcagtcagtgactgtctctgcaaggccagtgatatatcttcaacaaatntaggtatgaattgggtgacgacgacggcccccggaagaacgggtcttaggacggtgggggttggggtcgggttcaacggtcggtcgtttagggaacggttaaggctacgagttaacgtggaccaacggaagtagtagggaaaggcgaagacgtaccgtaacggtaaccgtttaacccgaaccgggaacccctaaccccccgaaacgaaacccgtaaccgtacggttaacccttaaacgtacgttaccgaaccgttaaaccgttacgggaaacccgtaggtaaccccggttaaggaacgggtaacgtaccgttaacggaaacccgtaccgaaccgggtcccgttaacgtttaaccgttacgttcggtaccggtacggttaaacggttaaacgtttcgtttttaccgacggtttaccgtaaggtttttacccgtaaatttaacggtttacggtaacttacggttaccgtttacgttaacggttaccggttaccgtttcgggttaccgtttcgggtaacccggggg

SEQ ID NO: 98723 - DNA, 686 bp, Homo sapiens
  misc_feature: GYAE6OF02HIQPI.17.10.A10.1.454.CMB.1.raw
  modified_base (499)..(499): a, c, t, g, unknown or other
  misc_feature (499)..(499): n is a, c, g, or t
tcagcgtagactagcacgaccggtgctcgatttagcgtcgatctcaggggacccaaaaaccacacccctccttgggagaatcccctagatcacagctcctcaccatggactggacctggagcatcctttcctggtggcagcaggcacaggtgcccacgcccaggttcagttggtgcagactggggctgaggtgcagagcctggggcatcagtgactgtctcctgcaaggccagtggatatatcttcaacaaaatatggtatgaattgggtgcgtacgacggaccccccggtaacaaggggcttggacggttggggtggggtcgggtcgaggtcgggctttggacggtaaggcacgtagtaagtgaccgaccgaagtagtggaaacggggtcaggaacggttacgaacggtactttaacccgaacgggaacccacccccgaaccggaaccacgacggtacctaacgactcgacaactacgaacggacgaccgtagacggngacctcggaacgaccgtacggacccgttacgtactttaacgtggtacggtaccggtaagtaaagttcgttttacgtacgttactacgttacggttaacttaagttttcggaacgtttaacggtccgtttaccgtttaaggttaccggaacggtttaccggtttaccggttaccggttacccgggggg

SEQ ID NO: 98724 - DNA, 629 bp, Homo sapiens
  misc_feature: GYAE6OF02HSJRF.17.10.A10.1.454.CMB.1.raw
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (550)..(550): a, c, t, g, unknown or other
  misc_feature (550)..(550): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaacaaatntgtatgtaagttgggtncgacgacggacccccggagaagggtcttggaggtggggtgggggtggtcgaggcggtcgtttggacggtaaggcaacgtaggtactggaccacggaagagtagggaacgggacaggacgtacgaacggtaacttacccggaccggaccacccccgaagaactacgtacgtactacagtcgacaacgtacgacgacgcctaggagcgtacgtaacgacgaccgtaccgggtccgtacttacgttacgtgtacggacgtaacgttatttcgttttancgttatacgttacgttaacgttagtttagacgttaggtcctagttaggacggttacttacggtcgttcgggtaccgggg

SEQ ID NO: 98725 - DNA, 733 bp, Homo sapiens
  misc_feature: GYAE6OF02GE9GV.17.10.A10.1.454.CMB.1.raw
  modified_base (265)..(265): a, c, t, g, unknown or other
  misc_feature (265)..(265): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgccccaggttccagttggtgcagacgtggggctggaggtgcaggaagccgtggggcatcgagtgactgtctcctgcaaggccagtggattatatctcaacaaaatntaggtatggtaagttgggtgcgacgaccggacccccggtacggaaggggtcttaggacggtagggggttgggggttgggtacgagggtccgggttacgtttagggaaccgggtaagggccaacgaggtatacggccgaacggaacgtaggtaggaacgggtcaggtaagtcgaacgtaacgttaccgaaccgggtacccaaaccccgacgaaccgaacgtacgtaacctacgtagtacgaaccgtaacgttaccggacggtaacgtccgttaacggacggtaacgtccgttaacgggaaccgtaccggacccggttaccgtacttaacgttacgttacggacggttacggaaagttaacgttttcgttttacgagtttcgaacgttttcggtaaactagtttacggtaggttaaccggttcttacgtgttacggtacgttacggtttacggttaccgttaccgggggg

SEQ ID NO: 98726 - DNA, 668 bp, Homo sapiens
  misc_feature: GYAE6OF02GTC5U.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcgtggggcatcagtgactgtctcctgcaaggccagtggatatatctcaacaaatatgtatagtagttggtgcgacgacggcccccggagaacgggtcttaggaggtggggtggggtgggtcgaggcgtcgttggacggtagcacgagtatgcgacgaagagtaggaggcagagtacacgactaccgacgacccaaccccgacgaacacgtacgtcaacgatacgacaacgtggaaccgacgtaccgtagaaccggtacgaccgtaacggaccgaaccggacccgggtacccggttacttaacgttacgttcggtaggaccgtaacggtacccggtaccccgtaaccggtacgttacccgggtacgaccggtccccgtaaccggggaccgtacgggtccccggttaccggttttacgtacccgggttaccggggttaccgggggaccgtacgggggtacccgtcccggg

SEQ ID NO: 98727 - DNA, 645 bp, Homo sapiens
  misc_feature: GYAE6OF02I8JN6.17.10.A10.1.454.CMB.1.raw
  modified_base (308)..(308): a, c, t, g, unknown or other
  misc_feature (308)..(308): n is a, c, g, or t
  modified_base (547)..(547): a, c, t, g, unknown or other
  misc_feature (547)..(547): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagacgtggggctggaggtgcagaagccgtggggcagtcagtgactgtctcctgcgaaggccagtggatatatctacaacaaaatgtgtatagtagttggtgccgacgacgggtccccggaagaacgggtnttcggaggttggggtgggggtgggtcgaggtcggtcgtttaggaacggtaaggcagtaagtagtcgaccgaacgtaaagagtaggaacgggcgaaggtacgtcgaacgaacgttaccgaaccggtaccccaaccccgtaaggaaccaaccgtacggtaacctaccaacgtcggaaacctacggtagaccgaacgccgttagacgacgctaggaccgtaacgcggaccgttacttacgtntacggtgaacgtagtacgttcgtttcgtagtacttagtaccgtaacttaagtacgtagtcgtacttagtacgtcgtacgtgtaccgttggtaccgggg

SEQ ID NO: 98728 - DNA, 720 bp, Homo sapiens
  misc_feature: GYAE6OF02JHI8D.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcgaggcacaggtgcccacgcccaggttcagttggtgcagacgtgggctggaggtgcaggagccgtgggcatcaggtcgactgtctccgtgacaacggccaggtgtatagtactctacaactaaattagtggtaatagttaagttgggtacgcgaccgaccgggtaccccggaacggtaacgggtccgttagggagggttggggtcggggtggtacgtcgggcggtcgtttagggaaccggggttaagcgtaacgtaggttacgagaccgtaacggaagtaggtacgggaacggcaacggtacgtacgaacgtacgtaaccgaacggtaacccaaccccgaagggtaacacgtacgtacaacgcgttacgacttaaagacgtacgacgtcgtagagacgtacgacgtaccggacgaccgtccgttattaaccgtacgttacgtacggtacgtaaagttaccgttttcggttttacgcgtttagtaccgttaacgtttagttaacggtttacgtaaagttccgtaacgttacggttaacgtcggttaacccggtcggttttaccgtaccgggttccggggg

SEQ ID NO: 98729 - DNA, 684 bp, Homo sapiens
  misc_feature: GYAE6OF02H5CSK.17.10.A10.1.454.CMB.1.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (365)..(365): a, c, t, g, unknown or other
  misc_feature (365)..(365): n is a, c, g, or t
  modified_base (559)..(559): a, c, t, g, unknown or other
  misc_feature (559)..(559): n is a, c, g, or t
tcagcgtagactagcacgaccggtgctcgatttagcgtcgatctcaggggacccaaaaaccacacccctccttgggagaatcccctagatcacagctcctcacatggactggacctggagcattcctttttcctggtggcagcaggcacaggtcgcccacgcccaggtttcagttggtgcagacgtggggctgaggtgcagaagcctggggnatcagtgactgtctctagcaagccagnggtatatactcttacaactaaaatntaggtatagtaagttgggtagacggacgacgggacccccggagaagggcttaggagggtgggggtaggggtggtcgaggcggtctttagggacggtaaggntacgaggtatcgacgtaccgaaagtacgtaggaaagggtcaaggacgttacgacgtaagttaacccgaaccggaaccgaaccccccgtaagaaccgacctacggttaccaaactgtacgacgaacgtacgacggactaccgtagacgacgttacgaggtaacgacgacgacccgttataacgttacgaggtacncgaacgaacgtacccaagtaccgtacggtacgtaccgacggttaaccggcgtaaccgggtcgttacccggtttacgtaccggttttacggaccggggtaccggtacgggaccggttaaccccggg

SEQ ID NO: 98730 - DNA, 603 bp, Homo sapiens
  misc_feature: GYAE6OF02GRKO6.17.10.A10.1.454.CMB.1.raw
  modified_base (291)..(291): a, c, t, g, unknown or other
  misc_feature (291)..(291): n is a, c, g, or t
tcagcgtagactagcacgaccggtgctcgatttagcgtcgatctcaggggacccgaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaattatggtatagaattgggtgcgacaggcccccgganaagggcttggagtgggtggggtgggtcagcggctttggacggtaggcgacagtatgcacgaagatggaagggcagagtacacgattaccgacggaccaccccgaacgaaccacgacgtctaacatcgaccaaactggaaccgacgccgtagacgagcgtagaccgaccgacggccgtactacgtttaacgtcgtaggacgtaaggtaaacttggttttacgagttacgtattacggttaacttaagttttaggaattacggtaccttacgttaagttcggtaacgttcgggttaccgtttcggtaccggggg

SEQ ID NO: 98731 - DNA, 714 bp, Homo sapiens
  misc_feature: GYAE6OF02GXPYI.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacaactaaaatgtaggtataggtaattgggtgccgaacgaccgggcccccggaagaacgggtcttggaggtggggtggggtggtcgaggcgtcgtttggacgggtagcgagtagtatcgacacgaagagtaggaagggacaggacgtacgaacgtacgttaaccgaccggtaacccaacccccgaacgaaacctaaccgacggttacctaaccgagtacgaaccgtaaacgtcggaaccggacgaccgttaggagaaccggcgtaacggaacccgaacggacccgggtacccgtttacgttaaccgtttacgtcgggttacggtaccgtaaaggttacttttccgggttttcttacggttcttaacgttacccggtttaacttaagtttcggtaacgttacgggttaccttacgttaggttaaccggtaccggtttacggttacccggtttgggtacccggggggg

SEQ ID NO: 98732 - DNA, 781 bp, Homo sapiens
  misc_feature: GYAE6OF02FPTE7.17.10.A10.1.454.CMB.1.raw
tcagcgtagactagcacgaccggtgctcgatttagcgtcgatctcaggggacccgaaaaaccacacccctccttgggagaatcccctagatcacagctcctcaccatggactggacctggagcatcctttctggtggcagcgaggctacgaggtgcccgacgtcccgtaggttcagttggtgtcgagactggggctggaggtgcagaagccgtgggcagtcgaggtgacgtgtctccgtgcgtaaggccagtgatagtatcgttacaactaaagtcgtggttatgtaagtttggacgacgaccgacgggccccgtagacgggtcgtaggtacgggtgggggttacggggtggtacgacgggttcggtactttacgggaacggttaagccgtacgtaggtagtcggaaccgaacggtaagtagtacggacgggtagtaacgtacggtacgtaaggtacttacccggaacgtaccccgtaacccccgaaggtacctaaccgtacggtaccctaaacgtcgtaaccggaacctaaacgggtcgtaaccggtacgtacccgttaaggagttacccggaaccgttacgaaccggttaaaccgggcccggttaacgttaacccgttaaggtacccggttaggtaaccgtaccgggttaaacgtttaccgttttgggttttaaccaggggtttaccctaacgggttactttaaccggttaagtttccggaaacgtttacgtaccgttacgttaacggtccggttacgttcgtacggtttccggacggg

SEQ ID NO: 98733 - DNA, 765 bp, Homo sapiens
  misc_feature: GYAE6OF02HE5D5.17.10.A10.1.454.CMB.1.raw
tcagcgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagacgtgggctgaggtgcagaagccgtgggcatcagtgactcgtcctccgtgaccaaggccgaggtaggataatactcttacaactaaaatatggttatggtaaagttgggtcgcgtaacgaccgggaccccccgggaagaacggggtcgttggaggttgggggtacgggggtgggtccgaagggccgggtcgtttacggaacggggtaggcgacgagtagtacggaccaaccggtaagacgtaggaacgggcgaaggaacggtacaaccggtaacttaacccggaacccggtaacccaaccccccgaacggaaacctaaccgtaacggttaacctaaaccaagttccggaactaaaaccgtcggaaaccgtacggacctttaggaaacggtacggtacctacgggaaaccggaccggtaacccgggtacccggttaactaacgttttacccgtaggttaccgacgggttaacgttaaacgtttccgttttagtaaccgttctaacgtttaccttaagttaaacgttttcggaagtttacgccttagttaacgtagggttaacttcgggttacgttccgggtaacgggg

SEQ ID NO: 98734 - DNA, 704 bp, Homo sapiens
  misc_feature: GYAE6OF02HZ83D.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcgagtgactgtctcctgcaaggccagtggatatatcttacaacaaaatgtaggtatgtaagttgggtgcgacgacgggacccccgagaacgggcgttaggacggttgggggtggggtacgggtcgaggccgggtacgttttgggaacgggtaacggcgtaacgtaggtacgtcggactaaccggaaggacgtaggaacgggagaggtacgtcgaacgtactaaccgacgaccaccccgaagtaacacgagtctaacacgtacgaccaacgtcgtacgacgtaccgttaggagacggccgtaggaaccgacggacccggtaccgttacgttaaccgttaaccgttggtacggtacgtaagttaaacgtttcgtttttacgtcgtaccgttaacgtttccggtaaacttacggttttagaacggtttaccgggtacgtttaccgttacggtcggtttaaccgggttggttaccctttcggggttaacccgggggg

SEQ ID NO: 98735 - DNA, 660 bp, Homo sapiens
  misc_feature: GYAE6OF02I69ZZ.17.10.A10.1.454.CMB.1.raw
  modified_base (628)..(628): a, c, t, g, unknown or other
  misc_feature (628)..(628): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcaggttggtgcagacgtggggctggaggtgcagaagccgtggggcatcagtgactgtctcctgcaaggccaggtgatatatcttacaacaaatatggtatgtaattgggtgacgacgaccgggtcccccggaagtaacgggcgtttacggagggttgggggttaggggtgggtcgaggccggtcgtttggaacggtaagggcaacgtagtacgtagcgtaaccggaagaacgtggaagggacaaggtagtacgaacgtaacttaacccggaaccggtaacccaaccccgaacggaaaccacgaacgtacgtaaacgactacgaccaaacgtaggaaccgacgacgttacgaaggacgtcgacgacggacgaccggtccgtacttaacgttacgtcggtagccgtaagtaactttggtttctacgtacattaccgtacttaagttcgtaagttgtaccgttntacgtggacgttggtacgtcggtaaccggggg

SEQ ID NO: 98736 - DNA, 681 bp, Homo sapiens
  misc_feature: GYAE6OF02GCHGD.17.10.A10.1.454.CMB.1.raw
  modified_base (406)..(406): a, c, t, g, unknown or other
  misc_feature (406)..(406): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagtttggtgcagacgtggggctggaggtgcagaagccgtggggcatcagtgactgtcctcctgacgaacggccagtggatatatcttacaactaaaatagtggtatagtagttgggtagcggacgacgggaccccccggaaggacgggtccgttggacggggttgggggttgggggttcgggtcgaggtcggtcgtttaggtaacggtaagcgacgtagtgtacgacgaacggaagngtagggaaggcgaggactacgacgtaacgttccgaaccggacccaaccccgtaacgaaccgtacgtaacggtactacgtagacgaccaaaccgtgaaccggcaccggtagaacgtaggtaccaaggaccgacggtccggaccttacgttactacgttcggacgacgtaagtatttcgtttctacgttactacgttacgtaacgtttaacgtttagacgtttacggtactacgtttacggtaggttactacgggttaccggttggtacccgggggg

SEQ ID NO: 98737 - DNA, 671 bp, Homo sapiens
  misc_feature: GYAE6OF02IQPRF.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcctggggcatcagtgactgtctcctgcaaggccaggtaggatatatcttacaacaaaatatggtatgtaagttgggtgcgacgacggcccccggagagggtcttaggaggttggggtagggggttgggtcgaggtcgggtcttttaggaacgggttaaggccgtaacgaggttatgacgtaaccggaaggagtaggaagggcaggacgtacacgattacccgaacggtacccaacccccgacgaaccaaccgaacgtacctaacagtacgtacgaaacgtacggaaccggtacgaccgttagaacggtacaccgttacgggaaccgaccgtacccgggtaccgttaccttaagtttaccgttagggtacggacgtacggtaaatttcggttttactagtccgtattacggtaattaacgttggtactacggtcttacgtagttacggactacggttcgtcggtaccgggg

SEQ ID NO: 98738 - DNA, 704 bp, Homo sapiens
  misc_feature: GYAE6OF02JE1Q9.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacctgggggctggaggtgcgaggaagccgtggggcatcgagtgactgtctctgcaaggccagtgatagtatcgttacaacaaatatggtatgtaacttggggtgacgacgaccgggtaccccgggaacgaacggggtcttagggacggttgggggttagggggttcgggtcgtaagggtccgggtcgttttagggaacgggttaaggaccgaaccggtagttagttcgggctaacccggaaaggtagtaacgggaaaggggccgaaggtacggtaccgtaacggggttaaccttaccccgggaacgggtaacccacccccgaacggaaccacgtaacgtaccttaacgagtacgacaacgtcgtacgacgttcagagacgctcggaccacggacgtaccgtacgtttacgtacgtagtcggacgttagtacgtttgtttacgacggttactaacgtaccgttaaattacgttagtacgttagttccttacgtagtcggtacgtttacgacggttcggtaacgggg

SEQ ID NO: 98739 - DNA, 700 bp, Homo sapiens
  misc_feature: GYAE6OF02HQP0E.17.10.A10.1.454.CMB.1.raw
  modified_base (388)..(388): a, c, t, g, unknown or other
  misc_feature (388)..(388): n is a, c, g, or t
tcagcgtagactagcacgaccggtgctcgatttagcgtcgatctcagggggacccaaaaaaccacacccctccttgggagaatcccctagatcacagctcctcaccattggactggacctggagcatccttttcctggtggcagcaggcacaggtgcccacgccctaggttcagttggtgacagacgtggggctgaggtgcagagccgtggggcagtcgagtgactgtctcgtgcagccagtcgatatatcttacaactaaaatgtggtatagtaagttgggtgacgacgacggaccccggagaacgggtcgttggaggttgggggtagggggtgggttcgagggtccgggtcgttttagggaacgggttaacggcaacgtaggttancggacgtaaccggaagtagtagggaacgggacaaggacgtacgaacgtactaccggaacggacccaaccccgaacgtaaccaacgtacgtactaacacgtacgaaccgaaacgtcggaaccgacgtccggttaagaacgtcgtacgtacggaaccggaccgaccgggtccgttaacttagttaccgtggtacggtaacggtaaggtttaactttcgtttttaccgtagttacgtactttacggtaacttaaggtttcgaagtttacgctttacgtaggtcggtacgtttacggtaccgttcgggtaacgggg

SEQ ID NO: 98740 - DNA, 638 bp, Homo sapiens
  misc_feature: GYAE6OF02JA55V.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccaggttcagttggtgcagactggggctgaggtgcagaagccgtggggcatcagtgactgtctcctgcaaggccagtggatagtatcttcaacaaatatggtatgtaagttgggtagcgacgacgggaccccccggaagaaacgggtcttgggaggttgggggtgggggttggggtcgagggcgggtcgtttggacgggttaacggcacgtagtagtgacgaccggaagagtaggaagggacaggagtacgacgtacttacccgaccggaacccgaaccccgaaccgaaccaaccgagttaccgaactacacgtacaacgtacggaccgacgaccgtaggagacgtcctagaccggaccgaccgggccgttacttactacgtgtgacggataagtttcgtttactgttctacgttgttaacgttattggtaagtacgtcgttacgtagttggtaacgtggtttacgtggtaccgggg

SEQ ID NO: 98741 - DNA, 675 bp, Homo sapiens
  misc_feature: GYAE6OF02HV5XW.17.10.A10.1.454.CMB.1.raw
  modified_base (258)..(258): a, c, t, g, unknown or other
  misc_feature (258)..(258): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaggccagtgatatatcttacaacaaaatntagtatgtaagttgggtgcgacgacggcccccggaacgaagggtcttggaggttggggtggggtcgggtcgaggcggtctttggacggtaaggcacgtagtatcgacgaaccgtaaagagtacggaagggacaaggacggtacaacgtaacgttaacccgacccggtaacccaacccccgaacgaaaccacgaacgttcctaaacatcgaactaacgtgaaaccgagccctaggaacgacgtcgtacggaaccgaccggacgggtccttacttacgttacgttggtacgaccgttaagtaactttgtttttaccgtgttacctaagtttaccgtaacgtttaacgtttagacgtttaacggtcctttacgtaaggtttaccggacgtttacgggttaccgtttcggtacccgggggg

SEQ ID NO: 98742 - DNA, 608 bp, Homo sapiens
  misc_feature: GYAE6OF02FTZC4.17.10.A10.1.454.CMB.1.raw
  modified_base (492)..(492): a, c, t, g, unknown or other
  misc_feature (492)..(492): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctcctgcaaggccagtggatatatcttacacaaaatatggtatgaattgggtgtcgacgaggccccccgggacaaggggccttggacggttgggggtggggtcgggtcgaggcgggtctttggacggttaagggcacgtagtatcgcaccgaagatggaagggcagagtcacgattaccgacggtaccaccccacgaaccacgacgtctactatacgcaacgtacgacgagccgtaggagacgcgtcggaacgaccgaacgggacccgttnttacgtttacgtggtgtacgaagtagtttcgttttcgtgtacacgttacggttaactaagtttgaagttacggtcttacgttagtacggtacgtggttaccgttaggtaccggggg

SEQ ID NO: 98743 - DNA, 679 bp, Homo sapiens
  misc_feature: GYAE6OF02FV9OS.17.10.A10.1.454.CMB.1.raw
  modified_base (489)..(489): a, c, t, g, unknown or other
  misc_feature (489)..(489): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagacgtggggctggagtgcagagccgtggggcatcgagtgacttgtctcctgcaagcagtgatatacgtcttacaactaaaatagtaggttatagtaaacgtttggggtcgacgtaccgaccgggcccccggacgaagggtccgttaggacgggttgggggtggggtggtcggaggtcgggtctttagggacggtaaggctacgagtagtcggactaacggaagagtagggagggacgtaagacggtaccaacgaacgttaccgaccgggtaaccccaaccccgaagaaccgactacgtacctagaacgtntaccgaagttacggacgacgtatacgagacgtacgacggaccaccggaccggtccgttattacgtttacgtagtaccggtacgtaagttacgtttgtttactacggttactacgtacgtttacgtaacgtttgtaagtccgtttactcggttgtaaccggtagtttacggttaccgttaggtacccgggg

SEQ ID NO: 98744 - DNA, 673 bp, Homo sapiens
  misc_feature: GYAE6OF02IUMUC.17.10.A10.1.454.CMB.1.raw
  modified_base (402)..(402): a, c, t, g, unknown or other
  misc_feature (402)..(402): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcgagaagccgtggggcagtcagtgactgtctcctgcaaggccagtggatatatcttacaacaaaatataggtaataggtaagtttggggtgacgacgacgggcccccggaagaagggtcttggaggtgggggtggggtgggtcgaggcgggtctttacgggacggtaaggccagtagtatcgacgaaccgagacggtaggaacgggnaggagtacgacgtaacttaaccgaccgacccaaccccgacgaaaccacgtacgtacctacgatcaacgaacgtacgacgacgcctaggacgacgccgtagaaccggaccgaccgggtccttagttaaccgttactaggtcgaacgtaacggttaagtttccgttttacgtgttacctaacgtttaccgttaaacttacggtttagaacgttaacggttctttacggttagtaccgggttacgttacggttaccggttcgggtacccggggg

SEQ ID NO: 98745 - DNA, 699 bp, Homo sapiens
  misc_feature: GYAE6OF02HP1UK.17.10.A10.1.454.CMB.1.raw
  modified_base (519)..(519): a, c, t, g, unknown or other
  misc_feature (519)..(519): n is a, c, g, or t
  modified_base (571)..(571): a, c, t, g, unknown or other
  misc_feature (571)..(571): n is a, c, g, or t
  modified_base (603)..(603): a, c, t, g, unknown or other
  misc_feature (603)..(603): n is a, c, g, or t
  modified_base (627)..(627): a, c, t, g, unknown or other
  misc_feature (627)..(627): n is a, c, g, or t
  modified_base (634)..(634): a, c, t, g, unknown or other
  misc_feature (634)..(634): n is a, c, g, or t
  modified_base (665)..(665): a, c, t, g, unknown or other
  misc_feature (665)..(665): n is a, c, g, or t
tcagcgtagactagcacgaccggtgctcgatttagcgtcgatctcgaggggacccaaaaaccacacccctccgttgggagaactcccctagatcacagctcctcaccatggactggaccgtggagcattccttttccgtggtggcagcaggcacgaggtcgcccacgcccgaggttcaggttggtcgcagacgtgggctaggaggtgacgagaacggtccggtaggggcagtcgaggtgacgtgttcctccgtgacaggaccgtaggtaggtattagtacttctacaaacaaaagttgtgtaatagtaagtcgggtgacgacgaccgggtaccccggaacgtaagggcttaggacggttaggggtggggtcggtgacggcggttcgttacggaacgggtacggactacgtacgtagtacggaccaacggaaaggacgtagggaacgggtacgaggaacgttacgacgtaactacccggaaccgaacccaacccggtaacgaacgacgtaacgtcgaacncggtagaccaacggtaacgtcggaacacgttacggagtaccgacgtacgganaaccgacggttacctacttacgttcttacggngacggtaacttagttcgtttacgntaacgtnttaacgtaacgtagtttaccgagttaacgtnttacgttgaaccgtttgcgttcggtagtccgggg

SEQ ID NO: 98746 - DNA, 714 bp, Homo sapiens
  misc_feature: GYAE6OF02FG4F7.17.10.A10.1.454.CMB.1.raw
  modified_base (247)..(247): a, c, t, g, unknown or other
  misc_feature (247)..(247): n is a, c, g, or t
  modified_base (280)..(280): a, c, t, g, unknown or other
  misc_feature (280)..(280): n is a, c, g, or t
tcagcgtagactagcacgaccggtgctcgatttagcgtcgatctcagggggacccaaaaaccacacccctccttgggagaatcccctagatcacagctcctcaccatggactggacctggagcatcctttcctggtggcagcaggcacaggtgcccacgcccaggttcagttggtgcagacgtggggctggaggtgcagagccgtggggcagtcagtgactgtctcctgcgacggccagtggatatntctacactaaatagtaggtatagagtttagggngtacgacgtacgggcccccggaacgaacgggtcgttggtaggtggggtggggtgggtacgaggcgggtcgtttaggacggttagggcacgtagtacgtcggacgaaccggagtagtacggtaacgggcgaaggtacggtaccgaacggtacgttacccgaccggtaccccaacccccgacgtaaccacgtacgtaccgtaacgactacgaccgaacgttcgaaccggacgtccgttacgaggacgtcgtacggaaccgaccgaccgggttacccgtagttaacgttaccgtaggtacgtacgggtaagtaaacggttttcgtttaccgtacggttactaacgttaccggtttaacctaaggtttacgaccgtttacggcctttacgttacggttaccggtacggtttacggtaccgtttccgggtacccggggg

SEQ ID NO: 98747 - DNA, 659 bp, Homo sapiens
  misc_feature: GYAE6OF02G500R.17.10.A10.1.454.CMB.1.raw
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagccgtggggcatcagtgactgtctcctgcaacggccagtggatatatcttcaacaaaatatggtatagtaattgggtgcgacgacgggcccccggaagaacgggtcttaggagggtggggtgggggttcgggtcgacggtcgggtcgtttggacgggttaaggcaacgagttatcgacgtaccggaagtagtaggaagggcaaggagtacaacgtacttacccacggacccaaccccgacgaaaccacgacgtacctaacgagttacgacctaacgtcggaacgtaccgccgtagacgtacgcgtacgacgacgtccggcttacgtacttacgcgtacgacgtataagtttcgtttcgtagtccgttaagttacggtaaccttaagttttaccggtaagttacggttccttaggttacggttaggtaccggtacggttaccgttcgggtacccggggg

SEQ ID NO: 98748 - DNA, 633 bp, Homo sapiens
  misc_feature: GYAE6OF02HJYE9.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtgggctgatgtgcagaagccgtggggcagtcagtgactgtcctctgcgaaggccagtggatatatcttcaacaaaatgtagtatagtaattgggtgacgacgacggccccgagaacgggcttggaggtgggtgggtggtcgagcggtgttggacggtagcagagtatcgacgaacgagagtaggaaggcaggagtacgacgtacgttaaccgaccgaaccgacccccaacgaacgacgtaagttaccgaacgactacgaaccacgtacgacggaacgtccgaggtagacgcacggtaccgacgaccgggtaccttacgtacgtttccgtagtaccgtacgtaagttacgttcggttttctacggttaccttacgttaaccggttaacttaaggtttgtaacgttagtacccgttataggttaccggtacggttacggtacgttacccgggg

SEQ ID NO: 98749 - DNA, 725 bp, Homo sapiens
  misc_feature: GYAE6OF02INRMI.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggagtgcgagaagccgtggggcagtcgagtgactgtctcctgcaaggccagtagggactatatcttacaacaaaagttacgtaggtatggtaagttgggtagacggacacgggacccccggaagtaagggtcttaggaggttggggtaggggtcggtacaggccggtcgtttaggaacggtaaggcgtaacgtagtatcggacgaccggaagacgtaggaagggcacggagtacgaacgacgttaaccgacgggaacctaccccgaacgaacgacaacgttacctaacgacgtagaccaacgttacgaacggacgccgtaggacgtagaccgtacgaaccgacggtaccggacgttacggttaattaaccggttcgtacggtaacggtacggttaaagtttccggttttaacgttaccggttaccgtaaggtttacccggtaacgtttaaggtttttcgtaaacggttacgggttacctttacggttagtaaccgggttaccgtagggtttaacccggttgggttaaccccgggggg

SEQ ID NO: 98750 - DNA, 742 bp, Homo sapiens
  misc_feature: GYAE6OF02HBNK4.17.10.A10.1.454.CMB.1.raw
  modified_base (161)..(161): a, c, t, g, unknown or other
  misc_feature (161)..(161): n is a, c, g, or t
  modified_base (238)..(238): a, c, t, g, unknown or other
  misc_feature (238)..(238): n is a, c, g, or t
  modified_base (272)..(272): a, c, t, g, unknown or other
  misc_feature (272)..(272): n is a, c, g, or t
  modified_base (555)..(555): a, c, t, g, unknown or other
  misc_feature (555)..(555): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
tcagcgtagactagcacgaccggtgctcgatttagcgtcgatctcaggggaccaaaaaccaccacccctccttgggagaatcccctagatcacagctcctcaccatggactggacctggagctacttcccgttttcctgggtcggcgagcgacggcaccgnggtcgacccacgccctaggttcacggttggtgacaggacgtggggcctaggacggtgacgaggaacgcggtcggggntacgtagacggtggacttcggtctccgtacgganacgggacaggtggtatatacttcttaacacctaaaagtatacggtataggacgttacggggtgacggtacccgacgggacccccggtaaggtaaccggtcgtagttacgggtggggtagggtacggtgtaccgtcgggtcgttttagggaccgggttaaggacgtaacgtaggttcaggacccgacgaaggtagttaacggacgggttacagggtaggtacaacggtactttaccgggaaacgaccctacccggaaacgaaccacggacgtacgactacgtanaccgttagacggtacacggtccagggtanacgngtacgacgtacggaccggccgttacgtacgtaacgttcggaaggacgttacggaaacgtttcgtttagtcggtacgttaatcggtaacttaaggttacgtacgttaaccgtacttgtaacgtggtaaaccgtgttaccggttacggtaacgggg

SEQ ID NO: 98751 - DNA, 689 bp, Homo sapiens
  misc_feature: GYAE6OF02GY136.17.10.A10.1.454.CMB.1.raw
  modified_base (257)..(257): a, c, t, g, unknown or other
  misc_feature (257)..(257): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtcgcccacgcccaggttcagttggtgcagacgtggggctggaggtgcagaagccgtggggcatcgagtgactgtctcctgcgaagccagtggatatatctacaanaaatatgtatagaagttgggtgacgacgaccgggacccccggagaacgggtcgttaggtaggttgggggtgggggtcgggtacgacgggtcggttcgtttaggaacgggtaaggccgaagtacgttagcgaccgaacggaagtagtaggaacgggcaaggacgtacgaacgtaacgtaacccgaccggaaccccaacccccgaacgaaccgaacgtaacggttacctaaccgacgttacgaaccgtaacgtacgacgacgtaccgtaggacgtacggacgtaacggaccgaacggcccggtaccgttacttagttacgtcggtagtacgtaacgttatttacgtttcgtacgttctacgttacgttaacttaagttgtaacgtggttaccttacggttagtacgtaaggttcgttacggttacggtacgggg

SEQ ID NO: 98752 - DNA, 779 bp, Homo sapiens
  misc_feature: GYAE6OF02FRQN6.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcgagtgactgtctcctgcaaggccagtggatatatcttacaacaaaatataggtaatagaagttggggtagcggacgacgggcccccggaacgtaagggcgttggagggtggggttgggggtcggtacgagggtcggttcgttaggaacgggtaaggctacggtagtagtgacgaacggaagagtaggaagggacgaaggtagtacgaacgtacgttaacccggaaccggaaccccaacccccgtaacgaaacccgaacgtaaccgtaccgtaaccaggttacgaaccgtaaaccgttacggaaccggtaaccgtaccgttaaggaacggtaacgttccgtaaccggaacccggtaaccgggtaccccgggtacccgtttaaccggtttaacgtttaaccgttacggttaccggtaaccggtaaaggtttaaacgtttttgttttacccgttagtttacccgtaacggttaccgttaaaccgtttaagtttaccgggtaagttaacggttacgttacgttaaggttacggtacggtttacgggttaccgttggggtaacccggggg

SEQ ID NO: 98753 - DNA, 752 bp, Homo sapiens
  misc_feature: GYAE6OF02FKLPM.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcagtcagtgactgtctccgtgcaacggccaggtggatatatcgttacaactaaaatagtaggtatagaatttggggtgacgacgaccggcccccggacgaaggggtcgttggacggtgggggttcgggggtgggtacgaggccggtacgtttcggacggggtaacggccacgtaaggtatggaccgtaacgaagagtaggtaacgggcgaaggtacggtaccaacggttaacgttaacccggaacccggaccctaaccccccgaacgaaaccctacgaacgttcctaactagtacggaccaaacgtcggaacggtaccgccgtaggacggtacgtacgtacgaccggaaccggaacccgggttacccgtacgttaacgtttaacgttcgggttacgaccggtaacgttaaacgtttcggttttaaccgtaggttactaaccgttacggttaaactttaaggtttacggaacggttacggtaccgttaccgttacggtaacggttacggtttacgggttaccggtttacccgggttaccgggggg

SEQ ID NO: 98754 - DNA, 899 bp, Homo sapiens
  misc_feature: GYAE6OF02HYEXF.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgcccacgcccgaggttcaggttggtgcaggacgtggggtctggaggtgcgaggaacgccgtgggcagtcgagtgactgtcctaccgtgacgaacgggccgaggttacggaatagttacttactttaccaaacctaaaaaagttacgttaggttaagtacggtaagttggggtagaccggaaccggacccgggtaaccccccgggaacggtaaacggggtccggtttaggtaggggtttagggggggttaggggggttcggggttacgaaccggggttccggggttacggtttttacgggaaccggggttaagggtaccgtaaccggtaagggttaacgttacggacccggtaaacccggaaaggttcggtaaacggggtaacggggacgaaggtaaacggtaccgtaaaccggtaacctttaaaccccggaacccggtaaccccaaccccccggaacgaaaccgtacgtaacgtacgtaccaacgacgtaaaccgtaaccgtaagaccggtacgtaccgtaacggtaacgcgtaccgtaccggtaaccggtaacccggtaccgggtacccgttacgttaaccgtttacgtcgggtacgaacggttaagttaacgtttaccggtttttagcggttactacggtttaccggttaatttaaccggttacggtaaggtttacgggttacttaaccggttgttaacggttaccgggttacggttaccgggtttaccggttaacccgggggg

SEQ ID NO: 98755 - DNA, 736 bp, Homo sapiens
  misc_feature: GYAE6OF02HYU3P.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtcgcccacgcccaggttcggttgggtgcagactgggggctggacgggtgacgaggaacgccgtggggcatcagtgactgtctctgcaaggcttctggacttctacgtttacctaccttatacgttatcaaacgtgggtgccggccaggccgtctacggacaaccggtactcgagtagggagtgggacgcgggaccgaaaccgtaacgacgtggtcgcgtactaaggttcgtacttaccgacccctacttcccgaccggggtacctaacggtaccttaaccgagtaccgaaacccgtaacgtaaccctcccgtaacctaaacttaaaaccaaccgtaacgaccttaaccgaaggttagggtaacggtacggaaggggtacgaccgttacgaactacgtacgtacggaacgtaccgaaccggggtccttaaccgttaacgttaacgtcggtcggaacggtaacgccggtaacccgacgtaccggtccggtacggaccgtaccgtacggggacctacgggtccggtttaccgtttcggtaccgtttacgggtcgggacccggtagggtcccggtacccggtaccggg

SEQ ID NO: 98756 - DNA, 758 bp, Homo sapiens
  misc_feature: GYAE6OF02FYVZC.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagaagccgtggggcatcagtgactgtctctgcaaggccagtggatatatcttacacaaaatgtaggtatgaagttgggtgacgacgacggcccccggagaagggtcgttggaggtcggggtggggtgggtcgacggcggtcgtttaggacgggttaaggcctaacgtagtagtcggacgaaccgaagagtaggaagggacaggtaacgtcgaacgtacgttaacccgaccggacccaacccccgaacgaaaccgacgtaacgtacctaacagtacgaaccgtaacctacgggaaccggtacgtccgttaggaacggtacggaccgtaacggaacccggtaccggtaacccgggtacccgttacgtttaaccgtttaacgttcgggttacggaaccggttaaaggttaacgtttttcggtttttaccgttacggttacgttaaccgtttaccggtttaaacgttaaacggtttttaacgaacggtttacggttacctttaccggttaacggttaccggttaacggtttaccgggtttaccgtttccggggttaacccgggggg

SEQ ID NO: 98757 - DNA, 993 bp, Homo sapiens
  misc_feature: GYAE6OF02HAUWF.17.10.A10.1.454.CMB.1.raw
  modified_base (308)..(308): a, c, t, g, unknown or other
  misc_feature (308)..(308): n is a, c, g, or t
tcagcgtagactagcacgaccggtgctcgatttagcgtcgatctcagggggacccaaaaaccacacccctccttgggagaatcccctagatcacagctcctcaccatggactggaccgtggagcatccttttcctggtggcagcaggcacagggtgcccaccgcccgaggttctacggttgggtgtccacgtaccgtggggcttggaggtgcgaggaacgcccggtggggcatccgtaggtgaccgtcgtcctccgtgaccgaacggaccgtaggtggaattacttacgtcttaccgaaataaaagtntaggtatagtaaggttcgggtacggaccgaccggtacccggggacccccggtaagaaggggttccgttagggtacggggttcggggggttacggggggtacggggttacctaggggtccccggttacggttttacgggaaaccggggttaaccggcctaaacggtacggtttagcggtaccgaaacccgggtaagaaggtacgggaaacgggtcggaaaacggtcggtaacccgtaacggttaccggttaaaccccggaaccccgggtaacccccctaaacccccgggtaaccgtaaacccgtaaaccccgtacggtaaacccctacgaaccggttaaccgtaaccggtaaccgggttaccggaacccgggttcccgtacgggtttaaccggggtaacggtaaccggtccgggtaaacccgggtaaccgggtaccccggtaacccgggtttcccggttaaccgtttaaggtttttaccccggtaaggggggttaaccgttaacccgggggttaaacgtttaaacggtttttccgggttttaccgtacgggttttaacccgttaaaggtttaccccggttttaaaaccgttaggtttaccggggaaacgtttccggtttaaccgttccggttaacggttacgggtacccggtttcggttacccggggttcccggtaacccgggggg

SEQ ID NO: 98758 - DNA, 843 bp, Homo sapiens
  misc_feature: GYAE6OF02ILHOX.17.10.A10.1.454.CMB.1.raw
  modified_base (410)..(410): a, c, t, g, unknown or other
  misc_feature (410)..(410): n is a, c, g, or t
tcagcgtagactagcacgaccggtgctcgatttagcgtcgatctcaggggacccaaaaaccacacccctccttgggagaatcccctagatcacagctcctcaccatggactggacctggagcattcctttttcctggtggcagcaggcacaggtcgcccacgcccaggttcagttggtgcagacgtggggctggaggtgcaggacgtccgtgggcatcgagtcgatcgtctccgtgacaggtcttcgtggtcttactacgtttacctctagttagtactacgtaacgtgggtcgccgccgtacggcccgtacgtacgggaaccctaaccggtacccgtaggtacgggttacggggaacggttacgggggtaacgtccgggggtaaccccgtaaaaccccgttaaacccgnggtttacggggttaccgtaacccgtaacggttcggttacggtttacccttaacccgtaaccccgttacggttccccgggtaccggggtaactaaccgtaccgtttaaaccccgtagtacccgaaacccgttaacccgtaaccctttcccaaaccgtaaactaaacccgtaaccgacggttaccctaacgttacggtacgggtaacggtttagggaacgggtactccgtacgtaaccgttatacgtacggtaccgaccgtaccggttccgttacttacgtttaacgttcgacggtaccgtaccggtactaacccgtacggtccggttaccgtacgggtaccgtacccggtacggaccggtaccggtaccggtttaccggtttacgtaccggtttcgggtaccggggtaccgggtaccgggtacccgttcccggg

SEQ ID NO: 98759 - DNA, 814 bp, Homo sapiens
  misc_feature: GYAE6OF02FYA5E.17.10.A10.1.454.CMB.1.raw
tcagcgtagactagcacgaccggtgctcgatttagcgtcgatctcagggggacccaaaaacccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatctacacaaatatgtatagatttgggtgcgacgacggcccccggagaacgggcttggagtggggtggggtgggtcgacggtcggtacgtttggaacgggttaaggccaacgtagttactgccgacgaagacgtaggacgggacgaggacggtaccgaacgtaacgttacccgaacggtaacccgaaccccccgtaacggaaaccccaacgtaacggtttaccctaacgtaacttaccggaccgtaaacccgttacggtaacccggaggtaccccgttaaggacggttaaccgccgttaacggaaccccgtaaccggttaaccccgggaccccggtttaacgttttaaccgtttaaaccggtttcgggtaacggttacccggaaccggttaaaccggttacccccgaacgggttaaccgttaccccggggttaagggaacccggttaccccggggttaaccggtacccggttacccgggaacccgggtttccccggttttaacggtttaacccggttaccgggtttacccggggggacccctaagggggggtaccccgttacccccgggg

SEQ ID NO: 98760 - DNA, 613 bp, Homo sapiens
  misc_feature: GYAE6OF02JILW3.17.10.A10.1.454.CMB.1.raw
  modified_base (341)..(341): a, c, t, g, unknown or other
  misc_feature (341)..(341): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagcgtggggcatcagtgtactggtctccgtgcaaggccagtaggtatatatcttcaacaaaatagtagtatagtaattgggtgtacgacacggtacccccggaacaacgggcgttgaggtggggtcggggtggtgaggcggngttttggacgggtaagccgagagtgtgacgacgaagtacgaggtaacgggcaaggatcgaacgttactaccgaccggtaccaacccccacgtaaccactacgtacacgtatacgacaacgtacgacggaacgcctagtacgacgacgtcgacgacaccggactctacttacgtgtcgacgaagtatttcgtttacgtagtctaagtcgtaaagttattacggtagtacgccttaacgttagtaccggtatacggtacctttcgggaccgggg

SEQ ID NO: 98761 - DNA, 882 bp, Homo sapiens
  misc_feature: GYAE6OF02HSWE3.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacgaggtgcccacgcccaggttcagttggtgcagacgtggggctgaggtgcagacgcgtgggcatcaggtgactgtcctccgtgacaagggcctaggtagtactattactacttacaacgtaaaattcgtaggtagtaggtaacgttgggtacgccggtaacgacccgggacccccggtagaacgggtccgtttagggaggggtttggggggtagggggttcggggtacaacggggtccgggttacgtttacgggaaacccggggttaaggaccgtaacggtaaggttaacgttaccggacccgtaaacgggaaacggtaaggttaacggggaaagggaccgtaaaggtacgggtaacccgtaaacgttaacccggttaacccggaacccggtaaccccgtaaaccccccgaaacggaacctaaacccggttacgtaaccctttaacggacgttaacccgaacggtaacccgtcggggaaacccgtccggtaccttagggtaaaccggaccgttacggtaagggacccgttaaaccggccggttaccgttacccgtttaaagtttacccggtagttaacgggaaccgttaaagggttaacgttttcgtttttaacggtccgttacccgttaagttaacccgggtttaacctttaaggtttacggtaaccgtttacgggacttttaacgttaggtaccgggttaacctacggggtttcccttaacggggtacccggg

SEQ ID NO: 98762 - DNA, 630 bp, Homo sapiens
  misc_feature: GYAE6OF02IVSLD.17.10.A10.1.454.CMB.1.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (465)..(465): a, c, t, g, unknown or other
  misc_feature (465)..(465): n is a, c, g, or t
  modified_base (538)..(538): a, c, t, g, unknown or other
  misc_feature (538)..(538): n is a, c, g, or t
  modified_base (593)..(593): a, c, t, g, unknown or other
  misc_feature (593)..(593): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcaacaggtcgcccgacgcccaggttcaggttggtgcagacgtggggctggaggtgcaagaacggccgtggggcatcgagtgactgtctcgtgcaaggccagtgatatntctacaacaaaatgtgtatgtaagttggtncgacgaccggaccccggagtaaggcgttggagggttgggggtggggtcgggtgaggtcggtcgtttaggacgggtaagccgagtagtagtcgacgaacgaaggagtaggaagggcaggtacgactaacgtaacgttaccgaaccggacccaaccccgaacgtaccaacgtacgtacctaanacgtcgaaccaacgtggaaccgcgtacctaggagctcgacgacaccggacggtcttactattccgtaggtacncgtagtatttgttcgttagtactacgttacgtaagttaagttacgtagttacgtnttacgtacgtcggtagtcggttacctgggtaccgggg

SEQ ID NO: 98763 - DNA, 608 bp, Homo sapiens
  misc_feature: GYAE6OF02GABTA.17.10.A10.1.454.CMB.1.raw
  modified_base (377)..(377): a, c, t, g, unknown or other
  misc_feature (377)..(377): n is a, c, g, or t
  modified_base (464)..(464): a, c, t, g, unknown or other
  misc_feature (464)..(464): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaatatagtatagtaagttggtgcgacacgggccccggacgaacgggcttggaggtggggtgggggtggtcgaggcggtcgtttggacggtaaggctacgagtatgacgaaccgaagagaggaaggngaagagtacgaacgtacgttacccgacggtacccaaccccgacgaactacgagtacctacatgacaacgagacgagccgtagagganccgtacgacgaccgaaccgggtccgttactactttaacgtggtacgtacgaagtaacttcggtttactgtacctacgttacgttaacttaatttaggaagttcggtacttacgtagttaggtacgtggtaccttcggtacgggg

SEQ ID NO: 98764 - DNA, 837 bp, Homo sapiens
  misc_feature: GYAE6OF02HLX4S.17.10.A10.1.454.CMB.1.raw
  modified_base (228)..(228): a, c, t, g, unknown or other
  misc_feature (228)..(228): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagccgtggggcatcagtgactgtctccgtncgaaggccagtggatatatcttacaacaaaatgtaggtatagtaagttggggtagcgacgtacgggacccccggagtaagggtcttaggaggttgggggtagggggtcgggtcgaaggtcggtcgttttagggaacgggtaaggctaacgtaggttactaggaccgaaccggtaaagaagtaggaaacgggtacgaacggtaggttaccgaaaccggtactttaaccccggaaccggtaaccccaaccccccgtaagaaaacccaaccgtaacgttaacccgtaactaacgtacggtacctaaacggtcggaaccgtaacggaccgttacgggaacggtacgtacccgtaacggaaccgaaccggtaaccccgggtaccggtttaccttaaacgttttaacccggtaggttaaccgggaacggtaaacggttaaacggttttccggttttttaacttcgggtaacccgtttacgggttaaccggtttaaaccgttttaaacggttttaggtaaaccgttttacgggtaacccgtttacgtttaaaccgggttacccgggttaaccgtttaccggggtttaacccggttacccgggttaaccgggggggg

SEQ ID NO: 98765 - DNA, 691 bp, Homo sapiens
  misc_feature: GYAE6OF02HCLEX.17.10.A10.1.454.CMB.1.raw
  modified_base (555)..(555): a, c, t, g, unknown or other
  misc_feature (555)..(555): n is a, c, g, or t
tcagcgtagactagcacgaccggtgctcgatttagcgtcgatctcaggggacccaaaaaaccacacccctccttgggagaatcccctagatcacagctcctcaccatggactggacctggagcattccttttcctggtggcagcaggcacaggtgcccacgcccaggttcagttggtgcagacgtggggctgaggtgcagaagccgtgggcatcagtgactgtctccgtgacaggccagtgatatatctacaactaaatatggtatagtagtggtgcgacgaccggccccggaagacggtcgtaggaggttggggtgggtcggtcgtaggtcggtcgtttaggacgggtagctacgtagtagcgacgaacgtaagagtaggaaggcgaaggacgtacgaacgtactaccgaccggaacccaaccccgaacgaaccacgtacgtaacctaacgagttacgaacaaccggtagaaccggtacgtaccggtaaggtaacgacggtacgtaaccgggaaccgtaaccgaccgggttacccgtaatttacccgtttaggnggttacggaacgttaacgtttacgtttcggttttctaggtaccgttaacgttaaccgttactttagttaaggtccgttaacggtctttaacggtacgttacggtaccgttacggttacggttcccggtaccggggg

SEQ ID NO: 98766 - DNA, 791 bp, Homo sapiens
  misc_feature: GYAE6OF02I5VLO.17.10.A10.1.454.CMB.1.raw
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagagccgtggggcatcagtgactgtctcctgcaaggccagtggatatatcttacactaaaatntggtatgtaattggggtncgacgacggcccccggagaacgggtcttaggaggtggggtggggtggtcgaggcggtctttggacggttaaggcctaagagtatcgaccgtaaccggaagtacgtagggaaacggggtcaaagggtacggttaccgaaaccggtaacgtttaaccccgaaaccggggtaacccctaaccccccgaaacggaaacccgtaaccgtaacggttaaccttaaccgacgttacggaacctaaaccgttcggaaaccgtacggacccgttaggaacggtacgtccggttaacgaacccggtaccgtaaccggggcccgtttaaccgttaacgtttaccggtcgggttacggtaccgggtaaacgttaaacggtttcggttttttaccgacggtttaccaacggttttaacccggttaaagtttaacggttttacggtaacgttaaccgggttcctttaaccggttaggttaccgggtacccggtttagggttaccccgtttacggggtaacccgggggg

SEQ ID NO: 98767 - DNA, 734 bp, Homo sapiens
  misc_feature: GYAE6OF02FFT2G.17.10.A10.1.454.CMB.1.raw
tcagcgtagactagcacgaccggtgctcgatttagcgtcgatctcgaggggacccaaaaaccaccacccctccttgggagaatcccctagactccacagctcctcaccatggacctggacctggagcacttccttttacctggtcggacacgcaggcacgaggtcgcccacgcccgaggttcaggttggtgcagaccgtggggcctggacggtgcgagaacgccgtggggcacgtcgagtcgaccgttgtcctcgtcgacgaacggccaggtagatacgtatcttacgaacaagtgtgtagtagtacgttcggcgaccgaccgaccggacccggagtacggtcgtaggtggtgggtgggtcgtcgacggtcggtcgtacggacggtacgacgtacgtagtacgtacgaccgaacggaggaggacggaaggacgaacggtcgtaacgaaccgtaccgacccggacccgaacccacccgaagaaccgtacgtacgtacgtaacgacgtaccgaacgtaaccgaccggaacgtacgtacggtaacggacgaccgtaccgacggaacccgtacggtaccggtaccgttacgttaacgttccggtaggtaccgtaacgttacgttttacgtttccgttacccgtagtaccgttaacgtaccgttaacgttacgtaccgtacgtacgtaccttaggtaccggttacggtacgttaccgggttacggtccgggtaaccggg

SEQ ID NO: 98768 - DNA, 711 bp, Homo sapiens
  misc_feature: GYAE6OF02JPPLP.17.10.A10.1.454.CMB.1.raw
  modified_base (613)..(613): a, c, t, g, unknown or other
  misc_feature (613)..(613): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtgcccacgcccaggttcagttggtgcagtacgtggggctgaggtgctagagccgtgggcatcagtgtactgtctcctagacgaacggccaggtgaatatattctacaaagtaaattgtaggtatagtaagttgggcgacgacggtaccggaccccgagtaacgggtctaggaggtggggtgggtggtcgaggtcggtgtttacgggacggtaagctaacgtagtcgcgtaccgaacggaagtagtaggaagggtacaaggtacgtaaccgaacgttaacgtaacccggaccgtaaccccgacccctaaacgaaccgtaacgtacgtacctaaacgacgttcggacgtaacgtacggaccgtacgccgttaggacggttacgcggtaaccgacgacccgggtcccgtacgttaacgttacgtacgtcgtacggtaacgttcggttaaagttttccggtttntaccgttagttaccgttaccgttaaacggtttattacggtcgttaccgtacggtttgtaccgttaggttccggtaggttaccgttcgggtaaccgggg

SEQ ID NO: 98769 - DNA, 780 bp, Homo sapiens
  misc_feature: GYAE6OF02F3MVA.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcgagagccgtcggggcctcgaggtaggaacggtcctccgtggacgaacgggtcttcgtgggtacttcttaccgttttaccctaccttagttaggttactaccgtaacgttggggttacgccgacccggagggtccccgtacggttcggaacccgaaccgtaccgtggtacgggttggacggtggggtaacgttcggggaccgtaaacccgtaacgtaccggtggtcgtaccgaacgtgttacgtcgtttacccacccgtacgtccggtaccgggactaccgtacttaccagtaccgaccaccggtactcccacgtaactacgaccgactcccttaacaggtacggtaggttagaacgggtaccgacggtcaacgacttacgacgtaccgaccgtaccgggtaccgttcgttaattccggtcgtaaggtccgaaggttcccgaacccgtaccggttacggtacccgggtagacccgggtacgacccgggtcgaacccggttcccgggttacccgtttaggacccgtttccgggtacccggggtaacgggtaccgggttacccgtacccgggttccggttaaccccg

SEQ ID NO: 98770 - DNA, 946 bp, Homo sapiens
  misc_feature: GYAE6OF02GVNLJ.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtgcagagccgtggggcatcagtgactgtctctgcagccagtggatatatcttacaacaaaattataggtatagtagttggggtgacgacgacgggccccccggaagaacggggtcttaggaggggttggggggtacggggggttggggtcgacgggtccggggttacgttttacggggaaaccgggggttaaggaccgtaaacggtacggttaacggtaccggtacccgaaaacccgggtaaaggaacggttaacggggaaacgggggtaccgaaaaggggtaacggtttaacccgtaaaccggggttaaaccgtttaaacccccggaacccggggtaaacccccccgtaaacccccccggaaaaccccggtaaaaacccgtaaaccgtaaccccgggtttaaacccttaaaccggtaaccggttacccggtaaacccgaaaacggttacccgggaaaacccgggtaaccccgtacccgggtttagggaaaccggggtacccgttaaccggtaaccggggtaaaccccggtaacccgggtaccccggggttaccccggttaaacgttttaaacccgggttttaccggttacggggtttaaccgggtaacccggttaaagggtttaaccgtttttaggtttttacccgttacgtttaccgtaaccgttttaacccggtaatttaaacggttttcggtaaggtttacgtacttacggttagtcggtacggtacggttaccgttcggggtaccggg

SEQ ID NO: 98771 - DNA, 918 bp, Homo sapiens
  misc_feature: GYAE6OF02FUEXL.17.10.A10.1.454.CMB.1.raw
tcagcgtagactagcacgaccggtgctcgatttagcgtcgatctcaggggacccgaaaaaccacaccctccttggagaatcccctagatcacagctcctcaccatggactggacctggagcatccttttcctggtggcagcaggcacaggtgcccacgcccaggttcagttggtgcagacgtggggctgaggtgcagagcctggggcatcagtgactgtctcctgcgaaggccagtggattagtacttccttacactaaaatacgtggtaactggaagtttgggtacgtccggacgtacgggacccccccgggtaagtaaacgggggtcttttacgggaacgggtttcggggggttacggggggttacgggggttacccgacgggttcggggttacccgttttagggaaacccggggtttaaggggcccgtaacgttaagggttaacggttacgggtaccgtaaccccgggaaaggtaacgggtttacggaaaacggggggtacccgtaagggtaacggttacccggtaaccggtaaaccggttttaaccccgaaccgggggtttaaccccaaacccccgtaccggaaacctaacccggaaccggtttacccttaaacgtaacgttaccggtaaccgttaaaccgttcggggaaacccggaacgggttacccgttacgggtaaacggtacgggtaccgttacgggaaccggaacccgggttaacggtacccgggtttccgtttaaacgttccgttacgggttacggtacggaaccggtttaaacggtttcgtttttacccgaaggttttccgtaacgttacccggttaacgtttaacttcggttaacggttaccggttacgttaccgttaacggttacggttacggtcccggttaacggttttcgggtacccgggggg

SEQ ID NO: 98772 - DNA, 873 bp, Homo sapiens
  misc_feature: GYAE6OF02HNKCA.17.10.A10.1.454.CMB.1.raw
tcagcgtagactagcacgaccggtgctcgatttagcgtcgatctcaggggacccaaaaaaccacacccctccttgggagaatcccctagatcacagctcctcaccatggactggacctggagcattccttttcctggtggcagcaggcacgaggtcgcccaccgcccaggttcagttggtgcagacgtgggctgaggtgacaaggaacgccggtggggcacgtcgagtcgacgtcgtcctcctgacgaaggccgaggtggatatatcttacaaactaaaatagtagtagtagtaagttgggtagacgaaccgaccgggaccccggaacggtaagggtcgtaggtacgggttgggggtgggggttcggtacggcgggtaccgggttcggtttacgggtaaccggggttaacggaccgtacggtaacggttacgtacggaccgaaaccgggaaaggtaaggtaacggaaacggggtacgtaaacgggtaacgtaacccggtaaaccgtaacccggttaaaccccgaaacccgggtaaaaccccccgaaaccccccgtaaacccgaaacgttaaaccccggtaaggtaccctaacggtaacggtaccgtaaaccgtaacggttacggaaacccggtcggaccgttacggaaggaccgtaccgaacggaacggaacccggttacccggtacccgttttaacttacgttaccggagggttaccgacgggtttaaacgttacgttttcgttttacgtaggttacccgttaacgttaacccggttaatttaacgggtttagaaccggttttaccggtatttacggttaacggtaccgggttaacggtttacggttaccggttacgggggtaaccccgggg

SEQ ID NO: 98773 - DNA, 655 bp, Homo sapiens
  misc_feature: GYAE6OF02GGZ5J.17.10.A10.1.454.CMB.1.raw
  modified_base (290)..(290): a, c, t, g, unknown or other
  misc_feature (290)..(290): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcaacaaaatatggtatgaattgggtgcgacacggcccccgganacgggcttggaggtggggtggggtgggtcgaggcggtctttggacggtaaggcagagtatgacaccgaagagtaggaagggcaggagtacacgtacttaccgaccggacccaacccccgaacgaaaccacgacgtacctaacacgttgaccaaacgttcggaaccgaggtcccttaggaacgtacgtccgtagaacccggtaaccgaccgggtcccgttacttaacgtttaccgttggtacggaccgtaaagttaacgtttggtttttaccgagttaccaagtttaccggtaacttaaagttttcggtaacgttagtccttacgttcgtagggtaccgttgggttaccgttcgggtacccggggg

SEQ ID NO: 98774 - DNA, 1177 bp, Homo sapiens
  misc_feature: GYAE6OF02IASRT.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagacgtggggctggaggtgcgaggaacggtcccgtgggggcaacgtcgaaggttcgaaccgttcgttcccgttacccgttcggaccgaaacggccgtaagggttagggtaattaacttacgtttacctttaaccgaaactaaaaaagttacgttagggttaataggtaagtttggggtacgacggaaccggtacccgggaccccccgggtaaacgaacggggtccgtttaggtaacggggttcggggggttggggggtacgggttacgtacgggtaccgggttcggttttacggggaacgggttaacgggaccgtaacggtaaggttacgtcggaacccgtaaccgggtaaaggtaggtaacggggaacggggtacaaaccggggtaaacgttccggtaaaaccggtaaacccgttttaaaccccggaaccccgggtaaaaccccgtaaaacccccccccggtaaacgggtaaaaccccgtaaacccggttaaaccccgggttttaaacccccgttaaaacggtaacccgttaaacccggggtaacccgtaaaacccgggtttaaccggggtaaaacccgggtaaccgggttaacccccggtaaacgggtaaaccgggtaaacccggtcccgggttaaacccggggtaaaccccgggaaaccccgggttaccccggggtttaacccccccggtttaaacggttttaaccccggttttaaaccccgggtttaaccgggggttaccccggttaaaaccggggttaacggttttaaaaaccggtttttccgggtttttttaacccggtttaaccggttaaccccgggtttaaacttttaaccccggggtttaaacctttaaacggggttttttaaccggtaaaccgggttttaaaccgggttaccccgtttttaaaccgttaccggggttaaacccgggtttaacccgggtttacgggttttaaccccgggggttacccgtttaaacccccggggggggggg

SEQ ID NO: 98775 - DNA, 727 bp, Homo sapiens
  misc_feature: GYAE6OF02HATYO.17.10.A10.1.454.CMB.1.raw
  modified_base (530)..(530): a, c, t, g, unknown or other
  misc_feature (530)..(530): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgagaagccgtggggcatcagtgacttgtctcctgacaaggccaggtggatatatcttacaaactaaaatagtaggtataggtaagttgggtagacgacgacgggacccccggaagaagggtcgtagggagggtggggtggggtgggtacgaggtcgggtcgtttagggacgggtaaggcacgtaggtagtcggacgaaccggaagagtagggaaacggacgaaggtacgtacgacgtaaccgttaacccgaacccggaacccaaccccgacgaaaccacgtacgtacaactataccgacaaacgtcggaaccgacgtccgtagacggtacgngtaaccgaccgaccgtacccgggtaccttacgttacgttcgttaggtacggtaacgtaacgttaacttttcggttttacctaggttaccgttaacgttaccgtttaaacgttaacggttttacggaagtttaccggttacctttaggttaacggtaccgggttacggttaccggttaccgttacgggtacccggggg

SEQ ID NO: 98776 - DNA, 714 bp, Homo sapiens
  misc_feature: GYAE6OF02JWG1J.17.10.A10.1.454.CMB.1.raw
  modified_base (233)..(233): a, c, t, g, unknown or other
  misc_feature (233)..(233): n is a, c, g, or t
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
  modified_base (429)..(429): a, c, t, g, unknown or other
  misc_feature (429)..(429): n is a, c, g, or t
  modified_base (685)..(685): a, c, t, g, unknown or other
  misc_feature (685)..(685): n is a, c, g, or t
tcagcgtagactagcacgaccggtgctcgatttagcgtcgatctcagggacccaaaaaccacacccctccttgggagaatcccctagatcacagctcctcaccatcggactggacctgggacgctattccctttttcccgtggtcggcacgcacgggcaccaggtcggcccaccgcccgtaggttctaggttggtcgacagcgtgggggcgtggtaggtgcgaggaacgccgnggggcctatcgaggtgtacttcgtctccgtgacgtacggccgagttggattagtnttccttacaataaatagttaggtatacgtagttggngactaccggaccgggtccccgaaggtacggtcgtaggngggttaggggtcgggggttcgggtacggtccggtgggttccggtttaaggacggtagggacctaagnggtaacgtcgagtaaccggaggttagagggacgggacgtaggacggtacacggttaacgtacccggaaccgtacccgaccccgaacggaacctagtaacgtaccgtacctaaagcgtaaccgagtacctaacggaacctccgaggacggtacgccgacgtaaccgccggtaagtccgttccgttaaagttcccgtaggtaccgacgttacgtagtttccgttagttcgtactagttacgtagttacgtatacggtncgttactgtcgtgtacgtcggtgtaccgg

SEQ ID NO: 98777 - DNA, 795 bp, Homo sapiens
  misc_feature: GYAE6OF02INCZ6.17.10.A10.1.454.CMB.1.raw
  modified_base (152)..(152): a, c, t, g, unknown or other
  misc_feature (152)..(152): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtgcagcaggcacaggtncccacgcccaggtttcaggttggtgcacgtaacgtcggggctaggaggtgcgagaaggtccgtggggcatcgaggtacgacttggttcctaccgtacggacgaacggtcccgaaggttaggacttattaccttacgttcaaaacgttaaagtaggtacggttaatacggtaagttcgggacggtaccgaacgtacccgggaccccggtaacgtaagggttccgttacggaggggttcgggggtagggggtacggttacgacgggtaccggtcgttttaacgggaacggttacgtacgtacgtaaggtacgtacgacgaacggtaacggagttaacgggacgtacgagtaacggtacgaacgttaaccgtacgtaaccccggaacgtaaccccgataaaccgtccgaagttaccctaaagtccgaacgaaccgttaacggacgtacggaccgttcgaaggtttacgacgtaacctacggaccggtaacccggcgggtaccctttaggaccgttaggcgttacgcgtaagggttttacttacgttttacgcgtttacgtacggttaccgtaactttaaaggttcaacgtttacgtctttacgtagggttactacgggttaacggttccgtaacggttacccgggg

SEQ ID NO: 98778 - DNA, 793 bp, Homo sapiens
  misc_feature: GYAE6OF02I8WQ6.17.10.A10.1.454.CMB.1.raw
  modified_base (234)..(234): a, c, t, g, unknown or other
  misc_feature (234)..(234): n is a, c, g, or t
  modified_base (322)..(322): a, c, t, g, unknown or other
  misc_feature (322)..(322): n is a, c, g, or t
  modified_base (478)..(478): a, c, t, g, unknown or other
  misc_feature (478)..(478): n is a, c, g, or t
  modified_base (600)..(600): a, c, t, g, unknown or other
  misc_feature (600)..(600): n is a, c, g, or t
tcagcgtagactagcacgaccggtgctcgatttagcgtcgatctcaggggacccgaaaaaccacacccctccttgggagaatcccctagatcacagctcctcaccatggacctcggacctggacgcatccttttcctggtcggcagcaggcacaggtcgcccaacgccctaggttccaggttgcgacagactgggggcctggaggtgaccgaggaaagccttgggggacctaanccgtagtcggactcgtctacctcgaccgtaagccgaggacggattatactactcaacaaaatgtacgtattggtaacttcggggtacncgaaccgagggtaccccccggaacgtaaggggtccttaggacgggtacggggtttaggggtacggggtacacggtaccggttatttaaccgggaccgggttaaaggcctaaccgtagtacgtagggtaccaacggggaatacggttacgaaagggnaaaaggtcggtaaccaacgttaccgtccggaaaccgttacccgaaccccaacggaaaccttacgacggtttactaaccgagtacgacgaaacttcgaaaccggtacgcgttacgacgtaacnccggttaacgacgacgacgacgtttcctaaacgttcgttaggacgaacgggtaaactacggttttcgggttaacctgggtttaccaagtttaccggttaaacttaagttttagtaaacccgttagggttacccttaacggtttaaggttaccgggtaacgtttacgggtacccttttaggggtaacccggggg

SEQ ID NO: 98779 - DNA, 610 bp, Homo sapiens
  misc_feature: GYAE6OF02FH34J.17.10.A10.1.454.CMB.1.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttnacaaatatggtatgaattggtgcgacaggcccccgganaagggcttgagtgggtggggtggtcgaggcggctttgacgggtaaggcacgagtatgcacgagagtgaagggcagagtacgaacgtacgttaccacggaccaccccccgagtaaaccacacgtcctaacattacgacaaacctgaacgacgaccgttggaagacgccgtagaccggtaaccgacgggacccgtcgttaacgttactacggttagtaccggagtaaagttcgtttttacctagttctaacgtacgtaacctaattttcggaagttacggtacttcggttataccgggacgtaggttaccgttggtacccgggggg

SEQ ID NO: 98780 - DNA, 765 bp, Homo sapiens
  misc_feature: GYAE6OF02ITU41.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagacgtggggctggaggtgcgagaagcctgggcatcgagtgactgtctcctgacaaggccaggtcggatatacttcgttacaaactaaaattagttagtaagtagtaaacggttggggtgaccggaacgaccgggaccccccggaagaacggggttccgttagggagggttagggggttgggggggtcgggttaccggaggtcgggtacgttttacgggaacggggttaacgacgaacgtaggtacgtacgacgtaaccggaagtacgtaggaacgggacagtacgtacgaacgtaacgttaaccgaaccggaacccgaaccccgaacgaaaccgaaccgtacgtactaacgacgttacgaccgaaacgttacggaaccgacggtaccgttaggaacgtacggtacgtaacggaaccggaaccggacggtaacccgttacgttaacgttagtacggtagtaaccgtaaggttagtttacgtttacgttagtaccgtacgttaaccggttaacgttaagttacgttaacgtacggttaccgttaggttaacgtaggttaacggtacggttaccggttacggtaccgggg

SEQ ID NO: 98781 - DNA, 657 bp, Homo sapiens
  misc_feature: GYAE6OF02HBX9A.17.10.A10.1.454.CMB.1.raw
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
tcagcgtagactagcacgaccggtgctcgatttagcgtcgatctcagggggacccaaaaaaccacacccctccttgggagaatcccctagatcacagctcctcaccatggactggacctggagcatccttttcctggtggcagcaggcacaggtgcccacgcccaggttcagttggtgcagactggggctggaggtgcagaagctggggcatcgagtgactgtctcctgacgaaggccagtggatatatcttacaactaaaattatggtaatagtaagttgggtgacgacgacggccccggagaacgggtcttggaggttggggtacggggtggtacgaggtcggtcgtttggaacgggtaaggccaacgagttactcggacaacggaagagtaggaagggcaaggacgtacaacgtattaaccgacggtacccacccgaagaaccacagtacacgancgtacaacgtgacgacncgtacgagacgtctagacgtaccgacggaccgtacttacgtacttggtacgacgtaagtactttgttttaccgtgttacgtacgtttacggttaacgttaattttacggtaacttaccgggttacttacgtttaaggtaccgggttaacgtttcggttaccggtttcggttaacccgggggg

SEQ ID NO: 98782 - DNA, 772 bp, Homo sapiens
  misc_feature: GYAE6OF02HMTA6.17.10.A10.1.454.CMB.1.raw
  modified_base (648)..(648): a, c, t, g, unknown or other
  misc_feature (648)..(648): n is a, c, g, or t
  modified_base (653)..(653): a, c, t, g, unknown or other
  misc_feature (653)..(653): n is a, c, g, or t
tcagcgtagactagcacgaccggtgctcgatttagcgtcgatctcaggggacccaaaaaccacacccctccttgggagaatcccctagatcacagctcctcaccatggactggacctggagcattcctttttccgtgggtggcagcgagggccacgagggtcgccccgaccgcccgtaggttctaggttggtgcaggcggtgggcgtggaggtgcgaaggacgccggtaggggactagtacgagtagtactcgttccgtccgtagacgaacggccgtaggtaggtattagtacgtactaactaaactaaagttagttaggtagtaggtaggttgggtacgacggtaaccggaccgggtaccccggaaggtaacgggtcgttagggaggggttcggggggtaggggtcggtcgagggtcggttacggtttagggaaacgggtaagccgtaacgtaggttagacggtacgaacgggtaagacggtaacggggaaggtcgtaaaggtacggaccgtaaacggtaaccgtaacccggtaaccgaaccccgaaccccggtaaacgaactccggtaacttccgactaacgacgaaccaggaccacggtactaaccgaggacgtacgcggtaacgacgcgacggttccttaagtntacgnggtaactcggtaatttagttcgttacgtgtacgtagttccgttaaatacgtttcggtaagtacccgttagtttacgacgggttccggttaacgtaccgggttccgtaccggggccgggg

SEQ ID NO: 98783 - DNA, 690 bp, Homo sapiens
  misc_feature: GYAE6OF02FSD5O.17.10.A10.1.454.CMB.1.raw
  modified_base (150)..(150): a, c, t, g, unknown or other
  misc_feature (150)..(150): n is a, c, g, or t
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
tcagcgtagactagcacgaccggtgctcgatttagcgtcgatctcaggggacccaaaaaaccacacccctccttgggagaatcccctagatcacagctcctcaccatggactggacctggagcattccttttcctggtggcagcaggcanaggtgcccacgcccaggttcagttggtgcagactggggctgaggtgcagagcgtgggcatcagtgcttgtctccgtgacgaaggccaggtggactatatccttcaactaaaatntaggtattagaagtttgggtgacgacgaccgggcccccggtanaagggtcttggaggtgggggttggggtggtcgaggtccggtcgtttaggacgggtaagcgaagtagttagtgaccgaacgagagtacggaagggntacggatcgaacgtaacgtacccgacggaacccaacccccacggaaccctagacgtttacctaacgtacgttacggacctaacgtaccggtaacgacgtccgttaaggaccggacgttacgacggaaccgccggtaccggtcccgttacgttacgttccgttacggtcgtaacggttaaacgtagtttcgtttacttgttacgtacgttacgtttaacgttagtttagtaagtttacgttccttacggtcttaccgggtttacgcggtttaccgtggttaacccgggg

SEQ ID NO: 98784 - DNA, 716 bp, Homo sapiens
  misc_feature: GYAE6OF02JADI7.17.10.A10.1.454.CMB.1.raw
  modified_base (554)..(554): a, c, t, g, unknown or other
  misc_feature (554)..(554): n is a, c, g, or t
tcagcgtagactagcacgaccggtgctcgatttagcgtcgatctcaggggacccaaaaaaccacacccctccttgggagaatcccctagatcacagctcctcaccatggactggacctggagcatccttttcctggtggcagcaggcacaggtcgcccacgcccaggttcagttggtgcagactggggctgaggtgacgagaacgccgtggggctatcgagtagactgtcctacgtgacaacggcctaggtaggagtatactacttacaacaaaatacgtggtactgtaacgttgggtcgacgacgaccggcccccggagaacggtcgtggaggtggggtggggtcgggtacgaggtcggtcgtttagggaacgggttacggcgtaacgtagtagtcgacggaaccgaaggagaggaacggtacgaggtacgtacggtaaccgtaacgttaaccccggaacggaaaccccgaaccccccgtacggaaaccgtaaccgaacggtacctaaacgacgttacgacctaaacgtaggaccgacgaccgttcgagacgngtacgaaccgacgtaccggacgtacttaccgtacgtacggtcgaccggttaagacggttttacgtttaccgtagtactaacgtccgttaaacgttaagttacgtacgttacggttccttaacgttgtacgggttattaccggtaggttccggtaaccggggg

SEQ ID NO: 98785 - DNA, 739 bp, Homo sapiens
  misc_feature: GYAE6OF02IETKZ.17.10.A10.1.454.CMB.1.raw
  modified_base (121)..(121): a, c, t, g, unknown or other
  misc_feature (121)..(121): n is a, c, g, or t
  modified_base (134)..(134): a, c, t, g, unknown or other
  misc_feature (134)..(134): n is a, c, g, or t
  modified_base (157)..(157): a, c, t, g, unknown or other
  misc_feature (157)..(157): n is a, c, g, or t
  modified_base (359)..(359): a, c, t, g, unknown or other
  misc_feature (359)..(359): n is a, c, g, or t
  modified_base (565)..(565): a, c, t, g, unknown or other
  misc_feature (565)..(565): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
tcagcgtagactagcacgaccggtgctcgatttagcgtcgatctcaggggacccaaaaaaccacacccctccttgggagaactcccctagatcacagctcctcacatggactggactggancattccttttccnggtggcagcaggcacgagggtcncccgacgcccaggttcaggttggtgcgaggtacgtggggctgggagggtcgcgaaggtaacggccgttaggggacacgtacgaggtcgacttgtcctccgtgacgaacggccgagtaggatatatacgttacaaacgtaaaatcgtaggtactaggtaagttgggtacgcgacgccggggtacccgaagtacggtgttaggngggttggggtaggggtggtaacgcggtcggtacggttttcggaaacggggttaacggacacgtagggtacctacggaccgaaccggtagtacggtaggaaggcgaaaggacggtacgaacgttaacgtaaccggaacccggaacccgaacccccgtaacgaaaccgtacgactaccgtaaacacgttacgacgtaacgcgtaacgngaccgtagacgngtacgngaccgtacgcggtcttagtacgtacgtacggcgaacgtgttaaacgttcgtttacgacttacgtaacgtttcccggtaaatttaacttacgggtattaaccgtacggtttccttcggttaacggtaccgtacgggttccgttaccgggttacgggg

SEQ ID NO: 98786 - DNA, 633 bp, Homo sapiens
  misc_feature: GYAE6OF02JJRTU.17.10.A10.1.454.CMB.1.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
  modified_base (554)..(554): a, c, t, g, unknown or other
  misc_feature (554)..(554): n is a, c, g, or t
  modified_base (601)..(601): a, c, t, g, unknown or other
  misc_feature (601)..(601): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggctagcaggcacaggtgcccacgcccaggttcagttcgtgcagactgggctgagtgcgagagccgtgggcatcagtgactgtctcctgcaggccagtggatatatcttacaanaaactatggtacttgaattgggtancgacgtacggccccgganaagggtctttggaggtggggtagggtgggttacaggtcggtcgtttggaaccggttaaggcgaaccgtagttaacgtcggtacaacccggaaatacgaaggtaaccgggagtaaggaaggttccaacggtaaactttaacccgacggaaccaaccccgaacgaacctaccaacgttactaacactacgcgtaaacngtacgacgtcgagtacgacgacgtnaccgtaanccgggaccttagttactccgtagtcgcgtaanagtttcgtttcagttccagtacgtaactagttactaagtaccgtagnttacgtacggtcgtaggtaccttggtaccggg

SEQ ID NO: 98787 - DNA, 1198 bp, Homo sapiens
  misc_feature: GYAE6OF02JJPLM.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagctagggcacgacggtgccccaccgcccgtagggttcctacggtttgggtgtccgaaggtaccggtaggggggccttagggacgggtcggaccaacgggaacggtccgggttagggggccaaggttccaaggtttcggaaccgttggttcccgtccccgttagggacccgtaaacggggtccccgaaaggtttccggggtaaattttacggttaaccgttacccttttaaaccgtaaaaccgttaaaaacgtttacggtttaagggttaaagtttacggggttaaacgggttttaccggggggtaccggtaaaccccgggtaaccccggggtaacccccggggggtaacccccccgggggtaaacggtttaaccggggggttccggtttggggggtaaaccgggggtttcgggggggtttacggggggttaccggggtttacccggggttaaccggggtttacccgggggttttaaccggggtttaaccggggggttaaaccgggggtaaccggttaaccggttaacgggttaacgggttaccggtaacccgggtaaaccggtaaacggtaagggttaacggggtaacggggtaacgggtaaccggttaacgggtacccgggttaaaccgtaaaccggtttaaaccccggtaaaccccgggtaaacccccgggtaaacccccggtaaccccggtaaacccggtaaacccggttaacccggttaaccggtttaaacccggtaaccgtaaccgggtaaaccggtaaacccggttaacccgggtaaccgggtaaccggtaccggtaaccgggttaacggtaaccgggtaaccggtaaccggtaacccggtaacccgggtaacccgggttacccggtttaacccggtttaaccggtttaaccgtttaccgggttacgggtaaccggttaaacggtttaaccggttttaccggttttaccgtttacggttaccgggttaccgtttaacccggtttaaccggtttaaacggtttaccggggttaaccgttaaccggtttacggtttaccgggttaccggttacc

SEQ ID NO: 98788 - DNA, 819 bp, Homo sapiens
  misc_feature: GYAE6OF02I3XUA.17.10.A10.1.454.CMB.1.raw
  modified_base (698)..(698): a, c, t, g, unknown or other
  misc_feature (698)..(698): n is a, c, g, or t
  modified_base (710)..(710): a, c, t, g, unknown or other
  misc_feature (710)..(710): n is a, c, g, or t
  modified_base (748)..(748): a, c, t, g, unknown or other
  misc_feature (748)..(748): n is a, c, g, or t
tcagcgtagactagcacgaccggtgctcgatttagcgtcgatctcagggggacccaaaaaaccacacccctccttgggagaatcccctagatcacagctcctcaccatggactggacctggagcatccttttcctggtggcagcaggcacaggtcgcccacgcccaggttcaggttggtgcaggacgtgggggctggaggtgacaggaagccggtaggggcagtcgagtgactcgtctccgtagcgtaaggccaggtacggtattaacgttacttacttacaaacgtaaaaagttagtacggttaatacggttaaggttggggtacgaccgtaacccggaacccggggtaccccccggaaggtaacggggttcgttagggggtaggggttaggggggttcggggggtacgggtacaacggggtcggttaacggtttagggaacgggttaacggaccgtaacggtaggtagttccggaaccgaaacgggtaaggtacggtacgggaacgggacggtaacggcgtaaacccgtaaccgtacccggttaaacccggaaccggtaccccgaaacccctaacggaactaaccgtacgtaacgtacctaggcgtaaacgtagtccggaacacggttcgtaacggacgtacgtacgaccggacgaaaccggccggttacgttaaccggtagttacgtggtaccgntaaaccggtttntttacgttcgttacgtcttaacgttacgttaaaggttntttaaggaccggttagtaccgttacttacgggtacggttacgttccggttagggttaccgggtaaccgggg

SEQ ID NO: 98789 - DNA, 861 bp, Homo sapiens
  misc_feature: GYAE6OF02HZ03U.17.10.A10.1.454.CMB.1.raw
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgccctaccgcccgaggttcgagttcggtgcagacgtgggctgaggtgacagagccgtggggacagtcgagtggactgtcctccgtgacaaggcctagtggatagttactctacgaactaaaatgtaggtatagtaagttgggtacgacgacggtaccggacccccggaggtacggtcgttaggacgggttgggggtacggggtcgggtacgtacgggccggttacgtttacggggaccgggttaacgggcgtaaccgtaggttacgtaccggtaacccgtaaccgggtaacggtaacgtacggggaaacgggtacccggtaaagggtaacctaccggggaacgttaaacgtaaccccgggtaacccgggtaaaccccaaccccccgtaaacggtaaaccccgaacgggttaaccgttaaaccccgtaaaccggttacggacccgtaacccgggtaaacgtaacgggaacccgttaacggaccggttaacgtaagaccgtaaccggtacgaccggtaacgcccgggtacgttacccgttaacggttaccgtacgggtaaccgtacgggttaacgttaaacgttttcgttacgtttaacggttacacggtttaacccgtaaactttacggtttaagtaacccggtaccggtttacttaaccgtttacggacccggttacggttaccggtttaccgttccgggtaaccggg

SEQ ID NO: 98790 - DNA, 664 bp, Homo sapiens
  misc_feature: GYAE6OF02GEMYV.17.10.A10.1.454.CMB.1.raw
  modified_base (146)..(146): a, c, t, g, unknown or other
  misc_feature (146)..(146): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
tcagcgtagactagcacgaccggtgctcgatttagcgtcgatctcagggggacccaaaaaccacacccctccttgggagaatcccctagatcacagctcctcacccatggactggacctggagcattccttttcctggtggcagcnggcactaggtgcccacgcccaggttcagttggtgcagacgtggggctggaggtgcagaagccgtggggcatcgagtgactgtcctctgcgaaggccagtgatatctctacaacaaatagtgtatgtaagttggtgcgacgacggccccgagaacggtcgtacggnggtgggtggggtggtacgaggtcggtcgttagggaacggtaaggcaacgtagtacgngaccgaacggaaagtagtacggaacggcgaaggtacgtacgacgtaacgttacccgaaccgaacccgaacccccgaacgaaccgtaaccgtaacgtacctaacgtacgtacaaccgtaacgtacggaaccgacgtaccgtaggacgacgtcgtacggaaccgacggaccgtaccgtacttacgtacgtcggtacgtacgtaacgttacgtttgttttcgacgttacgtataccggtaattaggttacgagttacgtacttacgtaggtacgttagtacggttacgttcggtacggg

SEQ ID NO: 98791 - DNA, 685 bp, Homo sapiens
  misc_feature: GYAE6OF02F02XR.17.10.A10.1.454.CMB.1.raw
tcagcgtagactagcacgaccggtgctcgatttagcgtcgatctcagggggacccaaaaaccacacccctccttgggagaatcccctagatcacagctcctcaccatggactggacctggagcatccttttcctggtggcagcaggcacaggtgcccacgcccaggttcagttggtgcagacgtggggctgaggtcgcagagcctggggcagtcagtgactcgctcctgactaaggccagtggatatacgtcttacaactaaaatatcggtatagtaacgttgggtgacggacgtacggcccccggaacgacgggtacgttaggtacggtacggggtggggtggggtacacgggtcgggttattttacgggaacgggttaaggccgtaacgtagtacgttcggccgaaacgtaacgtaagttagggaacgggacgaggtacggtacaaccggtattaacccggaaccggtaccctaacccccgaaggtaaccaacgtaactacccgtaacgtatacggaaccaacgttagaaccgtacgacgtaggacgagctaggaccacgccggtacgtatacgtaccgtggtgacgaacgtatttcgttcgtgtactagtacgttaactagtttcgaagttacggctttacgtacgtacggtttagacggtttaccggttggtaacccgggg

SEQ ID NO: 98792 - DNA, 599 bp, Homo sapiens
  misc_feature: GYAE6OF02I2NJ3.17.10.A10.1.454.CMB.1.raw
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (448)..(449): a, c, t, g, unknown or other
  misc_feature (448)..(449): n is a, c, g, or t
  modified_base (534)..(534): a, c, t, g, unknown or other
  misc_feature (534)..(534): n is a, c, g, or t
  modified_base (552)..(552): a, c, t, g, unknown or other
  misc_feature (552)..(552): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacaggtgccaccgcccaggttcagttggtgcagacgtggggctgaggtggcagaagcctggggcatcagtgactgtctcctgcgagccagtggatatatcttcaacaaaatagtgtatgtaagttggtgcgacgacggcccccggacgaagggcgtttggagggttgggggtgggggtggggtcgaggcggtcgtttggacggtaaggcagagtangacgaccgaagataggaagggnaaggatacgaacgtagtaacccgaccgacccaaccccgaacgaaaccacgtaacgtacactannacaactaggacgaccgctggacgagcgtacgacgaccgaccggcgtacttacttcgtagtgaccgtaagtattgtttctgtactntaccgttaattagtttanagttacgtcttacgtagttcggacggttcgtacggttccggtcgggg

SEQ ID NO: 98793 - DNA, 670 bp, Homo sapiens
  misc_feature: GYAE6OF02JENWQ.17.10.A10.1.454.CMB.1.raw
  modified_base (280)..(280): a, c, t, g, unknown or other
  misc_feature (280)..(280): n is a, c, g, or t
tcagcgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtcgcccacgcccaggttcagttggtgcagactggggctggagtgcagacgccgtggggctagtcagtgactgtctcctgcaaggccagtgatatatctacaacaaatgtgtatgtaagttggtgcgacncggccccggagacgggtcttggaggtggggtggggtggtcgaggtcggtgtttaggaacgggtaggcacgtagtatcggacaaccggaagtacgtaggaacgggacaggtagtacgacgtaactaaccacgtacgaacccaaccccgaagaacaacgtacgtaacctaactagtacgaacgtaactacggaccgacgtcgtaggacgtagacgtacgaacccggacgtacccgggtccttacgtacgttacgtcggttacggaccgtaagtaagttttcgttttaccgagttccgtaatttacccggttaattaacggttttacgaagtttacccggtgttttacccgttaacgggtacggttaaccggttcggtaccggttacccgggg

SEQ ID NO: 98794 - DNA, 751 bp, Homo sapiens
  misc_feature: GYAE6OF02IK0H0.17.10.A10.1.454.CMB.1.raw
  modified_base (121)..(121): a, c, t, g, unknown or other
  misc_feature (121)..(121): n is a, c, g, or t
  modified_base (133)..(133): a, c, t, g, unknown or other
  misc_feature (133)..(133): n is a, c, g, or t
  modified_base (148)..(148): a, c, t, g, unknown or other
  misc_feature (148)..(148): n is a, c, g, or t
  modified_base (544)..(544): a, c, t, g, unknown or other
  misc_feature (544)..(544): n is a, c, g, or t
  modified_base (560)..(560): a, c, t, g, unknown or other
  misc_feature (560)..(560): n is a, c, g, or t
  modified_base (694)..(694): a, c, t, g, unknown or other
  misc_feature (694)..(694): n is a, c, g, or t
tcagcgtagactagcacgaccggtgctcgatttagcgtcgatctcagggggacccaaaaaccacacccctcctgggagaatcccctagatcacagctcctcaccatggactggacctggancatccttttccnggtgcagcaggcacnggtgcccacgcccaggttcaggttggtcgcagacgtggggctggacggtgcaaggacgccgtggggccatcgagtcgtactcgtctccgtgaccgaacggcctaggtcgtattatacttcttacgaactaaaatcgtaggtatacggtaagttcgggtcgacgacggtaccgggacccccggagtaagggtcgttacgggtaggggtttacgggggtggggttacggtaccggacggtcgggttacggtttacgggaaaccgggtagaccgtaagtacgtacggccggtaaccgacggtaaggtacgtacggggaacggcacgggtactacgaaacgttaccgttaacccggaacccggtaaccccaccccgaagaccgaccgtacgtaccgtaanactacggacctaacgngtaaccgcggtaaccttcgaacgcgacgggttacgaacccgtacggaacccttcggttacctacggttacgtcgggtacgtacgttaaacgtgttttacgtcgttacggtctaacgtttacgtatttaaccggntacggtcgtaaccttggtaaccgttggtaaccgtcgttaccggttaccgggcccggg

SEQ ID NO: 98795 - DNA, 700 bp, Homo sapiens
  misc_feature: GYAE6OF02I4F32.17.10.A10.1.454.CMB.1.raw
  modified_base (360)..(360): a, c, t, g, unknown or other
  misc_feature (360)..(360): n is a, c, g, or t
  modified_base (559)..(559): a, c, t, g, unknown or other
  misc_feature (559)..(559): n is a, c, g, or t
  modified_base (591)..(591): a, c, t, g, unknown or other
  misc_feature (591)..(591): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctggtggcagcaggcacgaggtcgccccacgccctaggttcgaggttggtgcaggacgtggggctggaggtgacgaggaacgccggttgggggctacgtcgaggttcggacttcggttcctccgtgacgaacggccgaggtggatatatcttacgaaactaaatagtggtagtagtaaggttgggtcgaccgacgaccgggtccccggaaggtaagggtcttaagggnggtgggggtagggtcggtcgaggtccggttgtttagggacggttaacggcgtaacggtaggtacgtacggaaccgtaaccggaaaagtgggtaaggaaccgggggtacaaaaggggtccgttaaccggaaccggtttaaaccggtaacccggaccccggaaaccaacccccgtaacgaaaccgacgtaacgtacgtaanacgtacgacaacgtagaacgtgcgtagacgangtacgaacgacgcgtacgtactagtcgagtgacgttatacgtttntcgtnactaagtctaagttatagtagtcggttatacgttggtacgtaggtcgtcgtcggacggg

SEQ ID NO: 98796 - DNA, 739 bp, Homo sapiens
  misc_feature: GYAE6OF02JAZHN.17.10.A10.1.454.CMB.1.raw
  modified_base (187)..(187): a, c, t, g, unknown or other
  misc_feature (187)..(187): n is a, c, g, or t
  modified_base (258)..(258): a, c, t, g, unknown or other
  misc_feature (258)..(258): n is a, c, g, or t
  modified_base (573)..(573): a, c, t, g, unknown or other
  misc_feature (573)..(573): n is a, c, g, or t
  modified_base (701)..(701): a, c, t, g, unknown or other
  misc_feature (701)..(701): n is a, c, g, or t
tcagcgtagactagcacgaccggtgctcgatttagcgtcgatctcaggggacccaaaaaccacacccctccttgggagaatcccctagatcacagctcctcaccatggactggaccgtggagcattccttttcctggtggcagcaggccacgacggtcgcccaccgcccgaggttcctaggttcggngcgaggacgtggggctggaggtgacgaggaacgccgtggggacctatcgaggtacggtactcgtcctccgnggacgaacggccgagtggacttatacttctacaactaaatagtggtatagtaagttgggtgacgacgaccggtaccccggacgaagggtcgtaggtagggtgggggttaggggtcggtcggacgggtcggtcgtttagggacgggtaacgacgagtcgtagtcgaccgacggaagtaggtacggacgggacgaaggtcgtacgaagtacccgttaaccggaaccggtaccccgtaaccccgaacggaaccgaaccgtaacggttacccaacgtacacggtaaccgtaacgtcggaaccgtacgaccgttaaacgnggaacgccgtaacgacccggtaccgggtacttaccggttacgttacgtttacgacgtacgggtaccgtaaggttaaactttcggttctagtacttacgttacgtacttaggtttaacgtagtacgttntacgtagttacggtactcggttacggttcggtacgggg

SEQ ID NO: 98797 - DNA, 730 bp, Homo sapiens
  misc_feature: GYAE6OF02HB3DE.17.10.A10.1.454.CMB.1.raw
  modified_base (106)..(106): a, c, t, g, unknown or other
  misc_feature (106)..(106): n is a, c, g, or t
  modified_base (135)..(135): a, c, t, g, unknown or other
  misc_feature (135)..(135): n is a, c, g, or t
  modified_base (178)..(178): a, c, t, g, unknown or other
  misc_feature (178)..(178): n is a, c, g, or t
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (324)..(324): a, c, t, g, unknown or other
  misc_feature (324)..(324): n is a, c, g, or t
  modified_base (437)..(437): a, c, t, g, unknown or other
  misc_feature (437)..(437): n is a, c, g, or t
  modified_base (464)..(464): a, c, t, g, unknown or other
  misc_feature (464)..(464): n is a, c, g, or t
  modified_base (553)..(553): a, c, t, g, unknown or other
  misc_feature (553)..(553): n is a, c, g, or t
  modified_base (571)..(571): a, c, t, g, unknown or other
  misc_feature (571)..(571): n is a, c, g, or t
  modified_base (587)..(587): a, c, t, g, unknown or other
  misc_feature (587)..(587): n is a, c, g, or t
  modified_base (627)..(627): a, c, t, g, unknown or other
  misc_feature (627)..(627): n is a, c, g, or t
  modified_base (679)..(679): a, c, t, g, unknown or other
  misc_feature (679)..(679): n is a, c, g, or t
tcagcgtagactagcacgaccggtgctcgatttagcgtcgatctcaggggacccaaaaaccacacccctcctgggagaactcccctagatcacagctcctcaccanggacgtgaccgtggagcattccttttccngggtgacagcgaaggcacgaggtcgcccaccgcccgtaggttntaggttggtcgcagacgtcggggntcggaggtgcacgacggccggtgggactgtacagtacggtctcgttaccgtccgnggaaccggaacgggccgttaggtaggtaacttacggttaacttacttaacggaaactaaaaacggtnttaaggtataaggtagttggtacgacggacggacccggtaccccgaagtaacggtcgtggttagggcggggttggccgtagacggtcgtcggttttacggaacggaacggtanacgtacgtagtgaccgaaccgggtaanacggaggtaacggacgtaacgtacggtcgaaaccgttcgaaacccgtaccggaacccaccgtaaacgacgtaacacgttacacgtaacntaacacgtagaacccggngtaccgttagaaccgngtacgccgtaacggacgtacggccgttaccttgtaaccgngtacgtacgtagttattcgtttctacgtatacgtacggttaattaacggttntaacgtacgtcgttacggtactacggttaccggtcgtacggttacggacgg

SEQ ID NO: 98798 - DNA, 755 bp, Homo sapiens
  misc_feature: GYAE6OF02ISYFV.17.10.A10.1.454.CMB.1.raw
  modified_base (473)..(473): a, c, t, g, unknown or other
  misc_feature (473)..(473): n is a, c, g, or t
  modified_base (575)..(575): a, c, t, g, unknown or other
  misc_feature (575)..(575): n is a, c, g, or t
tcagcgtagactagcacgaccggtgctcgatttagcgtcgatctcaggggacccaaaaaccacacccctccttgggagaatcccctagatcacagctcctcaccatggactggacctggagcattccttttcctgggtggcagcgaggcacgaggtcgcccacgcccgtaggttccaggttggtgcagtacgtgggctggacggtgacgaggacgtccgttggggacagtacgagtacgacgttggtcctccgtagacgtaacggcctaggtacggtattattacgttctactaactaaaataggttagtacttagtaggttcgggtacgacggacgtaccgggaccccgtaagaacgggtcgttagggagggttgggggttcggggtaggtcgacgggtcgttacgttagggacgggtaacgacgtacgtaggtaactcggaacgacggtaaggtacgtaggggaacggtanaacggtagtaacgacggttaacgaacccggaccggtaacccaccccgaagaaccgacgtacgttacgaacgtactcgtaacgtacgtacggacgaccgtcgnggtaacgcctacggcgaaaccggtcgaaccggtcccgttattaaccggtgtaccgtacgggtacttaaggttctttcggtttactccggtagttccgttaacgttaaccgtttggtttacaacggttccgtatacgtttacgggtacgtacggttacgggtttacttcggggaacccggg

SEQ ID NO: 98799 - DNA, 512 bp, Homo sapiens
  misc_feature: GYAE6OF01EDPU9.10.37.D04.1.454.CMB.1.raw
  modified_base (506)..(506): a, c, t, g, unknown or other
  misc_feature (506)..(506): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcacatcagcagcctggacgcctgaagatattgctagtttattattgtcagcagcgtagcaggtggctttcacgtttcggcccggggtacaaagtgaaatcaaacgactgtggctgcacatctgtcttcacttctcccgctntctacg

SEQ ID NO: 98800 - DNA, 258 bp, Homo sapiens
  misc_feature: GYAE6OF01D0ROJ.10.37.D04.1.454.CMB.1.raw
  modified_base (256)..(258): a, c, t, g, unknown or other
  misc_feature (256)..(258): n is a, c, g, or t
tcagcatagtagtgcacgaccggtgctcgatttagtagcatactgttgggtctgggacagacttcactctcaccatcagcagcctgcagtctgaggaccttggagtttattactgtcagcagtatcataactggcctccgtggacgttcggccaagggaccaaggtggacctcaaacgaactgtggctgcaccatctgtcttcatcttcccgccatctgacactactatgctgagcgggctggcaaggcgcatagnnn

SEQ ID NO: 98801 - DNA, 574 bp, Homo sapiens
  misc_feature: GYAE6OF01D6MP1.10.37.D04.1.454.CMB.1.raw
  modified_base (210)..(210): a, c, t, g, unknown or other
  misc_feature (210)..(210): n is a, c, g, or t
tcagcatagtagtgcacgaccggtgctcgatttagtagcatactggttgggtttagggggaggaacctgctcagttacggacccagacggaaccatggaagccccagcgcagcttctcttcctcctgctactctggctcccagattccactggagaaattgtgttgacacagtctccagccacgctgtctttgtctccgaggggaaacgngccaccctctcctgcagggccagtcagagtgttcgccctattcgttagggtgtatcaacataatccggcaggcctccgaggctcctcattctttgatgtctttcaacgacgggcccctggccgtcccgaggcaggttcaggtggcaggtggtctgggacagacttcactctcacatcagcagcctagacgcctagaacgtatttcgctagtttacttacgtgtcagcagcgtcgcctacgttcgggcggtaggtcgtccgtacgtttcgggacggacgggaaccaaagtaggacggtaacgtaaacggtaacgttggtacggtctacgcaacccgtattacctggtttccttcgtacgttcccg

SEQ ID NO: 98802 - DNA, 527 bp, Homo sapiens
  misc_feature: GYAE6OF01CEYWP.10.37.D04.1.454.CMB.1.raw
tcagcatagtagtgcacgaccggtgctcgatttagtagcatactgttgggtttggggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccacgtggacgtcccagccaggttcaggcggcggtgggtctgggacagacttcactctcaccatcagcagcctgcagtctggagtaccttggatttattactgtcagtcagtatcataacgtggccctcggtggaccgttcggaccaaggggaccaagggtcggaacctacgaaacggtactggtcgcctgaccaccatcgtgttcctctacg

SEQ ID NO: 98803 - DNA, 504 bp, Homo sapiens
  misc_feature: GYAE6OF01AWT5U.10.37.D04.1.454.CMB.1.raw
  modified_base (427)..(427): a, c, t, g, unknown or other
  misc_feature (427)..(427): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagacctcctcatatatgaagcctcttccagggccactggagtcccagccaggttcaggcggcggtgggtctgggacaggacttcactctcaccatcagcagccctgcagtctgacggaccttggagtttattactgtcagcagtntcatactgcctcggtgcgttcggcaagggcaagggtcgacctacgaaacgactgtcgctgcaccatctgtccttgac

SEQ ID NO: 98804 - DNA, 568 bp, Homo sapiens
  misc_feature: GYAE6OF01BC8EJ.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagacctcctcatatatgaagcctcttccgagggccacgtggacgtcccagccaggttcaggcggcggtgggtctgggacaggacttcactctcaccatcagcagcctgcagtctggacggtaccgttggtacgttttatacttgtacagctaagttactactagtaactcggtccgttaccggtcggtaccgttcggacgaacgggaccgtaagggtcggaaccctaccggaaacggtacgttggtacggccgtcgaccaccgtatcttagttccttctacgttccccg

SEQ ID NO: 98805 - DNA, 504 bp, Homo sapiens
  misc_feature: GYAE6OF01CNN36.10.37.D04.1.454.CMB.1.raw
  modified_base (497)..(497): a, c, t, g, unknown or other
  misc_feature (497)..(497): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaattagcctggtaccaacagaagcctggccaggttcccagactcctcatatatgaagcctcttccgagggccactggactcccagccaggttcagcggcggtgggtctgggacagcttcgactctcaccatcagcagcctgcagtctgacggtaccttggagtttattactgtcagcagtatcatactggcctcgtgacgttcggcaagggccaaggtcgacctacgaaacgtatggtcgctgactacatcgtntctctac

SEQ ID NO: 98806 - DNA, 626 bp, Homo sapiens
  misc_feature: GYAE6OF01CKBW9.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaacgcctctccgagggccacgtggacgtcccagccaggttcaggcggcgggtgggtcgtgggacaggtacttcactctacaccatcagcacgcctgcagtctaggacggtaccttggtagtttacttacgtgtacagtctaagttactactaactaacgtcggtcccgttacggtcgggtaccggtttaccgggacccggtaacggggtaacccgtaaggggtaccggtaaacccgttaaccggaaaaccggtaaccgttagggtacgggtaccttacggaccctaacccgtacttaccgttacgttaccctttccgtacctttcccccgg

SEQ ID NO: 98807 - DNA, 518 bp, Homo sapiens
  misc_feature: GYAE6OF01DVZ6F.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatccagcagcctgcagtctgacggtaccttggagtttatacgtgtcagcagtatcaataactcgcctccgtggacgttcggacaacgggaccaaggtcggacctacgaaacgtaactggtcggctgaccacactcgtgtcctctac

SEQ ID NO: 98808 - DNA, 540 bp, Homo sapiens
  misc_feature: GYAE6OF01C8QY4.10.37.D04.1.454.CMB.1.raw
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctctgcagggccagtcgaggggatcagcagcaatttagcctggtaaccaacagaagcctggccaggttcccagacctcctcatatatgaacgcctacttccgagggccatggacgtcccagccaggttcagcggcggtggctgggacagcttcnctctcacntcagcacgcctgcagtctgacggtaccttggtagtttatacgtgtcagtctagtatactaatacgtcggtccgtccggtggtacgttcggaccgaacgggaccaaggtcggaacctacgaaaccgtaagtggtcggcgtcgacctactacttcgtcgttctctacc

SEQ ID NO: 98809 - DNA, 553 bp, Homo sapiens
  misc_feature: GYAE6OF01DNXR7.10.37.D04.1.454.CMB.1.raw
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (462)..(462): a, c, t, g, unknown or other
  misc_feature (462)..(462): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacacaatctccagccaccctgtctgtgactccaggtgagagagcccaccctctcttgcagggccagtcgaggggatcagcagctaatttagcctggtaaccaacagaacgcctggcctaggttccccagacctcctcatatagtgaacgtccctctccgacgggcccaacgtggaacgtcccagccgtaggttcaggcgggcgggtgggtcgtggggacagcttcactcncacntcagcacgcctgcagtctgacgtacttggatttatacgtgcagctagtatcaatacgtcgcgtcgnggtacgtcggacgaacggaccgagggtcgtaccgtacgaaacgagttcgggtcgactcggacctaccgtattccgtcgttccttcgtaacc

SEQ ID NO: 98810 - DNA, 861 bp, Homo sapiens
  misc_feature: GYAE6OF01B4H2C.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcgacggccagtcgagggtatcgagcgagctaagttacgccgttaggtaaccaacgaacgaacgtccgtcggaccgtacggtcccagtacctcctactataatagtagaacgtccttacgttccgacgggaccaacgtcgggtaccgtacccgacggtaccgtagggttaccgacgggccgggtcggggttcgggtaccggtacggggaaccgtacgggttaccttaccgtaacccgttcctaaccctaaccgtaacgtcccgaaggtcccgaaccggttccgtaccgtacgtaacggttcccgtagggtaacccgggttaaccgtttagggtttaacgtttttaccgttaccggttacggaacgtaccgtaacgggtttaacgtttaactacccgttaaaacgttaacccgggttccgggtaccccggtttaccggggttaacgggttaacccccgggtttccgggaaacccggggtaaaccgggggtaaacccgttaacggggggtacccgtaaaaccccggttaacccggaaaaaacgggtttacccgttacgggggtacccggtacccgttttaacgggaccccttaaaccgtacggtttacccgtttcgggtttccccttttaacggtaacccccccgg

SEQ ID NO: 98811 - DNA, 499 bp, Homo sapiens
  misc_feature: GYAE6OF01EF099.10.37.D04.1.454.CMB.1.raw
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
tcagcatagtagtgcacgaccggtgctcgatttagtagcatactgttgggtttggggaactgctcagttaggacccagacggaaccatggaagccccagcgcagcttctcttcctcctgctactctggctcccagattccactggagaaatagttttgacgcaatctccagccaccctgtctgtgactccaggtgagagagccacctctcttgcagggccagtcaggggatcagcagcaatttagcctggtaccaacagaagcctggccaggttcccagactcctcatatatgaagcctcttccagggccacgtggacgtcccagccaggttccagcggcggtgggctgggacagacttcactctcacatcagcagcctgcagtctgagaccttggagtttatactgtcagcagtatcataactggcctcgtggacgttcggccaagggaccaaggtcgacctagaaacgaactgnggctgcacatctgtcttcntccc

SEQ ID NO: 98812 - DNA, 568 bp, Homo sapiens
  misc_feature: GYAE6OF01BPY4A.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaacgcctggccaggttcccagacctcctcatatatgaacgcctctccgacgggccacgtggacgtcccagcccgtaggtcaggcgggtcgggtgggtcgtgggactacgtacttcactctaccaccatcagcacgcctgctacgtcgtaggacggtaccgttggtacgtttactacgtgtacagtctagtactcgaatacgtcgtccgtcggtcgtaccggtcggaccgaacgggaccgtagggtccgacctacgaaaccgtacgtcggcggctagcccgtactcttacgtcgttcctctaccg

SEQ ID NO: 98813 - DNA, 584 bp, Homo sapiens
  misc_feature: GYAE6OF01EUN5X.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagacgccaccctctcttgcagggccagtcgaggggatcagcagctaatttacgcctaggtaaccaacagaacgcctggccacggttcccagacctcctcatatatgaacgcctctccgagggccacgtggacgtcccagccgtaggttcgaggccgggtcgggtcggggtactggggactacggtacttcgactcctaccaacctatccagccacgccgtaagacgccgtagaacgttagtttcgacttaagttttattactgtactagcgacggtcgtcgtccgtacgtttcgggacgggtgtcgaccgtacggttcggacgggaagggaacctaaagtaggacgtaacgaaacgatcgtagcacgacactatctgtctacg

SEQ ID NO: 98814 - DNA, 573 bp, Homo sapiens
  misc_feature: GYAE6OF01A7XIR.10.37.D04.1.454.CMB.1.raw
  modified_base (307)..(307): a, c, t, g, unknown or other
  misc_feature (307)..(307): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctaggtaccaacagaagcctggccaggttcccagactcctcatatatgaacgcctnttccgagggccactgggactcccgagccaggttcaggcgggcggtgggtcgtgggacaggacttcgactctcaccatcagcagcctgacgagtcgtaggaacggtacctttgggtaattttagtacgtgtacagtactagtactactaagtacgtacggtcctccggttaggaccgttcgggaccgtaacgggaaccctaagggtcggaacctacggaaacgaacgtggtacgcgtacgactacctagtacttcggtccttgtacc

SEQ ID NO: 98815 - DNA, 583 bp, Homo sapiens
  misc_feature: GYAE6OF01BKY4A.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaaccaacgagaacgcctggccaggttcccagacctcctacatatatgaacgtcctcgttccgagggcccacgtggacgtcccagccgtaggttcagcggggcggtcggggtctgggacaggacttcactctcacatcagcagctgcagtctggacggtacgttggtatttacttactgtcagctagtactactaagtaccgtcggtcccgttacggtcgggtaccggttccggaccggaacgggtacccgaaggggttacgaacccgttacgaaaaccgtacggtggtacggcgtacgacctactacgtcgtcgttacctcgtaccg

SEQ ID NO: 98816 - DNA, 782 bp, Homo sapiens
  misc_feature: GYAE6OF01DLKMQ.10.37.D04.1.454.CMB.1.raw
  modified_base (530)..(530): a, c, t, g, unknown or other
  misc_feature (530)..(530): n is a, c, g, or t
tcagcatagtagtgcacgaccggtgctcgatttagtagcatactgtggttggggaggaactgctcagttaggacccagacggaaccatggaagcccagcgcagcttctcttcctcctgctactctggctcccagacttccactggagaatgtttgacgcaatcctcagccacctgtctgtcgacctccgaggtgagacgacgccctaccctctcgttaggccgtaacgggccctaaggttcgacggggtaactccgaaggtcctaaggcctaaacgttttagcccgttacgggtaaacccaacgaacgtaaacggccgttacggtacctaacggttaccccaggtacccctccgtaccgtaagtttacgttaacgtcggaaaacgtcccgtaccgtttaccggacgggtaccctaacggttcggaaccgttccccgaaaggtcccgtaacggtttcgacggtccgggtcgggtcggtccgtacgggactacggtacctttccgacttaccgtacgaaccgtacgtaccgngtactaccgtccctaggtacccgtaaggttctacgggtaacgggtttaccttagggtaacttttacgttacgttacggtacctacggtactacgtttataccgtaaagttaaccgttccgggtacccttccgggtaggttaacccggtcgtacccgaaacgggtaccctacgggtccgtaaccctaagaaacccgtggtacggtaccggttcgtacggacctacctaggttcctacgttcgttccgttaacg

SEQ ID NO: 98817 - DNA, 791 bp, Homo sapiens
  misc_feature: GYAE6OF01DCMC5.10.37.D04.1.454.CMB.1.raw
  modified_base (242)..(242): a, c, t, g, unknown or other
  misc_feature (242)..(242): n is a, c, g, or t
tcagcatagtagtgcacgaccggtgctcgatttagtagcatactgttgggtttgggggaggaactgctcagttaggacccagacggaaccatggaacgcccagcgcagcttctcttcctcctgctactctggctcccagattccactggagaaattagttttgacgacaatctccacgccaccctgtctgtgactccgaggtgagagacgcccaccctctcttgcgagggccagtcgagggntcagcagactaagttacgccgtaggtaaccaaacgagaacgtccgtacggacctacggtacccagtacctcctacaattatagtacgaacgtccctaccgttaccggacgggccctacgtcggaaccgtccccgaaggtcccgtaggttccgacgggtccggggtcgggttacgggggtacgtacggggaactacggtaacccttccgaccgttcctaccgaaccgtactaccgacgtacaccggtccttacggcgtaacggttccgtacgggtaacgggtttacccgtttaggggtttaacgttttaacgtttaccgtacggttaccgtaacggttacgtaacgttaacgtaaccgttaaagtttaacccgggttccgggtacccggtttaccgggttaccgggttacccggttaaccgggacccgggtaaaacggggtaacccggttaaaggggtacccggtaaacccgtaaccggtaaaaaccggtacggttggtaccggaccgttacgccctaaccgtattccgttagttccccgttataccccg

SEQ ID NO: 98818 - DNA, 603 bp, Homo sapiens
  misc_feature: GYAE6OF01DK4NB.10.37.D04.1.454.CMB.1.raw
  modified_base (259)..(259): a, c, t, g, unknown or other
  misc_feature (259)..(259): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcgaggggatcagcagcaatttgcctggtaccaanagaagcctggccaggttcccagactcctcatatatgaacgcctcttccgagggccacgtggactcccagccaggttcagcggcggtgggtctgggacagtactcactctcacatcagcagcctgcagtctgacggtaccgttggtactttagtactgtacacgtcgtaagtactacaagttaaccgtcgggttacccttccgggtacgggtaccggtttccgggacccgtaacggggaacccgtaagggttaccggaacccgtaacgaaaaccggtaacgtcgggtacgggtctaccggaccaacccgtacttacgtacgtttccttcgttccgtttacccccg

SEQ ID NO: 98819 - DNA, 768 bp, Homo sapiens
  misc_feature: GYAE6OF01COEMK.10.37.D04.1.454.CMB.1.raw
tcagcatagtagtgcacgaccggtgctcgatttagtagcatactgttggggtttgggggaactgctcagttaggacccagacggaaccatggaagccccagcgcagcttctcttcctcctgctactctggctcccagattccactggagaaatagttttgacgcaatctccagccaccctgtctgtcgactccaggtgagagacgcccaccctctcgtgcgacgggccagtcgaggggatcagcagctaatttacgccttaggtaaccaacgagaagccgtggacccacggttcccagtacctcctacatatactagaactccttctccggagggccacggtggaccgtcccacggccgtagggttccgagggccggggtcggggttcgggtcgtacggggaactacggtaccttcgtaaccgtcctaccaaccctagtaccgacggccgaacgtcccgtacggaccgtaacggttccggtacgggtaaccgggttaaccgtttaggggttaacgtttttaacgtttaaccggttacggttaccgacggtacgttaacggtaacttaaccgtaacgtttaaacccggttccggggtaccccgtttacccggggttacgggttacccgggttacccgggaacccggtaacggggaacccgtaacggggtaccgggtaaaccctaacggaaaaccggtaccggtacggtaccgggtcgtaccggacctaccgttaacgttccgttagttcccttcgtcccgtttaccccg

SEQ ID NO: 98820 - DNA, 902 bp, Homo sapiens
  misc_feature: GYAE6OF01C3LF4.10.37.D04.1.454.CMB.1.raw
tcagcatagtagtgcacgaccggtgctcgatttagtagcatactgttggggtttgggggaactgctcagttaggacccagacggaaccatggaagccccagcgcagcttctcttcctcctgctactctggctcccagattccactggagaaattagttttgacgcaatctccagccaccctgtctgtgactccaggtgagagacgccaccctctcttgcgacgggccagtcgaggggatccagcagtactaatttacgccctacggtaacccaacgagaacgtccgtcggacccgtacggggtttaccccacggtacccttcccgtactaacttaacgtaacgttacggaaacgttcccctttcccgttacccgggaaccgggtcccttaaccggtacgggaccgttaaccccgacggtaccccggttaacgggttaccggacgggtccggggtaccgggggttcggggttccggtaacgggaaccgtaaccggttaacctttccctaaccttcccgtacccaaccgtacaccgtacgaaccgtccgggtaccctggaaccgtcgggttacggtacggtaaccgggttaaccggttttaggggttaaaccgttttttagttaacccggttcgttaacgaacggttacgttaaacggttactttaacggtaacgtttaaccggttccggttaccccggtttccggggtaccgggttaacccggttacccgggggaacccgggttaaacgggggtaaccccgtaaacggggttaaccggaaacccccgttaaaccgggtaaaacccggtaaggtttccggggtaacggtaccccggacggtaccccgaaacccgttccgttcgtttaccggtttacctttaacccgttccggtttacccccccg

SEQ ID NO: 98821 - DNA, 827 bp, Homo sapiens
  misc_feature: GYAE6OF01CLK50.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagacttccactggagaaattagttttgacgcaatctccacgccacctgtctgtgacctccgaggtgagagacgcccaccctcttcgttgcgacgggccaggtcgaggggactcgagcgaaggtctaaacgttttacgccgtacggtaaccaaacaaggaaccggtcccgtcgggaccctaacgggtttaccccaaggtaccccttacccctacgtaatttaacgtaacgttaggaaaccgttcccttacccgttacccggaaccggggtacccctaacggttcgggtaaccgtaccccgacggtcccggtaacggtttccgacgggtccggggtaccggggttcggggtaccggtacggggaccgtaacgtacccgtttaccaccgttcctaccaacccgtactaccgaacggccgtacgtaccccggtagtccgtaacgttacggtaccgggtaaccgggttaccgtttaggggttacgttttaacgttacgtcgtacgactacgaagttacgtacttaaacgtaccggtccggtaccgttcccgggtacgggtacccgggttaccggaccggtaaacgggtccggtaacgggtaccggtaaacccaacgggtaaaccttacggtcgggttccggacgttacccgaccgtaaccttacggttccttacccggttcttaacgttccccgg

SEQ ID NO: 98822 - DNA, 747 bp, Homo sapiens
  misc_feature: GYAE6OF01B5VJ8.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgacctccgaggtgagagacgcccaccctctcttgcgacgggccagtcgaggggatcgagcagctaagtttacgccgtacggtaacccaaacgaaggaacgccgtacggacccgtacggttcccccaagtaccctcccgtacaattaattaacgtgaaccgtcccttaccgttcccgacgggccctacgtcgggaccgtccccgagccgtacggttccgacggccggggtcgggtggggtccgtagggaacgtacgtaccttcaccgttcgtaccaccgtatccgacgtcacggtcctgaccgtacgttccgtacggtaaccgggttaccgtttagggttaacgttttacttaccgttgtaccgtacgtacgtaacgttacgtacgtaagttaaccgtcggtacccgttccgggttacgggtacccgggttacggaacccggtaaacggggtacccgtaaacggggttaccgtaacccgtaaaccggtaaaccggttacgttcgggtacggtcccgtacgccctaacgttacgttcccgttacgttcccttcgtaccccg

SEQ ID NO: 98823 - DNA, 568 bp, Homo sapiens
  misc_feature: GYAE6OF01BOAAQ.10.37.D04.1.454.CMB.1.raw
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
  modified_base (561)..(561): a, c, t, g, unknown or other
  misc_feature (561)..(561): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgtcaatctccagccaccctgtctgtgactccaggtgagagagccaccctctcttgcagggccagtcgaggggatcagcagcaattagcctggtaccaactagaacgcctggccaggttcccagacctcctcaatatagtgaacgtccctccttccgacgggtccacgttggacgtcccgagccgtaggttcaggtcgggtcggtacgggtcgtcggggacacggtacttcacctctcctacatcganccacgcctgcagtcgngacggtacttggtatttatcgtgtcagtcagtacncgtaataccgtcggtcctcggtcggtacgttccggacgacgggaccgaggtcgtaccacggtaacgacgttggcggtcagccactactcttacgcttccgtnttccccg

SEQ ID NO: 98824 - DNA, 741 bp, Homo sapiens
  misc_feature: GYAE6OF01B7RBI.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaattagttttgacgcaatctccagccaccctgtctgtgactcgaggtgagagacgccacctctcgtgcgacgggccagtcgaaggggctcgagcagactaagtttacgccgtacggtaaccaacgagaacgccgtgggacctacggttccccaagtacctcctacaatatacgtacgtaaccgtcccttaccgtaccgacgggccctacggtacgggtaccgtccccgaaggcccgtaagggttaccggaggtccgggggttcggggtacggggttaccgtacggggaacctaacgggtacctttacccgaccgttcccgtaccaacccgtacgtaccggacgtaccggaacgtaccggtagggtacccgtacggttaacggtaaacgtttacgtttacggaccgttacgttacgtttacttacgtcgtacgacgtacgtagttacgtcggtaccgtaacccgtaccgttaaaggttaccgtttacgggaccggtaacgggaaccgtaaggtacgtacggacgtaacgtacgaacggacgtacggttggtacggtacgtacgaccgtaccgttacttcgttcgttaccg

SEQ ID NO: 98825 - DNA, 725 bp, Homo sapiens
  misc_feature: GYAE6OF01DDY8R.10.37.D04.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctccagattccactggagaaattagtttgacgcaatctaccagccaccctgtctgtgactccgaggtgagagacgtccaccctntctgcgacgggccagtcgagggntcgagcagtactaagtttacgaccgtaggtaaccaaacgacgaaacgtcccgtacggaccgtacggttaccccaggtacctacctactaataatagtacggaaccgtcccttacgttaccgacgggtaccctaaggtcggtaccgtacccacggtccgtaaggtcgacgggtcggtcggggtggtccgtagggaactacggtacctcgacctcgtaaccactacgtacgaacgcacgctacgactacggtgtacggaacggttacgtttaagggttaacttttacgtacgtggttaccagtacttacgttaaatcctaaacgttaaccgggtccggttacccgttaccgggtaacgggtaccgttacggaacccgggaagggtaccggtaaaggccgtaaaaccgttaacgaaaacggtacgttgggtacctacggtaactaaccgacctttaaaccgttggtttccttaccgttcccgttaccgg

SEQ ID NO: 98826 - DNA, 559 bp, Homo sapiens
  misc_feature: GYAE6OF01B6HFV.10.37.D04.1.454.CMB.1.raw
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccacctctcttgcagggccagtcaggggatcagcagctaatttagcctggtaccaacagaacgcctggccaggttcccagactcctcatatatgagcctcgttccagggcccacgtggacgtaccccagcccagggtttcacggcggtcggggtgggtacgtggggacagaccttacgactctccacctatcgagtcacgcctgctacgtcgtacggacggtaccttgggtatttattacgtgtcagtctatatctagtaactggtcctcggtggtacgttccggaccgaagggaccgagggtcgaccctagaaaccgtacgtgtcggctcggcacgtcttcngtcttcncttcccg

SEQ ID NO: 98827 - DNA, 752 bp, Homo sapiens
  misc_feature: GYAE6OF01DBT15.10.37.D04.1.454.CMB.1.raw
tcagcatagtagtgcacgaccggtgctcgatttagtagcatactgttggggtttgggggaactgctcagttaggacccagacggaaccatggaagccccagcgcagcttctcttcctcctgctactctggctcccagattccactggagaaattagttttgacgcaatctccagccaccctgtctgtgactccgaggtgagagacgccaccctctcttgcgagggccagtcgaggggatcgagcagctaagtttacgccttaggtaccaaacgacggaacgccgtcgggaccgtacggtttccccaaggtaccttccctactaataacgtaataggaacgtcccttccgttacccggacggggtaccctaccggtagggtaaccgtccccgacggtacccgtagggtttccgaacgggtccggggtcggggttcggggtccgttcgggggaacctacggtacctttccgacccttccgtaccaaccctagtccgaacggtccgaacgtcccgtacggccgtacggtccgttacggtaaccgggttaccgtttagggttacgttttacgttacgttacggtactacggtacgtaacgtactacgtaagttaaccgtcggtacccgttccggtacgggtaccgttaccggaccggtaacgggaccgtaacgggtacgaacccgtaaccggaaacgtacgtaggcggtccgcgacccgaaccttacgtcgttacgttcttccgtaccgttccccg

SEQ ID NO: 98828 - DNA, 1091 bp, Homo sapiens
  misc_feature: GYAE6OF01CYGFP.10.37.D04.1.454.CMB.1.raw
tcagcatagtagtgcacgaccggtgctcgatttagtagcatactgttggggtttgggggaggaactgctcagttaggacccagacggaaccatggaacgccccagcgcagcttctcttcctcctgctactctggctcccagacttccacgtggaagtaaattaggttttgacgcaatctccacgccctacccgtgtctgtcgacctccgaggtgagacgacgccctacccgtctccgttgaccgtacggggaccgtaaggttacggaacgggggtactaccggaaggaccgtaacggtaccgttaaacggttttaaccggaccccggtttaaccggtaaacccgaaaaccgtaacgggtaaaccggtcccccggtaccggggtacccgttaacccgggtttacccccgaaacggttaccccttacccttacgtaaagtttaacgtttaacgtaccgggtaaccttccccgttacccggtttacccggaaccggggtccctaaaccgggttaccggggtaaccccgttccccggaaccggttacccggtaacggggtttccggaacgggtccccgggggtcgggggtttacggggtcccggtaacgggtaacgttaaccggtaccctttacccgaacccggtttacctaaccccgaaaccttacgtacccggacggtacccgtacccgggtaccgttacgggtaacccgttaagggttacccggttaaacgggggtaacggtttaaccccgggttttacggggttttaacgttttaacggtttacccggtttacggaacccgttaggttaacccggttaacggtttaacctaaccggttaaaccgtttaaccccgggttccgggttacccccgggtttccggggtaaccggggtttaacccgggttaacccccgggggtaaacggtaaacccgggggtaaacccgggttaacggggttaaaccccggtaaccccggttaaaaccggtaaaccgggttaaacccggttccggggtaccgggttacccgttacccgaacggtacccccttaagtttcccgttaacccggtttacccgttcccgtttaacccccg

SEQ ID NO: 98829 - DNA, 691 bp, Homo sapiens
  misc_feature: GYAE6OF01CIRWQ.10.37.D04.1.454.CMB.1.raw
tcagcatagtagtgcacgaccggtgctcgatttagtagcatactggttggggtttggggggaggaactgctcagttaggacccagacggaaccatggaacgccccagcgcagcttctcttcctcctgctactctggctcccagattccactggaagaaattagttttgacgcaatcctccagccaccctgtctgtcgactccgaggtgagcgacgcctaccctctcgttgcgacgggccaggtcgagggactcagcagctaaagttcgccgttaggaaccaacagacgccgtcggccgtacgttacccacgtacctcctacatactagtcgaaccgtcctactccggacggctacgtggacgtccaggcctaggtccgagggcgggtcgggtcgggtcgtacgggaacgtacgtaccttcgacctttcccaccgacccgtaactccggacgtaccgtacggtcctacgggacgttaccgggtcttacgggtaacggttaccgtttagggtttaacttttacgttacgtcggtactaggtacctaagttactacgtaacttaacccgggtcggtacccgttcgggtaccggttaccgggttaaccggaccggtaaacgggaccggtaacggtaccggtaccgaaacgtaacgtaggtcggcgtcgacacgtacctactgttctcttcgtacg

SEQ ID NO: 98830 - DNA, 711 bp, Homo sapiens
  misc_feature: GYAE6OF01BOQFL.10.37.D04.1.454.CMB.1.raw
  modified_base (239)..(239): a, c, t, g, unknown or other
  misc_feature (239)..(239): n is a, c, g, or t
  modified_base (544)..(544): a, c, t, g, unknown or other
  misc_feature (544)..(544): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccacgtggagaaattagttttgacgcaatctccagcccacctgtctgtgacctccgaggtcgagagacgccaccctctcgtgcgacggccagtcgagggntacgagcagactaagttacgccgtacggtaaccaacgagaacgtccgtcggaccgtacggttacccagtacctccgtactaattatacgtacggaaccgtccctttaccgtccggaccgggacctaacggtcgggtaacccgtacccgacggtaccgtagggttccacggggtcgggtccgggttggtacggtacggacgtacgtaccgttcaaccttccgacaccgtatcgaacgcgaacgtccgtgaccgtaggttccgtagggtaaccggttacgtttagggttaactttacgttaacggtntacgtaagtcgtaattaacgtacctaagtacccgtcggtaccgtcggttacgggttacgtacccggaacggaacgggtacgaacggggttaccacccggtaaaacgacggtactagggtcggccgtacgacccacgttctcggttaacttccgttaccgcttccccg

SEQ ID NO: 98831 - DNA, 674 bp, Homo sapiens
  misc_feature: GYAE6OF01CDQ3R.10.37.D04.1.454.CMB.1.raw
  modified_base (441)..(441): a, c, t, g, unknown or other
  misc_feature (441)..(441): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccgaggtgagagacgccaccctctcgtgcgacgggccagtcgaggggatcgagcagctaatttagccgttaggtaaccaaacagaacgccgtggacctacggttcccagacctccacattatagtcgaacgtcctaccgtccgacgggccacgtcggaccgtcccgaacgtaccgtaggttccgacggccgggtacgggttcggggtaccgtagggactacggtaccttaccgacttcctaccacctanccacgaccacgtcctagtacgtacgtcgtacggtacggttacgttggttaactttagttacgtacgtacgagtacgtagttaactactaacgtaacgtccggtcccgttacggttaccgggttaccggttaccgggaccgtaacggggaaccgtacgggtaccgaaacccgtacgaaaccgtacgacggtccggtcgtaccaccgtacctagttccgtcttctccgttacccg

SEQ ID NO: 98832 - DNA, 877 bp, Homo sapiens
  misc_feature: GYAE6OF01DFJ7M.10.37.D04.1.454.CMB.1.raw
tcagcatagtagtgcacgaccggtgctcgatttagtagcatactggttgggttgggggaggaactgctcagttaggaccagacggaaccatggaacgcccagcgcagtcttctcttcctcctgctactctcggctccagtacttaccacgtaggaagtaaagttaggttttacgacgactaacttcctaccaacgtccctaccgttgtcgtcgtacgacctcggaggtgacgacgccgcctacctctcgtcggcgacggctacggtacggaggactcacgacacgtacttacgtacgtccgtaacggtaaccaacgtaacggacgtaccgacggtaccgtaccggtccaacggtaccttacctaacttaagttaattacggtaccgtaccgttaccctttacccggtaccggtaaccggtaccggttaccgtaccgggtacctacccggtaaccggtccggtaacgggtcgggtaaccggggtccggggtacgggggttacgggtaccgggtaacgggtaaccgtaccgttaaccgttaccgtacgtaacccgtaccgtaactaaccgacgtaacccgacgtaccgtcgtaacggtacgtaaccggttacggttacggtaacggtttcggttaaggtttacgttaacgtaccgttacgtagtaccgtaagttacgttaacgtaacgttacgttacccgggtaaccggttccgggttaaccgggttaccgggttaaccgggttaaccggggaaccggtaaccggtaaccgggtaacgtaacccggtaaaccggtaaaccgtaaacggtaacggtacgggtcgttaccggaccgttaacctaaccggtacttaccgtaacgttccgtaaacggttcccg

SEQ ID NO: 98833 - DNA, 871 bp, Homo sapiens
  misc_feature: GYAE6OF01CF442.10.37.D04.1.454.CMB.1.raw
  modified_base (637)..(637): a, c, t, g, unknown or other
  misc_feature (637)..(637): n is a, c, g, or t
tcagcatagtagtgcacgaccggtgctcgatttagtagcatactggttgggtttgggggaggaactgctcagttaggacccagacggaaccatggaagccccagcgcagcttctcttcctcctgctactctggcctcccagacttccactggaataaattgttttgacgcaacttcctccacgcccaccctgtctgtcgtacctccgaggtcgagagaccgccctacccttcttcgttcgcgacgggcctaggtcggaaggggtctcgacgacgtacgtacgttaacgttacgtaccgtaaccggtaaaccaaaggtacggaaccgtcgtaccggtaccgtaccgtacccgaacgttaccctaccgtaactaagtttaactacggtaacgtacccgttcccgttaccggtaccgggaaccggtacccgtacggtaccgggtacccgaccccggtacgtaccgggttaacggttcggggacggtcggggttacgggttccgggtacggtacgggtaaccgtacggttacctaccgttaccgtacctaacctacgtaccgtacgaccgccgtaacgtcccgtgaccgttacggtacgtacggtaaccgtttacgttacggtttaatttaacttccggtntaaccggtacgttacgtagtttaacctacggttaaacggttcccgttacccgggtcccgggtttaccgggtaaccggttaccgggtaccggaaacccgggtaaccgggtaaccgggttaaccggtaccccggaaaaccgtaacccggttaaaccggtgggtttaaccgcccggaaccgttacgtacccgtaaacgttccgtttaccgttacccgtttagtccccgtttccccgg

SEQ ID NO: 98834 - DNA, 726 bp, Homo sapiens
  misc_feature: GYAE6OF01D9LJT.10.37.D04.1.454.CMB.1.raw
  modified_base (487)..(487): a, c, t, g, unknown or other
  misc_feature (487)..(487): n is a, c, g, or t
tcagcatagtagtgcacgaccggtgctcgatttagtagcatactgttgggtttgggggaactgctcagttaggacccagacggaaccatggaacgccccagcgcagcttctcttcctcctgctactctggcctccaagattccactggaagtaaattagttttgacgcaatcctccacgcccacccttgtctgtcgacctccgaggtgagacgacgcccacccttctctgcgacggccagtcgagggtactcgagcagtactaagtttcgccgtacggtaaccaaagtacggaacgtccgtacggaccctacggttacccacgtaccttcctacgtataatacgtacgtaaccgtccccttcgttaccggacggtaccctacggtcggtaaccgccccgagtccgtaggttacggacggggtccgggtcgggttcgggtcgacgggtactaccggtaccttacgacctactacccgaactacgtacncggactcgtccgtacgcgtacgtcgtacggtacgttacgttaggttactttacgttcggtcgtacgtagtactagttataccgtaacgttcgtccggttaccgttcggtacggttaccggtacgggaaccgggtaacggtaccggtaacggtaccgaaaccgtaaccgtaaacggtacggttcggacgtacccgtcgacctaacgttcgtcgttaccgtcttacccgtccgttaccccg

SEQ ID NO: 98835 - DNA, 864 bp, Homo sapiens
  misc_feature: GYAE6OF01A9DEN.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaattagttttgacgcaatctccagccaccctgtctgtcgacctccgaggtcgagacgacgcccacccttctcttagccgagggccaggtccgaaggggtactccgagccacgacgtaaagtttacggacccttacgggaacccaacgtaacggaaccggacccgtcgggacccctaacgggttacccccaagtacccttaccctactaattaactacgtacgaaccgtcccttacgttacccggaacggggtccctaacggtcgggtaacccgttaccccgaggtaccccgttaacgggtttcccgaacggggtcccgggggttccggggttacgggggttcccgggttaacccgggggaactaacccggggttaccctttaacccgtacccgttacccgtaccctaaaccgtacgttacccgagacccgtacgtcccgtacggtactacggttaccgtacgggttaacccgggtaaccggtttagggttaacgtttacgtttaccgtacggtacgacgttactaacggttaactacccgtaagttaaccgtccgggtacccgttcggtaccgggttacgtcccgggaaccgaacggggtaacccgtaacgggacccgttaacccgaaccggtaaaccggttaagtcccgggtaggtcccgaacggaccccacgttacgtaccgtttaccgttacccttccgttaccgtaccccg

SEQ ID NO: 98836 - DNA, 944 bp, Homo sapiens
  misc_feature: GYAE6OF01A636C.10.37.D04.1.454.CMB.1.raw
  modified_base (731)..(731): a, c, t, g, unknown or other
  misc_feature (731)..(731): n is a, c, g, or t
tcagcatagtagtgcacgaccggtgctcgatttagtagcatactgtttggggtttgggggaggaactgctcagttaggacccagacggaaccatggaagccccagcgcagcttctcttcctcctgctactctggctcccagattccactggagaaatagttttgaccgcaatctccagccaccctgtctgtgacttcaggtcgagagacgccacccgtctcttgcgacggggccacgtcgaggggactcgacggctacggactaagttttacgacccggttacggtaaccctaaacgaacggtaaaccggtcccgttacgggtcccgtaaccggggtttacccccgaacggtaccccttacccgttacccgtaaatttaacgtaacgtcgtaaaccgtcccgtttacccgtttacccggaccggggtacccgtaaccgttgggaacccgtacccccggtaacggaccccgtacggggtttacccgacggtcccgggggttccggggttacggggttacccggttaggggtaacccgtaacggttaccgttttacccgtaaacccgttcccggttaccctaacccgttacgttaccgaacgtcccgtaacccggtcctttacgggtacctaaccgggttcggtttaccgggttaaccggggttaccgtttttaaggttacggtttttaaccgttacccgtttagggtacccaacggttacgttaaccgggtnttaaaccgtacgggtttaaacccgtttccgggacccgttttacgggtacccggggttacggtttaacccggaccgggtaaacgggtacccggtaaacgggttcccgtaacccggtaaccggtaaaaccccgtacgggttcgtaacccgggtttcccaaacggtacccttaacccggttacctttaggttccttttacccgtcccgttacccgg

SEQ ID NO: 98837 - DNA, 493 bp, Homo sapiens
  misc_feature: GYAE6OF02F7GZE.10.37.D04.1.454.CMB.1.raw
  modified_base (490)..(490): a, c, t, g, unknown or other
  misc_feature (490)..(490): n is a, c, g, or t
tcagcatagtagtgcacgaccggtgctcgatttagtagcatactgttgggtttggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttccccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtgacgttcgcaaggccaaggtgacctcaacgactgtggctgcacatctgtcttcntcc

SEQ ID NO: 98838 - DNA, 515 bp, Homo sapiens
  misc_feature: GYAE6OF02FMOZB.10.37.D04.1.454.CMB.1.raw
tcagcatagtagtgcacgaccggtgctcgatttagtagcatactgttgggtttggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggacgtcccagccaggttcagcggcggtgggtctgggacagacttcactctcaccatcagcagcctgcagtctgacggaccttggagtttattactgtcagctagtatcaataactggcctccgtggacgtttcggaccaacgggaccaagggtcgacctacgaaacgaactaggtggctgacacatctgtcttcattccg

SEQ ID NO: 98839 - DNA, 530 bp, Homo sapiens
  misc_feature: GYAE6OF02HOLY4.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggacgtcccagccaggttcagcggcggtgggtctgggacagacttcactctcaccatcagcagcctgcagtctgaggtaccttggtatttattactgtcagcagtatcataacgtggccctccggtaggtaccgttcggaccgaagggaccgaagggtcggacctaccggaaacgacgtggtcggcgtgccactactcgtcgttcttcctac

SEQ ID NO: 98840 - DNA, 551 bp, Homo sapiens
  misc_feature: GYAE6OF02IYZ6R.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagctaattagcctggtaccaacagaagcctaggccaggttccccagactcctcatatatgaagccctcttccagggtcccaacgtggacgtcccagccaggttcagcgggcggtgggctgggacagacttcactctcaccgatcagcacgcctggcagtcgtgacggtaccttgggatttatacgtgtacagtcgatatctaataacgtcgaccttccggtaggacgttccggacgaaacgggccgaaggtacggactaccgaaacgtacgtggtcggtctagccgaccagttacgtcgtcgttactaccg

SEQ ID NO: 98841 - DNA, 539 bp, Homo sapiens
  misc_feature: GYAE6OF02GN74F.10.37.D04.1.454.CMB.1.raw
  modified_base (526)..(526): a, c, t, g, unknown or other
  misc_feature (526)..(526): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttccccagactcctcatatatgaagcctcttccagggccacgtggacgtcccagccaggttcaggcggcgggtgggtctgggacagacttcactctcaccatcagcacgcctgcagtctagaagtatttgctagtttattactgtcagctaagtataagtgtacgtttgggttttattcgtacgtttccggtccctagggaacctaagtggttactttcgaaggtacgtaacgttggtggtctgactacctntcgtcttctctac

SEQ ID NO: 98842 - DNA, 511 bp, Homo sapiens
  misc_feature: GYAE6OF02F0YNA.10.37.D04.1.454.CMB.1.raw
  modified_base (201)..(201): a, c, t, g, unknown or other
  misc_feature (201)..(201): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttatgacgcagtctccagccaccctgtctgtgtctccagggganagagccaccctctcctgcagggccgtcagaatattgctaccaacttagcctggtatcaacaaaagcctggccaggctcccagactcctcatctctggtgcatctcgagggccacgtggtcgtcccagccaggttcaggtggcaggtggtctggaacagagttcactctcacatcagcgctgcagtctgaagtatttgcttagtttatctgtcagtcagtatatgtactttggtttatctacgtttcggcctgggacctaagttgatttcgaagtacgtaacttggtcgctgacctacgtatcgtgtcttc

SEQ ID NO: 98843 - DNA, 530 bp, Homo sapiens
  misc_feature: GYAE6OF02IQT5T.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagcccagcccaggttcagcggcggtggtctggggacagtacttcgactcgtcacatcagcagcctgcagtctgacgtacctggagtttatactgtacagctagatcagtaactggcctcgtggacttcggaccgaaggaccgaagtacggtacctaccgaaaccgaacgtcgtaaggcctagcgtaaccactcgtcgttcttcgtaaccg

SEQ ID NO: 98844 - DNA, 550 bp, Homo sapiens
  misc_feature: GYAE6OF02H3CQF.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcacatcagcagcctgcagtctgacgaccttggatttattactgtcagtcagtatcaataacgtgtcctcggtcgacgttcggaccgtaaagggaccgtaaggtcggtaaccctacggaaaaccgtaaccgttggtacggaccgttaggacctaacccgtattaccgtcgttccttactaccg

SEQ ID NO: 98845 - DNA, 516 bp, Homo sapiens
  misc_feature: GYAE6OF02JCWNG.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctctccagggccactggagtcccagccaggttcagcgggcggtgggtctgggacagacttcactctcacatcagcagcctgcagtctgacggaccttggtagtttattacgtgtcagctagtatcattaactggccttccggtcggacgttcggccgaacgggaccgaggtcgacctacgaacgactggtcgctgaccacatctcgttctctac

SEQ ID NO: 98846 - DNA, 512 bp, Homo sapiens
  misc_feature: GYAE6OF02G87SJ.10.37.D04.1.454.CMB.1.raw
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttccccagacctcctcatatatgaagcctcttccagggccacgtggacgtcccagccaggttcaggcggcggtgggtctgggacagacttcactctcaccatcagcagcctgcagtctgacggtaccttggtagtttattacgtgtcagctagtatcatacgtgcctcgtgtacgtcggacaaggaccgaggtcgactacgaacgactggcgtcngaccncatctntcctntacg

SEQ ID NO: 98847 - DNA, 555 bp, Homo sapiens
  misc_feature: GYAE6OF02GM35W.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggacgtcccagccaggttcagcggcggtgggtctgggacagacttcactctcaccatcagcagcctgcagtctggacggtaccttggagtttattactgtcagctagtatcataacgtcgtcctccggtggtaccgttccggacccgtaaacgggaccgtaagggtccgacccgtacgaaaaccggtaaccgtcggtacggactacggaccaccgtattccgtcgttccttctaccg

SEQ ID NO: 98848 - DNA, 525 bp, Homo sapiens
  misc_feature: GYAE6OF02GAUF5.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttccccagacctcctcatatatgaagcctcttccagggccacgtggacgtcccagccaggttcaggcggcggtgggctgggacagcttcactctccaccatcagcacgcctgcagtctaggacggtaccttggtagtttattacgtgtcagcagtatcattactggtcctcgtcggacgttcgaccgaaggaccagggtccgacctacgaacgacgtggtacgctgacacctactctcgtcttcacttccc

SEQ ID NO: 98849 - DNA, 613 bp, Homo sapiens
  misc_feature: GYAE6OF02GGENJ.10.37.D04.1.454.CMB.1.raw
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaattagcctggtaccaacagaagcctggccaggttcccagactcctcatatatgaagcctcttccagggcccactggacgtcccagccaggttcacggcgggcgggttggctggggacaggacttcactctccacnctcagcagcctgcagtcngacggtaccttggagttttattacgtgttcagtacagttactacgtaataacgttcggtcccgttaccggttgggtaacccggttccggaccgtaaaccggggtaaccgtaacggggttacggaacccgttaacggaaaacccggtaaccgttaggtaccggggtaccttggacccgtacccgtaacgttccgtcgtttacccgttcgttaacccg

SEQ ID NO: 98850 - DNA, 627 bp, Homo sapiens
  misc_feature: GYAE6OF02ICSDU.10.37.D04.1.454.CMB.1.raw
  modified_base (349)..(349): a, c, t, g, unknown or other
  misc_feature (349)..(349): n is a, c, g, or t
  modified_base (430)..(430): a, c, t, g, unknown or other
  misc_feature (430)..(430): n is a, c, g, or t
tcagcatagtagtgcacgaccggtgctcgatttagtagcatactgttgggtttgggggaacgtgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcgagcagcaatttacgccttggaccaacagaagtcctggccaggttccccagactcctcatatatgaacgcctcttccgagggccaacgtggacgtcccagccgaggtcagcggngggtgggtctgggacgagtacttcgactctcacatccagcagcctgctagtctgacggtacttcggtaagtttacttacgngttacacgactagtactactaaacgttaacgtgggtccccttaccgggtaggtaacccggttttcggggaaacccgtaaaggggtaaaccccggaagggtttacgggaacccgttaaccaaaacgggtaaacccttggcgggttacctacggacgtaccaacctccgtttacgtaccttttaccgacgtttaccccg

SEQ ID NO: 98851 - DNA, 614 bp, Homo sapiens
  misc_feature: GYAE6OF02GFM4T.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagacaatttacgcctggtaaccaacagaagcctggcctaggtccccagacctcctcactctcgtggtgctatccgttcggagggcccacgtcggtcgtcccacgccgtaggttccaggtcggctaggtcgggtctaggaacaggtacttcactctaccaccatcacgcggcctgctagtctagtaagttagtttgacttagtttacttacgtgtcagtactaagttaacgttaattacggtacgtttgggttttaacttaccgttacgtttccggtcccggttaggtaacccgtaaggttcgttactttacgaacggtaacgtaaccgttggtacggtacgtcgtacctaccgtactttcgttcgtaccgtttaccc

SEQ ID NO: 98852 - DNA, 695 bp, Homo sapiens
  misc_feature: GYAE6OF02GX8JH.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaacgcctggccaggttcccagacctcctcatatatgaagcctcttccaggccacgtcggacgtcccagccgaggttcaggccggtcgggtgggtcgtggggacaggactttcgactcctccaacctacgtctacgaccgacggtccctggccgagttccgtagggtaacgggtacccgtttaggggtaacggtttttacgttaaccgtttggtacgttaacggtcctaaacggtttactaccggtaacttaaccggttaccggtcccgtttacccgggtacgggttaccggtttaccgggaacccggtaaacggggaacccgtaacggggtaccggtaaccgtaaccgtaaaacggtacggttaccggtacgggaccgttcgacccgtaacccgtagttccgttacggtttccttaccgtacccgttaaccccg

SEQ ID NO: 98853 - DNA, 726 bp, Homo sapiens
  misc_feature: GYAE6OF02JWE2D.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgccgagggccagtcgaggggatcgagcagctaagtttcgcctaggtaccaacagaacgcctgccgaggttccccagacctcctcaatactatcgaacgtcctccgttccgaacgggccctaacggttcgggaccgttccccgacgtaccgagggtttccgaacggccggggtccgggttcgggggtaccgttacgggggaaacctacggtaaaccctttcgtaaccttcccgtaccaaccctacgttccgagaccgtaacggtcccgtacgccgtacggtccgttaggaccggttaccgtttagggtaacgtttttacgttacgtcgttactacggctaacgttactacggtaacttaacgtcccggtaccgttaccggttacgggtaccggtttccggaaccggtaaacgggtaaccggtaacggtacggtaccgtaaccgtaaccggtaacgttcgggtacgtacgtcgacgtacccgtagtcccgttagtccttccaccgtttaccccg

SEQ ID NO: 98854 - DNA, 569 bp, Homo sapiens
  misc_feature: GYAE6OF02GDMH7.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggacgtcccagcctaggttcaggccggcggtgggtcgtgggacagacttcactctcaccatcagcacgcctgcagtctaggacggtaccttggtagttttacttacgtgtacgagctagtatctaagtacgtggcccttccggtaggtccgttcggacccgtaacggggacctaagggtcggaccgtaacgaaacggtaacctgggtacggtacgtcggacctaccgtactactcgttaccttcgtacccg

SEQ ID NO: 98855 - DNA, 533 bp, Homo sapiens
  misc_feature: GYAE6OF02FM8F7.10.37.D04.1.454.CMB.1.raw
  modified_base (395)..(395): a, c, t, g, unknown or other
  misc_feature (395)..(395): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatcgcgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtactcccagccaggttcagtggcaggtgggtctgggacaggagtcgctctcacatcagcagtctgctagtctgaagtntttgctagtttatacttgtcagtatatgtatggctggtcctaccgtactacgtttcggaccgtaacgggaccgtaggttcggactaacgtacgaaacggtacgtagtcggtcgtcgaccgtacctagttctgttaccg

SEQ ID NO: 98856 - DNA, 769 bp, Homo sapiens
  misc_feature: GYAE6OF02IU0XV.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccacctgtctgtgactcgaggtgagagacgccaccctctcttgcgacgggccagtcgaggggatcgagcgagacaatttacgcctcggtaaccaacgaggaacgccgtcggaccctacggttcccagacctcctcaatatatacggaacgtcctccgttccgacgggtccctacgtcggacgtcccaggccgaggttcgacggcgggtccggggttggggtccggtacggggaaccgtacggtaccgtttccaacccgttcctacccgaaccgtacttaccgaacggtccacgtccccgtcggtaccggtacggttaccggttacgggtaacgggtacccggtttaagggttacgttttaacgttaccgttggttaccgtacggttaccgtaagttacttaccgtacgttaaaccggtccgggttacccgttccggggttaaccggttaccggtttaccgggaaccgggtaaaccgggtaaaccgggtaacgggtaaccgtacccgttaacggaaaacccggttaacgttacggtacggtacgttacgaccgtaaccgttacggttccttacggttaccttacctaccgtttccccg

SEQ ID NO: 98857 - DNA, 654 bp, Homo sapiens
  misc_feature: GYAE6OF02HA4TX.10.37.D04.1.454.CMB.1.raw
  modified_base (629)..(629): a, c, t, g, unknown or other
  misc_feature (629)..(629): n is a, c, g, or t
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagcccaccctgtctgtcgactccgaggtgagagagccaccctctcttgcagggccagtcgaggggatcagcagctaagttcgcctggtaaccaacagaagccgtggaccctaggttccccagacccttcctctaactatagtcggaactcccttcttaccgagggtaccctagtcggacgtccccaaggccgtaaggttccgaggtccgggtcgggttcggggtcgtcggggactacggtaccttcgaccttcgtaccgacctatccgacgcgacgtcctagcgtacgtgtacggaacggtaccgttaggtagttttacttacgttagtactacgggtactaggtactacgtaagttaaccgtcggtaccctccgggtacggtaaccgttcggaaccgaacgggtacgaacgggtcgaaccgtaacgtaacggtaccgtcggttacgcgtacgacnccgtagttccgtcttcctatacccg

SEQ ID NO: 98858 - DNA, 679 bp, Homo sapiens
  misc_feature: GYAE6OF02JZEDH.10.37.D04.1.454.CMB.1.raw
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccacctgtctgtgactccaggtgagagagccaccctctcttgcagggccagtcaggggatcgagcagcaatttagcctggtaccaacagaagcctggaccnggttacccagtactccctanactaagtactagaacgcctccttccgaacgggccacgtggaacgtcccagaccgtaggttacctaggccgggcgggttagggtcgtacggggtacaacggtaccttcacgtccgtaccgaaccgtactaccgacgtacgaccggtcctacgcgtaacgttcgtacgggacggttaacccggtttgggtaacttttaccgttacgttcgttaccgagtactaggttacacttaagtaaccgttaccggtccttaccgggggtctacgggtttccgaacccggtacgggaaaccggacgttacgggaccctaacggtaaaccggtctacggtttcggacgttacgtcccgacggtattcccggttattccgtaccttcgttaaccccg

SEQ ID NO: 98859 - DNA, 753 bp, Homo sapiens
  misc_feature: GYAE6OF02H4ZGZ.10.37.D04.1.454.CMB.1.raw
tcagcatagtagtgcacgaccggtgctcgatttagtagcatactgttgggtttggggaggaactgctcagttaggacccagacggaaccatggaagccccagcgcagcttctcttcctcctgctactctggctccagattccactggagaaattagttttgacgcaatctccagcccaccctgtctgtcgactccgaggtgagagacgccacctctctgcgacgggccagtcgagggatcagcagctaatttacgccgtacggtaaccaacgtaagaacggcctcggaccgtacggttaccccaacgtaccttacccgtactacttatacgtacggtaaacgtcccgtttaccgttccgaacgggtccctaacggttcgggaaccgttccccgacggtacccgtagggttaccgacggccgggttaccgggtgggtaccgtacggggtaccaacggttaccgttccgaaccttcgtaccctaaccgtacgtaccgtacggcctaccggtacccgtcggtccgtacgttcgtaggtaaccggttaccgtttagggttaacttttaacgttcgttgtacgtagtaccgtatttaccgacttaacggtaaccgtccggtaccgttccgtacgggtaccgttaccgggacgtaacggtaaccggtaggtaccggtaccgtaacccgtaaggtaaccgttacggtacgttacgaccgtaaccgtccgtacgtttaccggttcgtaccgtccgttaacc

SEQ ID NO: 98860 - DNA, 855 bp, Homo sapiens
  misc_feature: GYAE6OF02GPSTL.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagacgccaccctctcttcgacgacgggccaggtcgaggggatcgagcagactaagtttacgccgtaggtaacccaagacggaaacgccccgttagggacccctaacggggtttcccccaaggtacccttcccgttacctaagttaacgttacgtacggtaaaccgtcccctttaccgttacccggtaaccggggtccctaacggttacgggacccgttaccccgacgggtaccctacgggtttaccgacggtcccggggtcggggttacggggttccgtacgggggaacctaacgggttaccgttacctaacccgtttccgttacccaaccgttaacgttacccgaacgcccgtacgtacccgttacgacccgtaggttacccggtaaggtaacccgggtttaccggttaacgggtttaacgggtttttaaacttccggtacgttacggtaaccgtaccgttaaggttacctacgtaaacgttaaccggttccggtaaccccgtttccgggtacggttaacccgggtttaccggaccggtaaacgggaaccgtacgggttaccggtaaccgtaacggtaaaacccggtacgttgggtaaccgtcggtacgtaccgtaacccgttgtttaccgtcgttacgttacccgttacccg

SEQ ID NO: 98861 - DNA, 784 bp, Homo sapiens
  misc_feature: GYAE6OF02HLAGB.10.37.D04.1.454.CMB.1.raw
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagtaaattagttttgacgcaatctccagccaccctgtctgtcgactccgaggtgagagacgccacctctcttgcagggccagtcgagggatcagcagactaatttacgcctaggtaaccaacgaggaacgccgtaggccgtacggttccccaagtaccctcctacaattactaacgtgaaacgtccccttaccgttaccggacgggtacccctacgtacgggaccgttaccccgtaacggacccgttacgggttaccacggggtaccgggtcgggggttcgggggtaccgttacggggaaccttaacgggtaacccttttacgaacccgtttccgtacccgtaaccctaggtccaacggtacctaccgtcccgtaggtaccgtaggttccgtagggtaaccgggttaccgtttacgggttaacggttttaactttacgttacggttacgacgtacgtaacgtaacttacgtaacgttaaccggttcgtacccgttccggtacggttacccggttacgggaacccggtaaacgggtaaccggtaacgggtaccggaccgtaaccgtaaaccggtacggtacggtcgtaccgtagtacccgtaactcgtaccgttccgtacccgttcgtacccttcccgg

SEQ ID NO: 98862 - DNA, 790 bp, Homo sapiens
  misc_feature: GYAE6OF02HDB8H.10.37.D04.1.454.CMB.1.raw
  modified_base (203)..(203): a, c, t, g, unknown or other
  misc_feature (203)..(203): n is a, c, g, or t
tcagcatagtagtgcacgaccggtgctcgatttagtagcatactgttgggtttgggggaactgctcagttaggacccagacggaaccatggaagccccagcgcagcttctcttcctcctgctactctggctcccagattccactggagaaatagttttgacgcaatctccagccaccctgtctgtgactccaggtgagagacnccacctctcttgacaggcagtcagggatcagacagactaatttacgaccgtaggtaaccaaacaaggaacgtaccgtacggaccctaacgggttaccccaacggaccctacccgtaccaagttaagtagtacgtaacggtccctaccgttacccgaacggggtccctaacgtacgggaaccgttaccccgaacggtaccccgtaaggtttaccgacgggtccgggtaccggggttacggggtccgttacgggggaacgtacgttaacgtcctacgttcctaccacccgtataccgagaccgtaacgcccgtacgaccgtacgttaccgtacggtaacggtaccgttagggttaacgttttacttacgttacgtacgtagtacgtaggttaactacgtaacgtaaccgtacggaccctttaccgggtaccggttaaccgggttaccggtaaccgggaaacgggttaaacccggacgggttaaccgtaaccgttaacgtaaaccgtaacgggttaacggtaccggagttaacccggaccggtaacccgtaacgttcggttacctttccggtacttcccgttaaccccgg

SEQ ID NO: 98863 - DNA, 659 bp, Homo sapiens
  misc_feature: GYAE6OF02I669V.10.37.D04.1.454.CMB.1.raw
  modified_base (206)..(206): a, c, t, g, unknown or other
  misc_feature (206)..(206): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
tcagcatagtagtgcacgaccggtgctcgatttagtagcatactgttgggtttgggggaggaactgctcagttaggacccagacggaaccatggaatccccagcgcagcttctcttcctcctgctactctggctcccagattccactggagaaatagttttgacgcaatctccagccaccctgtctgtgacctccaggtgagaganccaccctctcttgcagggccagtcgaggggatcagcaggacaatttacgctgtaaccaacaagaacgcctggcctaaggttcccagtacctacctacgaatatatgaacgtcctcttaccgaggccctacgtggactcccagcctaggtcaaggcggcggtgggtccgtagggactagacttcgatccacacgtnctagcagcctagcagtntacggacgtacgttaggtagttttagtacgtacgtcgagaacgtagtaatacttaagttaaaccgtccggtaccgttaccggttcgggtaaccgttacgggtaacccggtaaacggggaaccgggtaacgggtaccgtaacccggtaaccggtaaaaccggtaacgttacgggttacggacccgtttaaggacccgtaaccgtaacgtttcccgtaacggttttacccgttacttaacccg

SEQ ID NO: 98864 - DNA, 778 bp, Homo sapiens
  misc_feature: GYAE6OF02IWMPW.10.37.D04.1.454.CMB.1.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (739)..(739): a, c, t, g, unknown or other
  misc_feature (739)..(739): n is a, c, g, or t
  modified_base (762)..(762): a, c, t, g, unknown or other
  misc_feature (762)..(762): n is a, c, g, or t
tcagcatagtagtgcacgaccggtgctcgatttagtagcatactggttgggtttgggggaggaactgctcagttaggacccagacggaaccatggaagccccagcgcagcttctcttcctcctgctactctggctccagattccacgtggagaaattgttttgacgacaatctccacgccacccttgtctggtanactccgaggtgagagcgccncctctctgcgacggccagtcgaggggactcgagcagacttagttacgccgttaggaaccagaacgaacgccgtcggtacctacgggtacccaacgtccgtcctataagttactagtacgaacgttcctccgttaccgacgggaccctcgtacgggtaccgttaccgacggtaccctagggtccgacgggcccggggtggggttcgggtacggtcgggggtaaccacgggtttaacccttccggtacctttacccgtacctaacccgaacgttaccggacgtaacgccggttaaccctcggggaaccctcgggttaccgtaacgggtaacgttccgggttttaaaggtttaaccggttttaacgtttacccggttaggtaccgtaacgggtcccttaagtaaccgtttacgtaaacgttccgtacgggttcccttacgggtaaccgggtccgtacggtaaacccgacggggtaacgtacccgggtacgtaactaaccggtaaacggtcgtacggtcgtaccgtancccgttaacgtcgttaccggttnttaccggtcttaaccg

SEQ ID NO: 98865 - DNA, 821 bp, Homo sapiens
  misc_feature: GYAE6OF02GSDE5.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctcggcctcccagtacttccacgtggaagtaaattagtttttggaaccgactaaactcctcccacgccctaccctcgttctggtcgacctccgaggtgaaggagacgcccaccctcgtcttgaccgacgggtccaggtcgaggggactcgacgacgacgtactaagtttacgcccgtacgggtaacccaaacgaaggaacgtccgtcggccgtaccggttaccccgtaacgtacccgttaccctaccgtaattaacgtacgtacgaacgttccccttccgttacccggaccgggtacctaccggtacgggtaccgtaccccggacgtaccgtacgggttccgaacggtcgggtcggggttacgggtccgtaggggtactacggttaccgttaccgtactacccggtacctaaccgtcgtacgaaccgtcgaaccgtccgtacggtacgtacggtacgtacggtaccggtaccgggtttaaggttaccgttttagtttaccgtcgttaaggtcgtacgttattaaaccgtcgttaaccgtttaccgtccggtaccggtttcccggttacgggttaaccgttaccgggaacccggaacggggttaaccgacgggtaccggtaactaacccggtaacgttacggtcgtcgggaaccttcgaccgtacgttcgttccgtacttaccgtcgttacccg

SEQ ID NO: 98866 - DNA, 724 bp, Homo sapiens
  misc_feature: GYAE6OF02JEYH8.10.37.D04.1.454.CMB.1.raw
  modified_base (487)..(487): a, c, t, g, unknown or other
  misc_feature (487)..(487): n is a, c, g, or t
  modified_base (505)..(505): a, c, t, g, unknown or other
  misc_feature (505)..(505): n is a, c, g, or t
tcagcatagtagtgcacgaccggtgctcgatttagtagcatactgtgggtttggggaactgctcagtagaccagacggaaccatggaagccccagcgcagcttctcttcctcctgctactctggctcccagattccactcggagaaatacggttttgaccgtcaatctccagccaccctgtctgtgactccgaggtcagtacgacggcccaccctacttcgttgaccgacggggcccaggtaccgacgggggactcgaacgtactagtactaagtttaccgccgttacggtaaccaacgtagaacgtccgtcggtaccacggttccccaagtaccctcctactaacttactagtacgaaccgtccttacgttacccggaacgggcctacggtacgggtaccgttacccaggtccccgtaggttaccacggccgggtacgggtggggttccgagggacctacgtacttcggacttaccgcaaccggtntcgaagcgaactccggtnacgtactacggtagtaccgtacgttacggttatttacgtacgttgtaccagtacaagtactccaagtacggttacggaccccttcgggtaccggtacgggttaccgaaccggtaacggtaaccgtaagggttaccggaccttaacgaaaccggtacggttacggtacgtccgagtacccgaccgtacgtaccttaccggtctaccctacggttaccccg

SEQ ID NO: 98867 - DNA, 752 bp, Homo sapiens
  misc_feature: GYAE6OF02INSIS.10.37.D04.1.454.CMB.1.raw
tcagcatagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagacgcccaccctctcttgcacgggccaggtcgaggggatcgagcagctaagtttacgccgtacggtaaccaacgagaacgtccgtggtactacggttcccaagacctacctctataatagtacgagtcccttccttaccgaccggtacctacgtacggaccgtaccccgacgtccgtaaggttccaggtccgggcggggttcggtcggtagggacgagtaccttcgacccgttcctaccgtaccctatccgacgtaccgaacgtcccgtggaacccttaggtacgtacgggtaaccggtacccgtttagggtttaacgtttttaaccgttacgttacggtactaccggtacgttaagtaccttaacgtaaccgtttaacggtaccggtccccgtttacgggtacgggttacccgttaccggggaaacccggaaccggggttaaccgaaggggttcccgtaaaccgtaaccccggaaagtaaccggttcggaccggttacccgtaacgtccctaaccgttactccgggtttaccttccgtacgttaccccg

SEQ ID NO: 98868 - DNA, 870 bp, Homo sapiens
  misc_feature: GYAE6OF02JOSR0.10.37.D04.1.454.CMB.1.raw
  modified_base (522)..(522): a, c, t, g, unknown or other
  misc_feature (522)..(522): n is a, c, g, or t
  modified_base (613)..(613): a, c, t, g, unknown or other
  misc_feature (613)..(613): n is a, c, g, or t
  modified_base (689)..(689): a, c, t, g, unknown or other
  misc_feature (689)..(689): n is a, c, g, or t
tcagcatagtagtgcacgaccggtgctcgatttagtagcatactgttgggtttggggaggaactgctcagttaggacccagacggaaccactggaagccccagcgcagcttctcttctcctgctactctcggctcccagacgttccctacgcggtaggtaaatagtttttcggaccgcctaatccgtcccagcccgtacccctgtctcgtgtacctaccgacggttacgacgacgtacgccgaccccttcctccggttgacccgacgggggtacctaacgttccggaacgggggtacctaccgacggttccgacggtacctaacggtttccggacccttacggtaaaccgtaaccgtacgtaacgtaccccggtagtaacccgtcgggttacccgacttaccgtacccttcacgttaaacttcggacgtaacccgtgttaccgttacccggagggtaccctaccggtacggtaacccgttccggaaccgttcccgtaacggttccgcgggtttaaccccggnggggtttacccggggttaacttccggggtaaaccgtaacgggtaccctttcggtaaccctacgggttccccaaacccggtaaccgtttccncgacccgtaacgttccggtcggttacaacggtttccacggtacggtaccttacgggttactttaacgttcccggtntaccgtatttgacggtactaccgtaattaacccgcggttccgtaacggtccggttaacgttcccggaacggttacgaaacgggtacgtccggaacccgtaacgtaaccggccgtttaacggttccgaacggtcgaaccggttacccgttaggtcctttaaccgggcgttccttaacccggg

SEQ ID NO: 98869 - DNA, 496 bp, Homo sapiens
  misc_feature: GYAE6OF01B6FJQ.12.31.C09.1.454.CMB.1.raw
  modified_base (329)..(329): a, c, t, g, unknown or other
  misc_feature (329)..(329): n is a, c, g, or t
  modified_base (367)..(367): a, c, t, g, unknown or other
  misc_feature (367)..(367): n is a, c, g, or t
  modified_base (492)..(492): a, c, t, g, unknown or other
  misc_feature (492)..(492): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaatggtatcaacaaaagcaggcaaagtcccaaagctcctgatttatgctgccaccagtctgcaaggtggtcccgtnaaggttcactggccgtggatcagggacagtaatttacnctcacatcagtagtctacagcctgaagatattgcttacttattactgtcagcagacgttaccgcgtctcccatcactttcggccaaggccacgaccgcagattggacgaactgtcggctgcaccngttc

SEQ ID NO: 98870 - DNA, 488 bp, Homo sapiens
  misc_feature: GYAE6OF01DKQ6L.12.31.C09.1.454.CMB.1.raw
  modified_base (389)..(389): a, c, t, g, unknown or other
  misc_feature (389)..(389): n is a, c, g, or t
  modified_base (485)..(485): a, c, t, g, unknown or other
  misc_feature (485)..(485): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagcagacagagtcaccatcacttgccgggcaagtcagaccatcagcagctatttaaatgtatcagcagaaccagggaagcccctaaggtcctgatctatgctgcatccagtttgcaaagtgggtcccatcaaggtcagtgcagtggtctgggacagattcactctcaccatcagcagtctgcaactgaagnttctgactaacttattactgtacaactagtagtaaactcgttaccctcccgtacgtttcggacggagggaccagggtgagactacaaacgatgtgntcg

SEQ ID NO: 98871 - DNA, 504 bp, Homo sapiens
  misc_feature: GYAE6OF01ATV14.12.31.C09.1.454.CMB.1.raw
  modified_base (300)..(300): a, c, t, g, unknown or other
  misc_feature (300)..(300): n is a, c, g, or t
  modified_base (368)..(368): a, c, t, g, unknown or other
  misc_feature (368)..(368): n is a, c, g, or t
  modified_base (501)..(501): a, c, t, g, unknown or other
  misc_feature (501)..(501): n is a, c, g, or t
tcagatacgacgtacacgaccggtgctcgatttagacgtctcatcaaggaaggaaggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttangctgccaccagtctgcaaggtggttcccgtcaaggttcactggccgtggatcgagggacagaatttcnctcaccatcagtagtctacagcctgaagatattgctactttattactgtcagcaagtagttaccgcgtctcccatcacctttcggccaagggccacgaccgcagattcggactaactggtggctagcctacgntcg

SEQ ID NO: 98872 - DNA, 624 bp, Homo sapiens
  misc_feature: GYAE6OF01BRN56.12.31.C09.1.454.CMB.1.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (574)..(574): a, c, t, g, unknown or other
  misc_feature (574)..(574): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagganacaaagtcacatcacttgccggntaacgagagtatgcctaacgttatttaaatggtatacaaacaaaagcaggacaaagtcccaaagctcctagtatttangactgaccaccagtcctgacgtaagggttcgggttaccccgtacgaaacgggtttcaacgttcgggcccgttaggactcgaaggggacaaggtaaacttttactaccgtacaaccctatacgagttagtacctaactacggtaccttaggaaactattacgttacgtacctttactttaattacctggttacaacgtcgtaagtaccgttaacccgcgtacccttaccctattcccgtactttaccggaccgaagggtacccacgaccgnaaggacttacgggaactaacgtggtcggacctaggacctaccctgttccg

SEQ ID NO: 98873 - DNA, 499 bp, Homo sapiens
  misc_feature: GYAE6OF01BG30G.12.31.C09.1.454.CMB.1.raw
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtggttccgtnaaggttcactggccgtggatcagggacagaatttacnctacaccatcagtagtctacagcctagaagatattgacttactttattactgtcagcagtagttaccgcgtctccatcactttcggccaaggacacgaccgcagattcggacgaactgtcggctgcnccntc

SEQ ID NO: 98874 - DNA, 648 bp, Homo sapiens
  misc_feature: GYAE6OF01BS81U.12.31.C09.1.454.CMB.1.raw
  modified_base (641)..(641): a, c, t, g, unknown or other
  misc_feature (641)..(641): n is a, c, g, or t
tcagatacgacgtacacgaccggtgctcgatttagacgtctcatcaaggaaggaagggggcaggagtcagtctcagtcaggtcacagcatggacatgagggtcccccgctcagctccgtggggctcctgctactctggctccggaggtgccagatgtgacatccagctgacccagtcctccatccctcctgtctgcatctgtaggagacaaagtcaccatcacgttcgccgggactaacgagagttattcgacctaacgttaatttaaattggtaatacaaaacaaaaagcaaggacaaacgtacccaaagtcctacctagtatttatcgctcgaccacagtctgacgtaggtcggttcccgtagtaacggttcacgtcggcgtggactcgaagggtactaaggttaactttactcctaccgacctagtacgtaagttacgtaccttaacggacgtaccgtaaggaaattagttaactttcgaaccttttaactttattacgtacgtacagtacgtaacgtaccgttacccgcgtacccctaccctagtccctacggttcccggaacgtaaaccgggaccctaaccggaccgacgtaaggttacgtaccggaacgtaccgttggtcgactcgacctacgtnttacccg

SEQ ID NO: 98875 - DNA, 531 bp, Homo sapiens
  misc_feature: GYAE6OF01CXR1F.12.31.C09.1.454.CMB.1.raw
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgngagtattgccacgttatttaaattggtatcaacaaaaagcaaggcaaagtcccaaagctcctgatttatgctgccaccagtctgcaaggtcggttcccgtnaaggttcactggccgtggatcgagggacagaatttcnctcaccatcagtagtctacagcctagaagattatgcttacttattactgtcagcagtacgttaccgcgtcctcccatcctactttcggacctaacgggaccaccggaccgacagtaacgttgggaccgtaacgtggtacgggctggacccactagtccg

SEQ ID NO: 98876 - DNA, 553 bp, Homo sapiens
  misc_feature: GYAE6OF01CE38A.12.31.C09.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
  modified_base (546)..(546): a, c, t, g, unknown or other
  misc_feature (546)..(546): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagganacaaagtcacatcacttgccgggactaacgagagtattgaccagttatttaaatggtaatacaaacaaaagcaggacaaagtcccaaagctcctgatttangctgccaccagtctgacaaggtgggttaccctagaacggttcacgtcggccgtggatcgagggacagtaatttcgctacaccatcagtagtctacagtcctagaaagtntattgtactacttatactgtcagcaagacgttaccgcgtcctccattcctacgttccggaccgtaacgggaccaccgtaccgacgaagtacgttcggaacgtaacgttggtcggtactccggacctaaccgtnttacccg

SEQ ID NO: 98877 - DNA, 488 bp, Homo sapiens
  misc_feature: GYAE6OF01BR2TM.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagcagacagagtcaccatcacttgccgggcaagtcagaccatcagcagctatttaaattggtatcagcagaaaccagggaaagttccacacctcctgatctatgctgcatccgctttgcaatcaggggtcccatctcggttcagcggcagtggatcgtgggacagagttcactctcaccatcagcagcctgcagcctgaagatgttgctaacttattactgtacaaagtataacagtcgcccccttcacccgttcggaccaagggaccacggactggatagtagtaaccg

SEQ ID NO: 98878 - DNA, 544 bp, Homo sapiens
  misc_feature: GYAE6OF01B2FNZ.12.31.C09.1.454.CMB.1.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (378)..(378): a, c, t, g, unknown or other
  misc_feature (378)..(378): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatacaaacaaaaagcaggacaaagtcccaaagcctcctgatttangctgccaccagtctgcaaggtcggttcccgtnaaggttcacgtggccgtggatcgagggacagtaactttacnctcaccatcagtagtctacagcctgaagtattattgtacttacttattactgtcagcaagtacgttacccgcgtcctccctatcctacctttcggacctaagggtaccaaccggaccgctaagacgttggaccgtaacgtggtcggctaggccctaccgtgttccg

SEQ ID NO: 98879 - DNA, 505 bp, Homo sapiens
  misc_feature: GYAE6OF01BE2ZI.12.31.C09.1.454.CMB.1.raw
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccagtatttaaatggtatcaaacaaaagcaggcaaagtcccaaagctcctgatttangctgccaccagtctgcaagggtcgggttcccgtnaaggttcacgtggccgtggactcgaagggacagtaactttacnctcaccatcagtagtctacagtcctagaagatattgacttactttattactgtcagcagtattaccgctcctccatctacttcggaccaggacacgacgcagagttggacgtacgtgtcgctgcncntc

SEQ ID NO: 98880 - DNA, 857 bp, Homo sapiens
  misc_feature: GYAE6OF01AVIW8.12.31.C09.1.454.CMB.1.raw
  modified_base (165)..(165): a, c, t, g, unknown or other
  misc_feature (165)..(165): n is a, c, g, or t
  modified_base (170)..(170): a, c, t, g, unknown or other
  misc_feature (170)..(170): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (189)..(190): a, c, t, g, unknown or other
  misc_feature (189)..(190): n is a, c, g, or t
  modified_base (852)..(852): a, c, t, g, unknown or other
  misc_feature (852)..(852): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagcncaccnctccncnctccctctctcnnctactcgtaggtaggaacaaacgtaacgtaccaactactacctacgttccgggcccggtaacgtaaacggaaggtacgttagtccgaacccgttaagttttaaaattttaaggttagtactaaaccaaaaaagaaacgcgacgtaaactaaaccccgaaccgaacgttccttacgtagtttaaactttggccgtacgtacccgacccctaacgtacgttccggtacggaaacggggtttaaccgggggttttccccgggttacccgtaaacggtttaaccggttacccgttaacggggtcccgggtacgggtaacggtaacctacgggggaaacgtaacgtaaagtttttaacctttccgtacccgtaacccaaaccgttcgttaaccggttaaacgggtttacccttaaccgtaaccggacccgttaacggtaaaggtaaacgttttattttacgtacccgttaacttttaaaccttttaacgttcgtacgtacgaaccggtaacgtaacgggttacccccggttacgccccttacccgtaacctacgttaccgttacccgggtaccggaaacggaaccggtaccctaccggaccgtaggtaaggttacggtaccggaacccgttaggttcgggtaccgtcacccgaaccctaacggtttntccgg

SEQ ID NO: 98881 - DNA, 673 bp, Homo sapiens
  misc_feature: GYAE6OF01DKWWB.12.31.C09.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (337)..(337): a, c, t, g, unknown or other
  misc_feature (337)..(337): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaganacaaagtcacatcacttcggccgggactaaacggngattagttcgacctaacgttaattttaaagttggtaataccaaaacaaaaagcgaaggacaaaacgtaccccaaaagtccctaccgttagtaacttttancggcttacgacccctacctaagtctacgacgtaagggttcggtttacccgtacgtaacggttccacgtcggtaccgtaggactacgaaggggactaggttaaactttactcctactaactagtacgaggttacgtactaacgacgtacctaaggaagtattattacgtactttaactttacttacgttcgtacagacgtaacgtaacgttaccccgcgtaccctaccctaattcccgtacgttacccggaacgaaccgggacctaccgaccggtactaaggtacggttaccggaaccgtaagttcgggtacggacttacgacctcctagtttcccg

SEQ ID NO: 98882 - DNA, 584 bp, Homo sapiens
  misc_feature: GYAE6OF01D9DCL.12.31.C09.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
tcagatacgacgtacacgaccggtgctcgatttagacgtctcatcaaggaaggaagggggcaggagtcagtctcagtcaggtcacagcatggacatgtgggtccccgctcagctcctggggctcctgctactctggctccgaggtgccagatgtgacatccagctgacccagtctccatcctccctgtctgcatctgtaganacaaagtcaccatcacttgccgggntaacgagagtattcgcctacgttattttaaatggtaatacaaacaaaagcaaggacaaagtcccaaagctcctgatttangctcgcctaccagtctgacgtaaggttcgggtaccctgaaggttcacgtcggcgtggaatcgaagggtacagtaactttacnctacaccgtaatcgtaagtacgtactaacacgtccgtaggaaatacttagtgtacttactttattaccgtgttacagtacagtacgttaccgcgtacctacccattcctacgttccggaccgtaacgggaccaccggaccgcaagttagttacggaacgtaacgttggtacggacctacgaccctacgtcttacg

SEQ ID NO: 98883 - DNA, 849 bp, Homo sapiens
  misc_feature: GYAE6OF01CY4ZR.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctcctgtctgcatctgtagagacaaagtcacatcacttggccggactaacgagagtattcgacctacgttaatttaaagttggtaatacaaaacaaaaagcaaggacaaaacgtaccccaaaagtcctaccttagtaattttatcgcctcgaccctaacctaggtcctaggaccggaaagggttcgggttaccccgtacgtaaacgggtttcccgaacgttcgggacccggttagggtaacgttaccggaagggggtaacctaaagggttaaacttttaccgtacttaccgaacctacgttaccgtaaggttacgttacccgtaacgtacggtacccttaagggtaaacgttactttaacgtttacggtacccttttaaaccgttttaagtttacccgttaggttaccgaacggttaccgtaaacgggtttaacccggtttaccccggtacccgttacccttaacccccccgttaaggttacccccgtttaacccggttttaccccggggaaacccggtaaaacccgggggtaccccgtaaaacccgggtaccccgggtaacgtaaacgggttaacccgggtttaaccggggaaacccgggttaaaccgtttcggggtaaccgggttacccgttacgggtaccccctaaaccgttcgttttaaccccgg

SEQ ID NO: 98884 - DNA, 785 bp, Homo sapiens
  misc_feature: GYAE6OF01BHKJH.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctctgaggtgccagatgtgacatccagctgacccagtctccatcctccctgtctgcatctgtaggagacaaagtcaccatcacttgccggctaacgagagtatgccacgtatttaaatggtatcaaacaaaagcaaggacaaacgtcccaaaagctcctagactttatgctcgaccacagtctagacgtaagggttcggttacccgtacgaaacgggttcaacgttcgggcccggttagggaattccggaaggggtactaaacggtaaacgttttactaccgttaccaacctacttacgtaacggttaacgttacctaacgtaacgtacccgttaaggaaacggtaagtttaaccgtttaagttccctttaaacgtttttaccttttaaaccgtttcggtaaccgttaacggcccgttaaaacggtaaccggttttaacccccggggacccgtaccccgttttaaccccctaacgtttacccgttaacccggtttttaccccggggaaaccccgttaaaacggggggaacccctaaaccccggggtaaacccggacccgttaaacgggtaccgtttaaccgggggaaacccggttaaaaccgtttcggggttacgggtaccttaccgggtaaccctaaccccgttaacg

SEQ ID NO: 98885 - DNA, 658 bp, Homo sapiens
  misc_feature: GYAE6OF01CQRKN.12.31.C09.1.454.CMB.1.raw
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagatgacccagtctccatcctccctgtctgcatctgtagcagacagagtcaccatcacttgccggnaagtcagaccatcagcagctatttaatgtatnagcagaaaccaggaacnccctaaggtcctgatctatgctgctatcctagtttcgacgtaaaggtcggggtacccagtacgtaaggttcaaggtggcgtaggtgggtcgtaggggtacaggtactttcgaccttctaccaaccctaacttcgaagtcctaacgttccgttacgaccctaaacccgttaggtaaacgtaactttaccgtaggtaacccttaaacgttttaactttaccgttaggttaactaaaccgtaacgtacgttaaaacctaccggttttaaccccttccccgttaaccggttttaccgggaccggggtaacggggtaaacccggaaaggggttacgggaaacgtaacgtaaccgaaaacggtaaccgttacggtcggtcgtaaccgg

SEQ ID NO: 98886 - DNA, 580 bp, Homo sapiens
  misc_feature: GYAE6OF01ERKIE.12.31.C09.1.454.CMB.1.raw
  modified_base (227)..(227): a, c, t, g, unknown or other
  misc_feature (227)..(227): n is a, c, g, or t
  modified_base (280)..(280): a, c, t, g, unknown or other
  misc_feature (280)..(280): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccggnaagtcagaccatcagcagctatttaaatggtatcagcaagaaaccagggaaanccctaaggtcctgatctatgctgcatccagtttgactaaagtggggtacccagtcaaggtttcaaggtggctaggtgggtcgtgggacagtactttcacttctcaccatcagcagtctgactaaccgtgtaacgtattctagactaaactttattaacttacgtacaaacgtagtaacgtaacctaacgtttaccccaccgttaaccgtttaccgggacggtaaccggggtaaccctaagggtcgggaacgtaacgtaaccgaaaaccggtacttagggtacggacttcgcgtaaacccg

SEQ ID NO: 98887 - DNA, 553 bp, Homo sapiens
  misc_feature: GYAE6OF01E2W2W.12.31.C09.1.454.CMB.1.raw
  modified_base (550)..(550): a, c, t, g, unknown or other
  misc_feature (550)..(550): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagttattgcctaacgttatttaaattggtatacaaacaaaaagcaggacaaagtcccaaagcctcctgtatttatgctgccaccagtctgacgaacgggttcgggttcccgtacgtaaggttccacgtcggccgtggactcgagggacagtaatttacctctacacctatctagtacgtctacagacctagaagtatattgacttacttattactgtacagtcagtacgttaccgcgtcctcccattctaccgttcgaccgtaacggaccacgaccgcgagtacgtcggactacgtggtcgactagcctaccgtntcg

SEQ ID NO: 98888 - DNA, 599 bp, Homo sapiens
  misc_feature: GYAE6OF01DJP1B.12.31.C09.1.454.CMB.1.raw
  modified_base (321)..(321): a, c, t, g, unknown or other
  misc_feature (321)..(321): n is a, c, g, or t
  modified_base (458)..(458): a, c, t, g, unknown or other
  misc_feature (458)..(458): n is a, c, g, or t
  modified_base (550)..(550): a, c, t, g, unknown or other
  misc_feature (550)..(550): n is a, c, g, or t
  modified_base (585)..(585): a, c, t, g, unknown or other
  misc_feature (585)..(585): n is a, c, g, or t
  modified_base (594)..(594): a, c, t, g, unknown or other
  misc_feature (594)..(594): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggactaacgagagtattgccacgtatttaaattggtaatacaaacaaaaagcaaggacaaacgtcccaaaagcctcctgtatttatgctgccaacngtactgacgtaagggttcgggttaccccgtagtaacgggtttccaacggtcgggaccggtaggtaactcgaacggggacctaaggtaaactttacgtctaccacctatacagttacgtctaacgagcctagaaagtnttatgtacttattacttactgtcagctaagtacgttacccgcgtcctaccctatacctaccgttccgaccgtaacgggccgaccgacccganaagttagtacggaaccggtacgtggtcgaccgttnacctacctnttacg

SEQ ID NO: 98889 - DNA, 628 bp, Homo sapiens
  misc_feature: GYAE6OF01EE8T4.12.31.C09.1.454.CMB.1.raw
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctcctgtctgcatctgtaggagacaaagtcaccatcacttgccggctaacgngagtntgccacgtatttaaattggtatacaaacaaaagcaaggacaaagtcccaaagctacctagtatttagtgctcgccacctagttctgacgtaaggtcggttacccgtagtaacggttcaacgtggaccgtaggactcgagggtacaaggtaactttacgctacacctatactagtagtactaacacgtacctagaaacgtattattcgtacttaacgtttacttacgtagttacagtacgtaacgtaacggtttacccgccgtaccttaccctaacgtccgttaccgtttacccggaaccgtaaacgggtacccaaccggtacccggactaagggtacgtttacgggaaccgtaacgttggtacggtacctaggtacctaaccctgttcccg

SEQ ID NO: 98890 - DNA, 676 bp, Homo sapiens
  misc_feature: GYAE6OF01AR5MM.12.31.C09.1.454.CMB.1.raw
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatccacttggccgggataacggagagttattgccacgttatttaaatggtatacaaacaaaagcaggcaaagtcccaaagctctgtatttangctgccaccagtctgactaagggtcggttcccgtcaaggttcacgtggccgtggactcgagggacagtaatttccnctacacctatactaggtacgtactacgacgtaccctaggaacgtaattacgtttacgtacttaacgttttaattaccttaggttacaaggtactaacggttaaccggttacccggtcccgtacccttaccccgtacttacccgtaccgttttacccgggacccggtaaaacggggtacccaaccgggtaaccccggtcgtaaaggggttaacggtttaccgggggaaacccgttaaacggtttcggggtaccgggtacccgttaacggtccctaaaccccgtttagttccccgg

SEQ ID NO: 98891 - DNA, 601 bp, Homo sapiens
  misc_feature: GYAE6OF01CGQWD.12.31.C09.1.454.CMB.1.raw
  modified_base (329)..(329): a, c, t, g, unknown or other
  misc_feature (329)..(329): n is a, c, g, or t
  modified_base (415)..(415): a, c, t, g, unknown or other
  misc_feature (415)..(415): n is a, c, g, or t
  modified_base (445)..(445): a, c, t, g, unknown or other
  misc_feature (445)..(445): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaagtcaccatcacttcgccgggactaacgagagtattcgacctacgttaattttaaagttggtaataccaaaacaaaaaagccgaaggacaaaacggtacccaaaagtcctccgtagtatttangctacgacccactagtctaggacgtaagggttcggttcccgtgtaacggttcacgtggcgtaggatacgagggacagtaactttcnctacacatcagtactctacagtctagaatnttatcgtacttacttagttactgtacacgacgtaggtacgttaccgccgtaccctcccttatcccgttaccgttaccgggaccgtaaacggggacctaccggaccgtacgagtacgttcgggacgtacgtggtacggtctacggccaccgtgtccg

SEQ ID NO: 98892 - DNA, 531 bp, Homo sapiens
  misc_feature: GYAE6OF01CL4D8.12.31.C09.1.454.CMB.1.raw
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (386)..(386): a, c, t, g, unknown or other
  misc_feature (386)..(386): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (523)..(523): a, c, t, g, unknown or other
  misc_feature (523)..(523): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagatgacccagtctccatcctccctgtctgcatctgtagcagacagagtcaccatcacttgccgggnaagtcagaccatcagcagctatttaaatggtatcagcagaaaccagggaaancccctaaggtcctgatctatgctgcactcctagtttcgacaaaggtcggggtaccccagtcgaaggttcaggtcggactaggtgggtcgtgggactagtatttccnctctcacccatcagcagtctgaccaactgaatnttctcgctaacttnttaactgtaccaacgtagtactaacaccttacccaccctacgttcgggaccggtagggaccgaaggtggacgtatacgaaacgacgttgngtcgtacg

SEQ ID NO: 98893 - DNA, 547 bp, Homo sapiens
  misc_feature: GYAE6OF01A4AQP.12.31.C09.1.454.CMB.1.raw
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (387)..(387): a, c, t, g, unknown or other
  misc_feature (387)..(387): n is a, c, g, or t
  modified_base (543)..(543): a, c, t, g, unknown or other
  misc_feature (543)..(543): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgcctaacgttaattttaaattggtatacaaacaaaaagcaaggcaaaagtcccaaagctcctagatttangctgccaccngtctgcgaagggtcgggttccctataaggttcacgtggccgtggatcgaggggacagtaatttacnctacacctatcgagtacgtctaacagcctaagaagtattattgcttaacgtttattacgtgtccagcagtacgttacccgcgtcctccatcctacttcggaccaacggcaccgaccgcagtacgttggaaccacgttggtacggctgaccaccgtntccg

SEQ ID NO: 98894 - DNA, 579 bp, Homo sapiens
  misc_feature: GYAE6OF01BQLVJ.12.31.C09.1.454.CMB.1.raw
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatccctccctgtctgcatctggtaggagacaaagtcaccatccacttgccgggactaacgagagttattgccaacgttaatttaaatggtatacaaacaaaagcaggacaaagtcccaaagctctgatttangctgccacagtctgcgtaagggtcggttcccgtanaaggttcacgtggccgtggatcgaggacagtaactttcnctacacatcgatagtctacagtacctagaacgtattagttcgacttactttatacgtgtacacgtacagtaagttaccaacggtcctacgttccccagttacctaccgtttaccgggaccgtaacgggacctaaccggcccgagaggtaacttcgggaacctaacgttcgggacggtacctcgcgaacccgttacg

SEQ ID NO: 98895 - DNA, 703 bp, Homo sapiens
  misc_feature: GYAE6OF01D8G96.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagagacaaagtcaccatcacgttgccggactaacgagagtattgcctaacgtatttaaattggtaatacaaaacaaaaagcaaggacaaagttccccaaagcctcctagtatttatgctcgcctaccagtctagcgtaagggttcgggttacccgtacgtaacggttccacgtcgggaccgtggaactcggaacggggtacaggtaacttttacctctaccgaacctatactaggttaacgtctaacgagtcctagaaagtatttacgttagtaccttaacgttttatttaccgtgttacaggtacaacggttaacgttaccccggcgtacccttaccccgtaattacccgttaacccggttttaccggggaaccccgtaaaacgggggacccctaacccgggtaaccccggtacccgtaaagggttaacggtttaaccgggggaacctaaaccggtttgggtaccgggtaccttaccgggacccctaaacccgtgtttaccccg

SEQ ID NO: 98896 - DNA, 695 bp, Homo sapiens
  misc_feature: GYAE6OF01DJ10M.12.31.C09.1.454.CMB.1.raw
  modified_base (690)..(690): a, c, t, g, unknown or other
  misc_feature (690)..(690): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctcgacccagtcctccatcctccctgtctgcatctgtaggagacaagtcacatcacgttcggccgggactaaacggagtagttattcgacctaacgttaattttaaagttggtaactacaaaacaaaaagcaacggacaaaacgtaccccaaagtcctaccgtagtatttagcgcttcgaccctaaccgtagttccgtacgacgttaacggggttcccgggttcccggttaacgtaaacggggtttccaaccggttcgggtaccggttaggactaccggaaggggtaacctaaggttaaacttttaccgacttaccaacctataccgtaagttacgtactaacgacgtacctaaggtaagtacttattcgtactttaacttacttactgtacgagtacgtaacgtaccgttacccgccgtcctaccctacttaccgttaccggttccgggaaccgtaacgggaccctaacccggaccggtactaaggtacgttacggaaccgtagtggttcgactacgacctccgtnttccg

SEQ ID NO: 98897 - DNA, 731 bp, Homo sapiens
  misc_feature: GYAE6OF01BIAA5.12.31.C09.1.454.CMB.1.raw
  modified_base (201)..(201): a, c, t, g, unknown or other
  misc_feature (201)..(201): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctcctgtctgcatctgtaganacaaagtcaccatcacttcggccggactaacgagagttattgacctaacgttaatttaaattggtaatacaaaacaaaaagcaaggacaaacgtacccaaagcctacctagtactttagcgtactcgaccacgtagtctagacgtaagggttcggttacccgtagtaacggttccacgttcgggaccgtaggactacggaaggggtaactaaggttaaactttaccgaccgttaccaacctaattaccgtaacggttaacgttacctaaacgtacggtacccgttaagtaaacgttaactttacgttaccggttaacctttaaacgttttaacttacgttacggtacgtaacgtacgtaaacggttaaccggttacccgccggtaccccttacctaacgttacccgttaccggtttacccgggaaccgtaaaccgggaccgaaacccggtacccggtacgttaacgggtacgttaccgggaacgttacgggtcggttacggacccttacggacctaaccgtcgtttaccg

SEQ ID NO: 98898 - DNA, 539 bp, Homo sapiens
  misc_feature: GYAE6OF01CD9YI.12.31.C09.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgttatttaaattggtaatacaaacaaaaagcaggacaaagtcccaaagctctgatttangctgccacagtctgcaaggtggttccctnaaggttcacgtggccgtggatcgagggactagaatttcnctcacatcagtagtactacagtcctagaagtatattgtacttaactttattactgtcaagtctaagtacgttaccgcgtcctccctatcctacttcggacccaagggaccaccggaccgcaaggtattcgggaaccgtaagttcggtacggctagccaccgtgtcg

SEQ ID NO: 98899 - DNA, 632 bp, Homo sapiens
  misc_feature: GYAE6OF01A6JBC.12.31.C09.1.454.CMB.1.raw
  modified_base (204)..(204): a, c, t, g, unknown or other
  misc_feature (204)..(204): n is a, c, g, or t
  modified_base (476)..(476): a, c, t, g, unknown or other
  misc_feature (476)..(476): n is a, c, g, or t
  modified_base (596)..(596): a, c, t, g, unknown or other
  misc_feature (596)..(596): n is a, c, g, or t
  modified_base (623)..(623): a, c, t, g, unknown or other
  misc_feature (623)..(623): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctcgaggtgccagatgtgacatccagctgacccagtcctccatccctcctgtctgcatcgtgtagganaacaagtcaccatcacgttcggccggactaacgagtagttagttcgacctaacgttaattttaaaacgttggtaaactacgaaaaacgaaaaaggccgtaacggactaaaaacgtaccccgaaaaaggtcccttaccgttaggtaacttttaagtcggtccttacggaccccaacgtaggttctacggtacgtaacggggttccggttaccccgtagtaacggttcacgtcggtaccgtaggactcggaacgggactaagttaactttaccnctacactatacgtagttacgtactacgacgtactagaatacgtattcgtacttattacttactgtacagtacagtacgtccgctacctcctatcctacgtcggacgaacggcaccgaccngagtcgtacggacgtacgtgtcgacanccacgtgtc

SEQ ID NO: 98900 - DNA, 763 bp, Homo sapiens
  misc_feature: GYAE6OF01DKL12.12.31.C09.1.454.CMB.1.raw
  modified_base (343)..(343): a, c, t, g, unknown or other
  misc_feature (343)..(343): n is a, c, g, or t
tcagatacgacgtacacgaccggtgctcgatttagacgtctcatcaaggaaggaagggggcaggagtcagtctcagtcaggtcacagcatggacatgagggtccccgctcagcctccctggggctcctgctactctggctccgaggtgccagatgtgacatccagctgacccagtcctccatccctccctgtctgcatctgtaggagaacaaagtccaccatccacgttcggcccgggactaaacggagtagttattcgacctaacgtttaatttaaagttggtaactaaccaaaacaaaagtccaaggaccaaacgtacccaaagtcctacgtgtaatttancgactcgaccctactagttcctacggacgtaagggttccggttacccgtagtaaacgggttccacggttcgggtaccgtagggtaacgtcggaacggggtaacttaaaggttaaaccttttaccctaccgtaaccctaacctaacttaaccgtaacggttaaccgtacccgtaacgtaaccgtcccgttaaggtaaacgtatttaacgttacgttacctttaaccttttatttaccgttcgtacacggtacgtaacgttacggttaaccccgtcgtaccccttacctacgttaccgttacccgtttaccgggaacccgtaaacggggtacccgaaccggtaaccggtacgtaacggtaggttaaccggaacgttaaccggttcgggtacggtacgtaccgtaccctaccgttattcccgg

SEQ ID NO: 98901 - DNA, 901 bp, Homo sapiens
  misc_feature: GYAE6OF01BV3AS.12.31.C09.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagatacgacgtacacgaccggtgctcgatttagacgtctcatcaaggaaggaagggggcaggagtcagtctcagtcaggtcacagcatggacatgagggtccccactcagctcctggggctcctgctactctggctccggaggtgccagatgtgacatccagctgacccagtctccatcctccctgtctgcatctgtagganacaaagtcaccatctacgttcgaccgggtactaaacggngtagtagtcgacctaacgtttaatttaaagttggtaacttaaccaaaaacgaaaaacggtccgaagggtaacctaaaaaccgggttacccccaaaaaggtccctttacccgtaggtaaccgtttttagcggtaccttaccggaccctaacccgtaggttcctacggtaaccgtaaacggggttccgggttaccccgtaacgtaaacggggtttcccgaaaccgggttggtcccgggttaacggtaacgttaccggaaagggggtacctaaaacggttaacttttacctaccgtaccgtaacctacgttacgtaacgttaacggtacctaaccgtaacggtccgtttaaggaaacgttaacttacgtttaccggtaaccttttaaacctttaacggtttaaccgtacggttaacccgtacggtaacgttaaacccgggtaaccggtttaacccccggacccgttaaccccgtttacccgtaaccgttttaccccggtaacggttttaaccccggggaacccggtaaaccgggggtaaacccaaccccggggttaaccgaacccggttaagggttaaaccggttaccggggtaaaccgttaaacccgggtgggttaaaccgggtccctacggtaaccccgtaaccgttaacgttccccgg

SEQ ID NO: 98902 - DNA, 602 bp, Homo sapiens
  misc_feature: GYAE6OF01BD3F0.12.31.C09.1.454.CMB.1.raw
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacgttgccgggactaacgagagtattcgacctaacgttatttaaatggtaactacaaacaaaagcaggacaaacgtcccaaagcctactgatttangctcgccactgtctgacgtaagggttcggttcccgtagtaacggttccacgttcggccggtaggacttcggaacgggactaagtaactttaccnctacaccatcagtagtactacagtcctagaacgtattagttgtacttacttagttactgtacacgtacgagtaccgttaccgcgtaccctaccctacttccgtacgtttaccggaccgtaacggaccaccggtacccgactaacgtagttacggaacgtaacgtcggtacgccgttagacctacccgtgttaccg

SEQ ID NO: 98903 - DNA, 650 bp, Homo sapiens
  misc_feature: GYAE6OF01A80GX.12.31.C09.1.454.CMB.1.raw
  modified_base (205)..(205): a, c, t, g, unknown or other
  misc_feature (205)..(205): n is a, c, g, or t
  modified_base (326)..(326): a, c, t, g, unknown or other
  misc_feature (326)..(326): n is a, c, g, or t
  modified_base (644)..(644): a, c, t, g, unknown or other
  misc_feature (644)..(644): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtcctccatccctccctgtctgcatctgtagganaacaaagtccaccatcacttcggccgggactaaacgagtagttattcgacctaacgttaattttaaaattggtaatacaaaacaaaaagcaaggacaaagtcccaaaagctcctgatttangctgccacagtctgacgtaagggttcggttcccgtagtaacggttcacggtcggaccgtaggactacggaagggtaactaacggttaaacttttaccctccgtaccaaccgttaatccgtaaagttaccgtacctaacacggtacctaaggtaaagttacttagttacgtacctttaactttatttaccgtgtacagacgtaacgtacgttacccgcgtacccttaccgtactccgttaccgttccggaaccgtaacggtaccaccggaccgacgtagtaacggttcggaaacgtacgtggtcgacgtacgacacgtnttaccg

SEQ ID NO: 98904 - DNA, 691 bp, Homo sapiens
  misc_feature: GYAE6OF01DRVAK.12.31.C09.1.454.CMB.1.raw
  modified_base (680)..(680): a, c, t, g, unknown or other
  misc_feature (680)..(680): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtcctccactcctccctgtctgcatcgtgtaggagaacaaagtcaccatcacttcggccggactaacggagagtattcgccctaacgttatttaaagttggtaataccaaacaaaaagcaaggacaaaacgtacccgaaagtcctacctagtacttatcgctcgaccacgtagtctaggcgtaacgggtcggttaccccgtacgtaaggttccaacgttcgggaccggttagggaactaccggaaggggactaaacggttaaacttttcctacctaccaacctataccgtaagttaccgttactaacgacgtccgtaagtaaagtactttacgttcgttaaccttaacgttttacttacgttacgtactacgtacgtaccggttaacggtttaccccgcgtacccctaccgttacgttccttacccggttaccggacccgaaacgggacccgacgaacccgtcgaacggttagtcgggaaccgtaggtcggtacggccctaggtacccncgttgttaccg

SEQ ID NO: 98905 - DNA, 701 bp, Homo sapiens
  misc_feature: GYAE6OF01CWE9Q.12.31.C09.1.454.CMB.1.raw
  modified_base (177)..(177): a, c, t, g, unknown or other
  misc_feature (177)..(177): n is a, c, g, or t
  modified_base (611)..(611): a, c, t, g, unknown or other
  misc_feature (611)..(611): n is a, c, g, or t
  modified_base (676)..(676): a, c, t, g, unknown or other
  misc_feature (676)..(676): n is a, c, g, or t
tcagatacgacgtacacgaccggtgctcgatttagacgtctcatcaaggaaggaagggggcaggagtcagtctcagtcaggtcacagcatggacatggacgggtccccgctcagctccgtggggctcctgctactctggctccggaggtcgccagatgtagacatccagctcgaccngtcctccactcctccgtgtctgcctatcgtaggtaaggacaactaaacgtcaactactcacgttcggccggactaagagtagtatcgacctaagtttaattaaagtggtaactacgaaaacaaaaggcgaacggaacctaaaacgtacccaaagtccttactagttacttacgtcgaccttcacctacgtacgtactggaccggttaacgggttcggtaccctaggtaacggttctacggcggtcgtaagtacgtaacggagggtactaagttaaccgtttcaccgtacgactacttacgtacgtacgttaaccacgacgtaccgtaataacgttaattcgttaactcctttaatacttacgtacgacgaaacgtcgaacgttaccgtacccggttccacccttactaccgttaacgtcgttaaccccgggaanaaaccggggtccaacggggtacctgtaacggtttagacggtaacccgtagttccggggtccttanacccggaaactcccggttatttccg

SEQ ID NO: 98906 - DNA, 846 bp, Homo sapiens
  misc_feature: GYAE6OF01CATH5.12.31.C09.1.454.CMB.1.raw
tcagatacgacgtacacgaccggtgctcgatttagacgtctcatcaaggaaggaagggggcaggagtcagtctcagtcaggtcacaacatggacatgagggtccccgctcagctcctgggggcctcctgctactctggctccgaggtgccagatgtgacatccagctgaccccagtcctccatccctccctgtcctgcatctgtaggagaacaaagtccacctatctacgttcggccgggtactaaacggagtagttagttcgacctaacgttaattttaaagttggttaataacaaaacaaaagcaaggacaaacgtaccaaacgtcctactagtatttacagtcctacgtaccaccgtagtctaggtacgtaacgggttccgggttacccgttacgtaacggttcctaacgggttccggaccggttacggtacgtaccggaacgggtaactaaggtttaaactttaccgtaccgtaacctaaccgtacgtttaccgtaaacggtttaccgttaaccgttaaccgtacggttaccccgttaaaaggtaaacgggttaacttttaagttaccggttaaccctttttaaaaccgttttaaccgtttaaccgttaccgggtaaccgtaacggttaacccggttaacggttaccccggggtttaacccgtacccggtacccccctttaccctaaccgtttaacccgttacccgggtttaaccgggaacccggttaaaccggggacccgtaaccccggtacccgaacggttaacggtacggttaacccgggaccgttacggtacgggttacgtcccgtacggtaacccctaccgttggttccccggttac

SEQ ID NO: 98907 - DNA, 746 bp, Homo sapiens
  misc_feature: GYAE6OF01C4GC9.12.31.C09.1.454.CMB.1.raw
  modified_base (206)..(206): a, c, t, g, unknown or other
  misc_feature (206)..(206): n is a, c, g, or t
  modified_base (570)..(570): a, c, t, g, unknown or other
  misc_feature (570)..(570): n is a, c, g, or t
tcagatacgacgtacacgaccggtgctcgatttagacgtctcatcaaggaaggaagggggcaggagtcagtctcagtcaggtcacagcatggacatgagggtccccgctcagctccctggggctcctgctactctggctccgaggtgccagatgtgacatccagctcgacccagtctccatcccgtccctgtctgcatctgtaganaactaaagtccaacatccgtacgttcggacccgggactaacggagtagtaacttgaccctaacgtttaatttaaagtttcggtaataacgaaaaaccgaaaagtcgaacggaccgaaaccgtaccaaacggtccttacctaggtttaatttagcgtcctacgacccgtaacgtacgttctacggacggtaacggggtttccggttacccctggttaaacggttcacggtggtccgtaaggctacggaagggtaactacggtaaactttccgtactacctaacgtattaccgtaaggttaccttacgaacgtaacgtaccgtaagtaaagtcttaagtttcgtactttaaaccttagtttaccgngttaacacggtactaacgggttaccttaccgaccgtcccttaccccgtaacgtccttaccggttacccgggaaacccgtaaggtacccgaccgggtacccgaagttaacgggtacgttaaacgggcccgttaagtcggggttacccgaacgttccgaaacccgtctaacgttcccg

SEQ ID NO: 98908 - DNA, 753 bp, Homo sapiens
  misc_feature: GYAE6OF01EA4JE.12.31.C09.1.454.CMB.1.raw
  modified_base (199)..(199): a, c, t, g, unknown or other
  misc_feature (199)..(199): n is a, c, g, or t
  modified_base (741)..(741): a, c, t, g, unknown or other
  misc_feature (741)..(741): n is a, c, g, or t
  modified_base (745)..(745): a, c, t, g, unknown or other
  misc_feature (745)..(745): n is a, c, g, or t
tcagatacgacgtacacgaccggtgctcgatttagacgtctcatcaaggaaggaagggggcaggagtcagtctcagtcaggtcacagcatggacatgaggtccccgctcagctcctggggctcctgctactctggctcgaggtgccagatgtgacatccagctgacccagtctccatcctcctgctgcatctgtagganacaagtcacatccaacgttcggaccgggattaacggacgtagtacgttcgccctaacgttaattttaaacttcgggtaactacgaaaacaaaaagtcgaacggactaaacgttacccaaaggtccttaccgtaggtattttaacgtcgtacctacggaccctaaccgtacggttactggtaaccgtaagggttccgggtttacccgtaagtaacggttacgaaccggttcgggtaccgtaggtacgtacggtaacgggtaaacttaacgggtaaactttaccgttcgtaacccgtaaccgttacgttaccgttaacgttacggttaaccgttaccggaccgttacgtaacgggtaaacgttacgttacgttacggtaccttttaacggttactttacggtaccgttagtccgtagtaaccgtaccgtacccggtacgtccctaacccgtcgttaccgtaccggtttcgaaccggtaaacggtcccgaaccggtacccgtcgtacggtacgttacggaacgtccgtgtaccggtcaggtaccncgtnttacccgg

SEQ ID NO: 98909 - DNA, 760 bp, Homo sapiens
  misc_feature: GYAE6OF01CDKOY.12.31.C09.1.454.CMB.1.raw
tcagatacgacgtacacgaccggtgctcgatttagacgtctcatcaaggaaggaagggggcaggagtcagtctcagtcaggtcacagcatggacatggagggtccccgctcagctcctggggctcctgctactctggctccgaggtgccagatgtagacatccagctcgacccagtctccatccctcctgtctgcatctgtagagacaagtccactatccacgttcggccggtactaacggagtagttattcgacctacgttaattttaaagttggtaacttaaccaaaacgtaaaaacgcgaacggaactaaaacggtacccaaaacgtccgttaccgtagtaattttacgcgtacctacgaccctacgtaggtactggtaccggtaagggtttccgggttaccccgtacgttaaacggtttcctaacggtcggtccgtaggaacgttacggaaggggtaactaacggttaactttaccgtaccgttaaccacctaacgtttacctaacgggtttacgtacccttaacgacggtacccgttaaggtaaacgttacttacgtttacgttaacctttaccgttttaattacgttacgttacgaagtacgtaacgtaccggttaccgccgtaccttacccgtattacccgtaccgttacggacccgtaacggaacccaccggtaccgacgtaaggtaacggtccggttaaacggaacgttcgggtaacgttacgttaacgacccgtaaccttcgtttaccgg

SEQ ID NO: 98910 - DNA, 710 bp, Homo sapiens
  misc_feature: GYAE6OF01BEVT8.12.31.C09.1.454.CMB.1.raw
  modified_base (292)..(292): a, c, t, g, unknown or other
  misc_feature (292)..(292): n is a, c, g, or t
tcagatacgacgtacacgaccggtgctcgatttagacgtctcatcaaggaaggaagggggcaggagtcagtctcagtcaggtcacagcatggacatgagggtccccgctcagctccgtggggctcctgctactctggctccgaggtgccagatgtgacatccagctcgacccagtctccatccctcctgtctgctatctgtaggagaacaagtcacactcacgttcggaccgggactaaacggagtagtattcgacctaagtttaattttaaaagttggtaactaacaaaanaaaaagcaacggacaaaacgtcccaaagtcctactagtaactttatcgacctacgaccacgtagtacgtaggacgtaagggttccggttacccgtagtaacggttcacggtcggcgtaggactacggaagggactagtaactttaccactacaacctacgtcgtaagttacgtactaacacgtaccttaagtaaacgtatttagttacctaactttactttaacgttacgtcgtacgacgtactaacggtaaccgttaccccgaccgtaccttaccctaattaccgttacccgttacccgggaaacccggtaacggggacccaaacccgggtaaccgcgtaaaggtacggtttaacgggaaaccttaaccgggttgtacccgggtacgcccggtaaccctaacccgttcgttacccgg

SEQ ID NO: 98911 - DNA, 841 bp, Homo sapiens
  misc_feature: GYAE6OF01DOD78.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctcgacccagtcctccactccgtccctgtctgctatcgtgtaggagacaagtcaccatctacgttcggaccggtactaacggagtagttacgttacgacctaacgtttaatttaaagttcggtaataaccaaaaacgtaaaaacggcgtaaggaaccgtaaaacggttaccccaaaaggtcctaccgttagtatttaacgtcgaccttcggaccctacgtacgtcgtacgtaccggtaacgggttccggttaccggtacgtaaacggttcgaaccggtcgggtaccggtacggacgtacggaacggggtaacgtaacgtttaaactttcccgtacctaacccgtaccgttaactaaccggtacgtttaacggtcccttaaacggaacgttaactaaaggtaaagtcgtttaacgttcgttaaccttttaaacgttttattacccgggtttagacccgtaggtaacctacgggttaacccggttaccccggtaccttacccccgtttaccgtaaccgttaccgtttaccccggtttaacccggggaaaccgtaaaccgggtaccccgtaaacccgggtacccgtaaacggaggtttaaacccggtttccggggaaaaccgttcggttaccggtccgggttaacccgtcggtaaacccccgttaacgttccgttacccgg

SEQ ID NO: 98912 - DNA, 887 bp, Homo sapiens
  misc_feature: GYAE6OF01ERI3L.12.31.C09.1.454.CMB.1.raw
  modified_base (213)..(213): a, c, t, g, unknown or other
  misc_feature (213)..(213): n is a, c, g, or t
tcagatacgacgtacacgaccggtgctcgatttagacgtctcatcaaggaaggaagggggcaggagtcagtctcagtcaggtcacagcatggacatgagggtccccgctcagcctccgtggggctcctgctactctggcctccgaggtgccagatgtagacatccagttcgaccctagtcctccacttccttcctgtctgcatctagtagganacagactccaaccatccacgttcggcccggaccagtacaggtactattacgacttaaagttttagttacggtcgttaggtactacgagacaaggaacgtacccggaagggaaacccgtaccccgttaacggttccgtagtacttaccgtaggtgtacgactaccttaccttagtttacgaacttaggtacgggtaccgggtaccctaagttaccgtaaggtttcaacgggtccggtaacggtacggtacgtacgtacggtacgggtaactacgttaaccgttaccctaaccgttccgtaacccgtaacctaaacccgtcccgtaacccgtaaccggttccccggtacgtaacccgtaccggttaaaccgtttaacggttaaacgttttaccgtttttaaccggaaaccctttttaaacccgtttaccgttaacggtttaacccgttaaaccggtttaaaccggttttaaaccgtttttaaccccggtttaacccgttttaacccggttttacccggttttacccggtttaccccggggttaccccgttaacgggttaacccccgtaaaggtttaacccggttaacggttaaacccgttaaaccgttaacccggtaaaaccgggttacccggtttacgggtaacccgttccgttaaacccgtccccgttaaccgg

SEQ ID NO: 98913 - DNA, 842 bp, Homo sapiens
  misc_feature: GYAE6OF01AQOKG.12.31.C09.1.454.CMB.1.raw
  modified_base (215)..(215): a, c, t, g, unknown or other
  misc_feature (215)..(215): n is a, c, g, or t
  modified_base (579)..(579): a, c, t, g, unknown or other
  misc_feature (579)..(579): n is a, c, g, or t
tcagatacgacgtacacgaccggtgctcgatttagacgtctcatcaaggaaggaagggggcaggagtcagtctcagtcaggtcacagcatggacatgacgggtccccgctcagctccgtggggctcctgctactctggctccgaggtgccagatgtgacatccagcctgacccctagtcctccactccctccctgttctgcattcgtgtaagganaacgaagtccaccatacgtacgttcggccggactaacgagtagttctcgacctagttaatttaagttggtataacaaacaaaaggcgaacggactaaacgaacccgaagtacctaccgtgttaattttacgtacgtccttacgccctaaccgacgttaccgtacgtaccgggtaacggggttttcccgggttacccgttaacggttaacgggtttacccgtacgggtacccgggtaccgggttacggtaaccgttaccgggaaacgggtaaccgttaaggtttaaaccttttaccgtacccttacccgtaacctaacgttacgtaaggttacgtacctacgtaacgtaccgttaggaaacgttnttaaccgttacgtactttaacttttacttacgttacgtaccgtacggacgttaaccggtaacccggttacccgtacccgtacccttacccgttaacgttacccggttaccgtttaccgggaacccgggtaaccggggttaaacccaaccccgggtaacccggtacggttaaacggttaccgggttaaaccgggtaacgggttaaccggttaccgggttaccgggtaccgttaaccggtaacccgtaccgttacgtttacccgg

SEQ ID NO: 98914 - DNA, 741 bp, Homo sapiens
  misc_feature: GYAE6OF01EU6YA.12.31.C09.1.454.CMB.1.raw
  modified_base (356)..(356): a, c, t, g, unknown or other
  misc_feature (356)..(356): n is a, c, g, or t
  modified_base (720)..(720): a, c, t, g, unknown or other
  misc_feature (720)..(720): n is a, c, g, or t
tcagatacgacgtacacgaccggtgctcgatttagacgtctcatcaaggaaggaagggggcaggagtcagtctcagtcaggtcacagcatggacatgacgggtccccgctcagctcctggggctcctgtctactctggcctcggagtcgcagtactgtgactactccgacgtctacgacccgtacgtcctcctactcccgtcctgtctgactatcgtaggtaagacaacgtaacgtcactactacgtacgtcggccggactaacgagtagtactcgtacctacgttaattaagtgtaacaacgaaaataacgcgaacggactaaccgtaccgaaacgtcctacgtagttacttacncgtaccgccgtacctacgtacgttcgaggtaccggtacgggtttcccggtacgtacgtaacgggttacaccgggtggtaccgtgaaccgtacgaagggtactaacgtttacgtacctacaaccgtactactacgtaacgtctacgaacgtacgtagtaacgtaagtattaacgtgtaaccttacgtttacgttacgtcgtaacgtacgtaccggtaatcccggttaccgtcccgtaccgtaccgttaccggtaccgttaccggttaacccggaaccgggttaaacggacccgtaaacggtacccggtaacggtaacggttccgtaacgggttacggtacccgtttaggaccggtacgttaaccncccgggttctaccggttaccg

SEQ ID NO: 98915 - DNA, 891 bp, Homo sapiens
  misc_feature: GYAE6OF01EQHKT.12.31.C09.1.454.CMB.1.raw
  modified_base (109)..(109): a, c, t, g, unknown or other
  misc_feature (109)..(109): n is a, c, g, or t
  modified_base (752)..(752): a, c, t, g, unknown or other
  misc_feature (752)..(752): n is a, c, g, or t
  modified_base (880)..(880): a, c, t, g, unknown or other
  misc_feature (880)..(880): n is a, c, g, or t
tcagatacgacgtacacgaccggtgctcgatttagacgtctcatcaaggaaggaagggggcaggagtcagtctcagtcaggtcacagcatggacatgacgggtccccgntcagctccgtggggcctcctgctactctggctccgagtcgccagatgtacgactactaccagtcgtcgaccctagttccctccacttcccgtcccttggtcttacgctacgtccgttagggtaacggaacgaaccaaacgttccaaacctacgttacccgtaaccgtttccgggacccgggtaaactaaacgggtaacgttacggttagtttaccggtaaccccgttaacggtttttaagtttttaaaaaccgtttgggtttaaaaaccgtaaaaaactaaaaaaaaacgggtcccgtaaaaaggggaaaccccgtaaaaaccggtttaaccccccgaaaaagggttcccctttaaccgttaaaggtttaacgtttttaaacgccgggttaccgttacccgaccgtaacccggtaaggttccgtacggtaaccgggttaacgggttcccggggtttaacccctaggtaaccggttccacggtaccgggtccggtaaggtcgtaccggtaggaacctaaagtttacgttcctacacgtactctaacgtacgtacgtactacgacgtacaagtaatcgttaacttacggtacctttaagtacgtttaatcgttaacacgtaccgttaacggtaccgttaccgacncccttaacgtacctccgggttaaccgttaccgggagaaacccgggtactaaaccgggtcccgtaacggtcgtaaggggttacccgaaacggttccgtaagggttcccgacgtctaaacctaaccgttnttaccggtacc

SEQ ID NO: 98916 - DNA, 719 bp, Homo sapiens
  misc_feature: GYAE6OF01A7GTU.12.31.C09.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (363)..(363): a, c, t, g, unknown or other
  misc_feature (363)..(363): n is a, c, g, or t
tcagatacgacgtacacgaccggtgctcgatttagacgtctcatcaaggaaggaagggggcaggagtcagtctcagtcaggtcacagcatggacatggagggtccccgctcagctccgtggggctccctgctactctggctccggaggtgccagatgtgacatcccagctcgacccagtcctccactcctcctgtctgctntctgaganaacaagtcaccatcacgttcggccggtactaagagtattacgtcgtacctacgttaatttaacggttggtaactaacaaacgaaaacgtcaacgggtaactaaaccgtaccaaaacgtccttaccgtgtaactttacgcgtctacgccctaacngtaccgtgacggtacgggttccggtaccgtagtaacggtcctacgtcggcggtagtacgacggtaacgggacttaaaggtaacctttccgtacctaccgtaaactcgtaacgttaacgtacgttacctacgacggtaaccgtgtaaacgtacgttactttacggtaacctttaacgtttacttaaccgtggtaccaggtactaaccggtaaccgttccgaaccgtcccttacctagttcccgtaacggttaccggacccggtaaacgggacccaaccgggaccgtaacgtacggttaagggtacccgttaagtaccgggttagtaccggacgtacccgacacccggttgtttaccg

SEQ ID NO: 98917 - DNA, 840 bp, Homo sapiens
  misc_feature: GYAE6OF01AM16Y.12.31.C09.1.454.CMB.1.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (820)..(820): a, c, t, g, unknown or other
  misc_feature (820)..(820): n is a, c, g, or t
  modified_base (831)..(831): a, c, t, g, unknown or other
  misc_feature (831)..(831): n is a, c, g, or t
tcagatacgacgtacacgaccggtgctcgatttagacgtctcatcaaggaaggaagggggcaggagtcagtctcagtcaggtcacagcatggacatgagggtccccgctcgagcttccgtggggcctccgtgcctactcgtggcctccggaggtcgccaggatggtgacactccgagcgtacgaccctagtcncctactccctccgtntcgtcgctatcgtaggtaggaacgaactaacgtaccacctataccgacgttcgggacccggtactaacggagtaagttacgtaccgaacccgtaagttttaaagttttaaacgttggtaaacttaaccgaaaaaacgaaaacggttccgaacgggtaaacctaaaaccgtaacccctaaacggtcccttaccgttaggttaactttttacgcgggttacctaccgaacccgtaccgttacgtcgttacggtaaccgggttaacggggtttcccggttacccggtaggttaacgggtccaacgggtccggtacggtcggaacgtaccggtaacgggacgttaaaggttaccttttccgaacctacctaaaccgtcttaacggtacgtttaacgacccgtaaccgtacgtaacgttaacggaaacgttttataccgtttaacggtcctttaaacgtttacgtacggttacgacgtaaatcgggtaacggttaccccggacctcccgtaccctttaccgtacttaaccccgttcgggtaaccccgggaagtacccggggacctacccgggtaccaggttaggaccgtacggggaaacttccgggaggtcgttacnctacccgtgtnttaccccgg

SEQ ID NO: 98918 - DNA, 491 bp, Homo sapiens
  misc_feature: GYAE6OF02I2XMN.12.31.C09.1.454.CMB.1.raw
  modified_base (369)..(369): a, c, t, g, unknown or other
  misc_feature (369)..(369): n is a, c, g, or t
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
tcagatacgacgtacacgaccggtgctcgatttagacgtctcatcaaggaaggaagggggcaggagtcagtctcagtcaggtcacagcatggacatgagggtcccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaaagctcctgatttatgctgccaccagtctgcaaggtggttcccgtcaaggttcactggccgtggatcagggacagaatttacnctcaccatcagtagtctacagcctgaagatattgcttacttattactgtcagcagagttaccgcgctcccatcactttcgccaagggcacgaccgnagattggacgactgtgctgcaccntc

SEQ ID NO: 98919 - DNA, 492 bp, Homo sapiens
  misc_feature: GYAE6OF02GD7W6.12.31.C09.1.454.CMB.1.raw
  modified_base (490)..(490): a, c, t, g, unknown or other
  misc_feature (490)..(490): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtgggttcccgtcaaggttcactggccgtggatcgagggacagaatttactctcaccatcagtagtctacagcctgaagatattgctacttattactgtcagcagagttaccgcgctcccatcactttcggccaaggacacgaccgcagatggacgagtgtggctgcaccntc

SEQ ID NO: 98920 - DNA, 482 bp, Homo sapiens
  misc_feature: GYAE6OF02H24TT.12.31.C09.1.454.CMB.1.raw
  modified_base (156)..(156): a, c, t, g, unknown or other
  misc_feature (156)..(156): n is a, c, g, or t
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (412)..(414): a, c, t, g, unknown or other
  misc_feature (412)..(414): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (476)..(476): a, c, t, g, unknown or other
  misc_feature (476)..(476): n is a, c, g, or t
tcagatacgacgtacacgaccggtgctcgatttagacgtctcatcaaggaaggaagggggcgaggaggtcagtctcagtcaggtcacagcatggacatgagggtccccgctcagctcctggggctcctgctactctggctccgaggtgccagatgngacatccagctgacccagtctccatcctccgngtctgcatctgaagganacaaagtcacattcacgttgccgggntaagagagtattgccagtattaaatggttancaagaaaaagcaggataaaatcccaaaagctcctgattatgctnccacagtctgnaagtggttcccgtnaaggttcaacgtggcctggatcgagggactagaatttacnctcaccatcgatagtnacngcngaantatgctatatatgtnnnagatcncnctccatctacttcgacgacgacgacgcgactagatagacgagtgacgtgtgacnctatcg

SEQ ID NO: 98921 - DNA, 504 bp, Homo sapiens
  misc_feature: GYAE6OF02I353F.12.31.C09.1.454.CMB.1.raw
  modified_base (228)..(228): a, c, t, g, unknown or other
  misc_feature (228)..(228): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggntaacgagagtattgccacgtatttaaattggtatcaaacaaaagcaggcaaagtcccaaagctcctgatttangctgccaccagtctgcaaggtgggttccctnaaggttcacgtggccgtggatcgagggacagtaatttactctcaccatcagtacgtctacagcctagaagattattgcttactttattactgtcagcagagttaccgcgctccatcactttcgacaacggacaccgaccgcagtactggaccaagtggtcgctgcacattcg

SEQ ID NO: 98922 - DNA, 508 bp, Homo sapiens
  misc_feature: GYAE6OF02HIMVA.12.31.C09.1.454.CMB.1.raw
  modified_base (333)..(333): a, c, t, g, unknown or other
  misc_feature (333)..(333): n is a, c, g, or t
  modified_base (477)..(477): a, c, t, g, unknown or other
  misc_feature (477)..(477): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaaacaaaaagcaggcaaagtcccaaagctcctgatttatgctgccacagtctgcaaggtcggttcccgtnaaggttcacgtggccgtggatcgaggacagaatttctctcacatcagtagtctacagcctagaagtatattgacttacttattactgtcagcagtacgttaccgcgtcctacccatcctacgttcgaccaagggacacgaccgnagtatcggacgacgtgtcggctgcactatcg

SEQ ID NO: 98923 - DNA, 486 bp, Homo sapiens
  misc_feature: GYAE6OF02HB1TG.12.31.C09.1.454.CMB.1.raw
  modified_base (366)..(366): a, c, t, g, unknown or other
  misc_feature (366)..(366): n is a, c, g, or t
  modified_base (430)..(430): a, c, t, g, unknown or other
  misc_feature (430)..(430): n is a, c, g, or t
tcagatacgacgtacacgaccggtgctcgatttagacgtctcatcaaggaaggaaggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccacagtctgcaaggtgggttccgtcaaggttcactggccgtggatcagggacagaatttacnctcaccatcagtagtctacagcctgaagtatattgctacttattactgtcagcagagttaccgngcctccatcactttcggacagggacacgaccgcagatggacactgtgctgcacatc

SEQ ID NO: 98924 - DNA, 511 bp, Homo sapiens
  misc_feature: GYAE6OF02F9V5J.12.31.C09.1.454.CMB.1.raw
  modified_base (333)..(333): a, c, t, g, unknown or other
  misc_feature (333)..(333): n is a, c, g, or t
  modified_base (371)..(371): a, c, t, g, unknown or other
  misc_feature (371)..(371): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaaacgagagtattgccacgtatttaaattggtatcaacaaaaagcaggcaaagtcccaaagctcctgatttatgctgccaccagtctgcaaggtggttcccgtnaaggttcactggccgtggatcgagggacagaatttacnctcaccatcagtagtctacagcctgaagatattgactacttattactgtcagcagagttaccgcgcctacccatcactttcgaccaagggaccacgaccgcagtagttggacgaacgtggtggcctgacctaccattccg

SEQ ID NO: 98925 - DNA, 501 bp, Homo sapiens
  misc_feature: GYAE6OF02HJMHG.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaaagctcctgatttatgctgccaccagtctgcaaggtgggttcccgtcaaggttcactggccgtggatcagggacagaatttactctcaccatcagtagtctacagcctgaagatatgctacttattactgtcagcagagttaccgcgcctcccatccaactttcgggaccaagggacacgaccgcagattggacgaactgtggctgctacatcg

SEQ ID NO: 98926 - DNA, 492 bp, Homo sapiens
  misc_feature: GYAE6OF02H9TII.12.31.C09.1.454.CMB.1.raw
  modified_base (231)..(231): a, c, t, g, unknown or other
  misc_feature (231)..(231): n is a, c, g, or t
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (490)..(490): a, c, t, g, unknown or other
  misc_feature (490)..(490): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctcctgtctgcatctgtagagacaaagtcaccatcacttgccggctaacgngagtattgccagtattaaatggtatcaacaaaaagcaggcaaagtccaaagctacctgattatgctgccacagtctgcaaggtcggttacccncaaggttcacgtggccgtggatacgagggactagtaatttacnctcaaccatcagttagtctaacagcctagaanttaattgacttaacttattactgtacagtcagagttccncgctccatcacttcggacaaggcacgacncagtntgacagtgcgctgcacgntc

SEQ ID NO: 98927 - DNA, 543 bp, Homo sapiens
  misc_feature: GYAE6OF02GGE9Y.12.31.C09.1.454.CMB.1.raw
  modified_base (465)..(465): a, c, t, g, unknown or other
  misc_feature (465)..(465): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccaacgttatttaaattggtatacaaacaaaaagcaaggacaaagtcccaaaagctacctagtatttatgctgaccacagtctgacgaagggttcgggttcccgtacgtaaggttcacgtcggccgtggatcgagggacagtaatttacactacaccatacagtacgtctacagcctagaagatattgtacttactttattactgtcagcagacgttaccgcncctccatctacgttcggaccgaagggccacggaccgcagtacgttacggacgtacgtgtcggcctcgcctactattcg

SEQ ID NO: 98928 - DNA, 506 bp, Homo sapiens
  misc_feature: GYAE6OF02GEJSZ.12.31.C09.1.454.CMB.1.raw
  modified_base (330)..(330): a, c, t, g, unknown or other
  misc_feature (330)..(330): n is a, c, g, or t
  modified_base (368)..(368): a, c, t, g, unknown or other
  misc_feature (368)..(368): n is a, c, g, or t
  modified_base (503)..(503): a, c, t, g, unknown or other
  misc_feature (503)..(503): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaagtggtcccgtnaaggttcactggccgtggatcgagggacagaatttacnctcaccatcagtagtctacagcctgaagatattgtactacttattactgtcagcagagttaccgcgtctcccatctactttcgcctaagggacacgaccgcaagagttcggacgaacgtgtcggcttgcaccgtntcg

SEQ ID NO: 98929 - DNA, 567 bp, Homo sapiens
  misc_feature: GYAE6OF02JF5ZF.12.31.C09.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (384)..(384): a, c, t, g, unknown or other
  misc_feature (384)..(384): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggntaacgagatattgccacgtatttaaattggtatacaaacaaaaagcaaggacaaagtcccaaagctcctagatttangctgccaccagtctgacgaagggttcggttccctagtaaggttcaacgttggcccgtgactcgagggacagtaatttcnctcacatacagtagtctacacgcctgaaagtatattgtacttatttacttactgtaccagtctaaggtacgttacccgcgtcctacccatcctacgtttcgacccgtaagggtccacggtaccgcgtagtacggttacggaacgtaaccggttggtacggtcctaggacctaccgtagttccg

SEQ ID NO: 98930 - DNA, 540 bp, Homo sapiens
  misc_feature: GYAE6OF02G6K83.12.31.C09.1.454.CMB.1.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (368)..(368): a, c, t, g, unknown or other
  misc_feature (368)..(368): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttangctgccacagtctgcaaggtggttccctnaaggttcacgtggccgtggatcgagggacagaatttacnctacacatcagtagtctacagcctagaagtatattgacttacttattactgtcagcaggtacgttaccgcgcctcccattccgtacgtttccggacctaagggtaccaccggtacccggcaacggtagttacggaacgtaacgtggtacggcttacggacctaccgtatccg

SEQ ID NO: 98931 - DNA, 677 bp, Homo sapiens
  misc_feature: GYAE6OF02HD7ZC.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccggctaacgagagtattgccacgttaatttaaattggtaatacaaacaaaaagcaaggacaaaacgtcccaaaagcctacctagtaatttatgctcgacccaaccagtctgcgtaaagggttcgggttacccgtacgtaaagggttccaacgtcgggaccggttagggaacgttacgaaacgggggtaacctaaaggttaaacttttaaccgtccttaacctaaccctaacttaccgtaagttaacgttccttaaacgacgtaccgtaggaaagtaattattacgtactttaactttaagttaccttgtacaagtactaagtacgttacccggcgtaccctacccgtacttaccaccgttttaccgggaaccgtaacggggacctaaccggacccggacaacggtacgttacggaacgtaacgtcggtacggcctaggacctaccgtattaccg

SEQ ID NO: 98932 - DNA, 539 bp, Homo sapiens
  misc_feature: GYAE6OF02GCFP8.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggacaaagtcccaaagctcctgatttatgctgccaccagtctgcaaggtcgggttcccgtcgaaggttcactggccgtggatcgagggacagtaatttactctacaccatcagtagtctacagtcctagaagtatattgcttactttattacttgtcagcaagacgttaccgcgtcctcccattcctaacctttcggacccaagggtaccaccggaccgcgaagtagttacggaacgtaacgttggtcggactgcctacctagtcc

SEQ ID NO: 98933 - DNA, 584 bp, Homo sapiens
  misc_feature: GYAE6OF02I0MZ9.12.31.C09.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccggctaacgngagtattgccacgtatttaaattggtatcaacaaaagcaggcaaagtcccaaagctcctgatttatgctgccaccagtctgcaaggtggtcccgtnagtcactggccgtggatcgagggacagaatttactctacaccatcagtagtctacagacctgaagatattagcttacttattactgttacagacaggtaacgtttacccggctcccgtaccctattcccgtaacgtttttcccgggacccgtaaacggggcccaaccggaaccccgggtcaacggtaacgtttacgggaaacccgtaaccggttggttacggggaccttacgggtacccaacccgtacgttcccg

SEQ ID NO: 98934 - DNA, 526 bp, Homo sapiens
  misc_feature: GYAE6OF02F1EFJ.12.31.C09.1.454.CMB.1.raw
  modified_base (375)..(375): a, c, t, g, unknown or other
  misc_feature (375)..(375): n is a, c, g, or t
  modified_base (521)..(521): a, c, t, g, unknown or other
  misc_feature (521)..(521): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatccctccctgtctgcatctgtaggagacaaagtcaccatcacttgccgggctaacgagagtattgccacgttatttaaattggtatcaacaaaaagcaggcaaagtcccaaagctcctgatttatgctgccaccagtctgcaaggtcgggttcccgtcaaggttcactggccgtggatcgagggacagtaatttacnctacaccatcagtagtctacagcctagaagtatattgactatttattactgtcagcagtagttaccgcgtcctcccatccactttcgaccaagggacaccgaccgcagtacgttcggaacgtaacgtggtacggctggcctaccgnttccg

SEQ ID NO: 98935 - DNA, 554 bp, Homo sapiens
  misc_feature: GYAE6OF02G290J.12.31.C09.1.454.CMB.1.raw
  modified_base (306)..(306): a, c, t, g, unknown or other
  misc_feature (306)..(306): n is a, c, g, or t
  modified_base (548)..(548): a, c, t, g, unknown or other
  misc_feature (548)..(548): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaaattggtatacaaacaaaaagcaaggcaaagtcccaaaagctcctgatttangctgccaccagtctgcgaaggtcgggttcccgtcgtaaggttcacgtggtaccgtggatccgagggacagtaatttaccgtctacacctatctagtagtctacacgtcctagaagtatattgacttacttattactgtacagctagtacgttaccgcgtctacccattcctacgtttcggccgtaacgggaccaccgaaccgcaagtacgttacggaacgtactggtcgctagcctaccgtnttaccg

SEQ ID NO: 98936 - DNA, 554 bp, Homo sapiens
  misc_feature: GYAE6OF02HDAGP.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagagacaaagtcaccatcacttgccggctaacgagagtattgccacgtatttaaattggtatacaacaaaagcaggacaaagtcccaaagctcctgtattatgctgccacagtctgcaagggtcggttcccgtacgtaaggttccacgtcggccgtggatcgagggacagtaatttactctcacctatcagtagtactacagctagaagatagttctacttacttattctagtcagcagtacgttaccgcgtcctccattcctaccgtttccggaccgtaagggaccaaccggtaccgacgacggtacgttacggaacgtaacgttggttacggcttacggacctaccgtattccg

SEQ ID NO: 98937 - DNA, 704 bp, Homo sapiens
  misc_feature: GYAE6OF02GKGRS.12.31.C09.1.454.CMB.1.raw
  modified_base (204)..(204): a, c, t, g, unknown or other
  misc_feature (204)..(204): n is a, c, g, or t
  modified_base (338)..(338): a, c, t, g, unknown or other
  misc_feature (338)..(338): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatcgtgtagganacaaagtcaccatccacttcggaccgggactaacgagtacgttacttcggaccctacgttaatttaaacttggtaatacaaaacgaaaagcaaggacaaaacggtacccaaaagccttaccgtgtaacttttanacgtcgtacgacccaacctagtcctagaccgtaagggttccgggttcccgtagtaacgggttcacgtcgggtaccgtaggactacggaagggtacaagttaatttacctccgtacacctatacgtagtacggttactacgacgtaccgtagaaacgttacgttattcggtaactttaaacttttacttagttacgtacaacggttacgtaacgtaacggtttaccccggcgtacccttacccgttaacgttccttacccggtttacggaaccccggtaagggaccaacccgggtacgaccgtaacggtaagttaccggaaccgttaagtcggggttaacgcccgttagaccgtaccgtcttacccg

SEQ ID NO: 98938 - DNA, 634 bp, Homo sapiens
  misc_feature: GYAE6OF02HKYCF.12.31.C09.1.454.CMB.1.raw
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagagacaaagtcaccatcacttggccgggctaacgagagtattgcctacgtatttaaattggtatcaaanaaaagcaggacaaagtcccaaagctcctagtatttangctgaccaccagtcngacgaagggttcgggttcccgtataagggttccacgttcgggacccgtggactacggacgggaactaaggtaaacttttaccgaccgttccaaccgtattacgagttacgtctacgacgcctagaagattattgtacttaacttaacttcttgtcctaagccgtaaggtaacgttacccggaccgtcccttacccgtacttcctacccgtttcggacccgtaacgggaccacccggaacccggtacgtaacggtacggttaacggaaccggtaacgttgggaccggtccttaacgggtcccaaccgtattaccg

SEQ ID NO: 98939 - DNA, 624 bp, Homo sapiens
  misc_feature: GYAE6OF02GCT21.12.31.C09.1.454.CMB.1.raw
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
  modified_base (377)..(377): a, c, t, g, unknown or other
  misc_feature (377)..(377): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccggctaacgagagtattgcctagtatttaaattggtatacaaacaaaagcagacaaagtcccaaagctctgatttangctgccaccagtctgcgaaggtcgggttcccgtntaaggttcacgtggccgtaggatcgaagggacagtaactttcnctcaacatacagtacgtctacagtctagaaactagtacttgtacttaacgtttacttaacgttcgtactaacggtactaacggttacggtttaccccgccgtaaccttccccttaagttcccgttaaccggttttcccggaacccgtaacggggtacccgaaccggtacccggtaacgtaacggtaacgttacgggaaacccgttaacgtcgggttacggccgttacggaccgtaccctagttcccg

SEQ ID NO: 98940 - DNA, 540 bp, Homo sapiens
  misc_feature: GYAE6OF02GSJVG.12.31.C09.1.454.CMB.1.raw
  modified_base (337)..(337): a, c, t, g, unknown or other
  misc_feature (337)..(337): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatacaaacaaaaagcaaggacaaaagtcccaaaagctcctgatttatgctgcccacagtctgcaaggtgggttcccngaaggttcatggccgtggactcgagggacagtaatttactctaccaccatcaagttagtctaacgagcctagaagtatattgcttaacttatttactgttacagcaaggacgttaccgcgccttccaattccacgtttcggacctaagggaccacggaccgcagacgttaggacgtaagtcggtcggctgacctaccattccg

SEQ ID NO: 98941 - DNA, 543 bp, Homo sapiens
  misc_feature: GYAE6OF02GWLTJ.12.31.C09.1.454.CMB.1.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (370)..(370): a, c, t, g, unknown or other
  misc_feature (370)..(370): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagganacaaagtcaccatcacttgccggctaacgagagtattgccacgttatttaaatggtatcaacaaaagcagacaaagtcccaaagctcctgatttatgctgcccaccagtctgcaaggttggtcccgtnaaggttcacgtggccgtggatcgagggactagatttacnctacacatcagttatcctacagacctgaagtatattgcttacttatttactgtacagcaggtacttaccgccgtacctcccacttcctaccgtttaccggaccctaagggaccacggacccgactaggacgtggaaccgtaacgttggtacggcgtacgccgtaccacgttcg

SEQ ID NO: 98942 - DNA, 627 bp, Homo sapiens
  misc_feature: GYAE6OF02GPDJA.12.31.C09.1.454.CMB.1.raw
  modified_base (319)..(319): a, c, t, g, unknown or other
  misc_feature (319)..(319): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagagacaaagtcacatcacttgccggactaacgagagttattgaccaacgttaatttaaattggtaatacaaaacaaaaagcaaggacaaacgtacccaaaagtcctacctagtattttangtctcgacccacctagtctagacgtaaggttcgggttcccgtataaggttcacgtggccgtgatcgaggacagtaactttactctacacctatacgtagttacgtacctacgtacgtcctaaggaacgtattagttacgttacttaacgttttattaccgtagttacagtcgtaacggtacgttacccgcctccttaccctattacccgtacgtttaccgggaccgtaacgggtaccaaccggaccgacgtagtacgttacgggaaccgtaacgttgggtaccgccgtacggcctaccgtagttcccg

SEQ ID NO: 98943 - DNA, 587 bp, Homo sapiens
  misc_feature: GYAE6OF02JJ7L9.12.31.C09.1.454.CMB.1.raw
  modified_base (306)..(306): a, c, t, g, unknown or other
  misc_feature (306)..(306): n is a, c, g, or t
  modified_base (582)..(582): a, c, t, g, unknown or other
  misc_feature (582)..(582): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctcatcctcctgtctgcatctgtaggagacaagtcaccatcacttgccggactaacgagagtattgccacgttatttaaattggtactacaacaaaagcaggacaaacgtacccaaagctacctgtatttagngactgccactagtctagacgtaagggttcggttacccgtactaacggttcacgtcggaccgtaggactcgaaggggactacggtaactttaccactacaccgtatacgaagtacgtactacgacgtcgtagaagtacttattcgtacgtttacttaacgttacgtgtacgtagacgtaacgtacgttacccgcgtacctccattctacgtttccgacgtaacggcacggaccgtcgagtacgtacggacgtaacgtggtacgtctacgctaccgtntaccg

SEQ ID NO: 98944 - DNA, 633 bp, Homo sapiens
  misc_feature: GYAE6OF02IKOFW.12.31.C09.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctcctgtctgcatctgtagganacaaagtcaccatcacttgccgggctaacgagagtattgccagttatttaaattggtaatacaaacaaaagcaggacaaagtccaaagctctgatttangctcgaccacctagtctgacgtaacgggttcgggttcccgtagtaaacggttcacgttcgggaccgtggactcgaaggggactaacggtaatttaccgtctacacctatcgaagtacgtctaacacgtcctagaatattagttcgtactttactttatttaacctgtacacggtcgtaagtaaccggtttaccgccgtaccttaccccgaatttcccgtaaccgttttccgggaacccgtaaacggggacccaaccggtacccggaactaacggtaacggttacgggaaccgtaacgttcgggtacgaccgttcgaccctaaccgattccgg

SEQ ID NO: 98945 - DNA, 722 bp, Homo sapiens
  misc_feature: GYAE6OF02GV49S.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctcctgggctcctgctactctggctccgaggtgccagatgtgacatccagctgacccagtctccatcctccctgtctgcatcgtgtaggagacaagtccaccatcacttgccgggctaacgagtagtattcgacctacgttaatttaaagttggtaattacaaactaaaaagcaaggacaaacgtacccaaagtcctaccgtaggtaacttttagtcgtctcgaccctaccgtacgttaccgtacgaccggtaaagggttccgggttaccccgtagtaacggttcctacggttcgggaccggtaggtacgtaccggaaggggtaacctaagttaaactttaccgtaccctaccgtaacccgtacgttaccgtaacgttacgttaccgtaacgtacgtaccgtaggtaaacgtaacttacgttacgtactttaacgtttactttacgtagtacctacgtacgtaacggtaccgttacccgaccgttacccgtacccgtaacttaccgtaccgtttaccggaccgtaacggtaccgtaccgtaccggaccgtaagttacggtacggtaacgtacgttcggtacggtaccgtacggtaccgtacgtacttccg

SEQ ID NO: 98946 - DNA, 630 bp, Homo sapiens
  misc_feature: GYAE6OF02HHDWE.12.31.C09.1.454.CMB.1.raw
  modified_base (281)..(281): a, c, t, g, unknown or other
  misc_feature (281)..(281): n is a, c, g, or t
  modified_base (323)..(323): a, c, t, g, unknown or other
  misc_feature (323)..(323): n is a, c, g, or t
  modified_base (422)..(422): a, c, t, g, unknown or other
  misc_feature (422)..(422): n is a, c, g, or t
  modified_base (624)..(624): a, c, t, g, unknown or other
  misc_feature (624)..(624): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtcctccatccctccctgtctgcatctgtaggagacaaagtccacatcacttcggccgggactaacgagagttattgacctaagttaatttaaaagtggtaatacaaaanaaaagcaaggacaaacgtaccaaagtcctacctagtatttancgctcgacctaccagtctgacgtaagggttcggttacctacgtaacggttctacgtcggtaccgtaggactcggaagggaactaacggttaatttaccncctacacctaatcgaagttacgtactacacgtcctaagaacttataattcgtactttactttagttacgtcgtacaagtcgaacggttaccgttacccggactacccctactaacgttcctacggtttaccgaaccgtaacgggtacccacgaccgtacacggtactacgggaacgtaagttcggcgactacggacctaccncgttcg

SEQ ID NO: 98947 - DNA, 673 bp, Homo sapiens
  misc_feature: GYAE6OF02HVOQ4.12.31.C09.1.454.CMB.1.raw
  modified_base (329)..(329): a, c, t, g, unknown or other
  misc_feature (329)..(329): n is a, c, g, or t
  modified_base (419)..(419): a, c, t, g, unknown or other
  misc_feature (419)..(419): n is a, c, g, or t
tcagatacgacgtacacgaccggtgctcgatttagacgtctcatcaaggaaggaagggggcaggagtcagtctcagtcaggtcacagcatggacatgagggtcccccgctcagctcctggggctcctgctactctggctccgaggtgccagatgtgacatcccagctcgacccagtcctccatccctccctgtctgcatctgtaggagacaaagtccaccatcacgttcggccgggactaacggagagttattgcctaacgttaatttaaagttggtaatacaaacaaaaagcaaggacaaaacgtacccaaagcctacctgtatttangctcgaccacagtctgacgtaagggttccggttaccgtacgtaaggttcacgtggccgtaggactacgaagggactagtaacttttaccncgtaccacctataccgtaagttacgtacctaaccgagtacctaaggaaacgtatttaattacgttacctttaacttttaacgttacttggtacaacgggtactaacggtaacgttacccgccgtacccgttacccagttaccgtacggtttacccggaaccgtaacgggccctaaccggacccgtacggtaacgtaggtaccgggtaacgtaaccgtttgggacggtaccgttacggaccctaccgtgttaccg

SEQ ID NO: 98948 - DNA, 590 bp, Homo sapiens
  misc_feature: GYAE6OF02GAKZH.12.31.C09.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtagganacaaagtcaccatcacttggccgggctaacggagagtattgccaacgttatttaaagttggtatacaaacaaaagcaaggcaaagtcccaaagcctcctgatttangctgccaccaggtctgacgtaagggttcgggttacccgtctaacggttcacgttcggccgtggactcggagggtaactaagtaatttacctctacacctatcgagttacgtctacgacgtcctagaatattagttgtaccttacttattacctgtcagtcagtacgtacccgctcctccatccgtacgttaccgaccgaaagggccctacggaccgtcgaagtacggttacgggaaccgtaggttacggtcgggtacttaccgggacctaccgattcccgg

SEQ ID NO: 98949 - DNA, 564 bp, Homo sapiens
  misc_feature: GYAE6OF02IWJ63.12.31.C09.1.454.CMB.1.raw
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
  modified_base (559)..(559): a, c, t, g, unknown or other
  misc_feature (559)..(559): n is a, c, g, or t
tcagatacgacgtacacgaccggtgctcgatttagacgtctcatcaaggaaggaagggggcaggagtcagtctcagtcaggtcacagcatggacatgagggtccccgctcagctccgtggggctcctgctactctggctccgaggtgccagatgtgacatccagctgacccagtcctccatccctccctgtctgcatctgtaggagacaaagtcaccatcacttggcccgggactaacggagagtattgccacgttaatttaaattggtaatacaaacaaaaagcaaggacaaagtcccaaagcctcctagatttatgctgcccaccagtctgctaagggtcgggttcccgtanaaggttcacgtggccgtggatcgaagggacaagtaatttactctcaccatcagtatctacngtcctagaagtatattcgtacttactttattactgtacagtctagtacgttaccgcgcctcccatcctacgtttcgaccaacgggaccaaccggacccgtagagtacgttacggaacgtaacgtcggtcggactacgcctaccnttccg

SEQ ID NO: 98950 - DNA, 633 bp, Homo sapiens
  misc_feature: GYAE6OF02GPPR4.12.31.C09.1.454.CMB.1.raw
  modified_base (342)..(342): a, c, t, g, unknown or other
  misc_feature (342)..(342): n is a, c, g, or t
tcagatacgacgtacacgaccggtgctcgatttagacgtctcatcaaggaaggaagggggcaggagtcagtctcagtcaggtcacagcatggacatgagggtccccgctcagcctcctggggctcctgctactctggctccgaggtgccagatgtgacatccagctcgacccagtcctccatccctccctgtcctgctatctggtaggagaacaaacgtcaccatctacgttcggccggactaaacggatagtattcgacctaagttaattttaaagttcggtaactaccaaaacgaaaagcgaaggtaccaaacgtcccaaagtcctaccgtatactttangcctcgccaccgtagtctgacaaggggtttccggtaccctagtaacggttcgagtacgggccgtaggacgtacggaaggactaagttaactttacctctaccactactcgtaacgtacgtaccacgtacacgttagaagtattagttcgttactactttatactgtacagacgtagtacgtcccagtcctcctactcctaccgttaccggaccgtaacggactaccggaccgtcgtaacggtacgtacggaacggttacgtggttccggaccgtacgccgtaccagttccg

SEQ ID NO: 98951 - DNA, 653 bp, Homo sapiens
  misc_feature: GYAE6OF02HE5CG.12.31.C09.1.454.CMB.1.raw
  modified_base (204)..(204): a, c, t, g, unknown or other
  misc_feature (204)..(204): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaaggtgccagatgtgacatccagctgacccagtctccatcctccctgtctgcatctgtagganacaaagtcaccatcacttgccggctaacgagagtatgccaacgttatttaaattggtaactacaaacaaaagcaggacaaagtcccaaagctcctagtattatgctcgccaccagtctagacgtaagggttcgggttacccgtagtaacggttcaacgtcggtaccgtaggactacgaagggactaaggtaactttacctctacaacctagtctagttacgtactaacgacgtccgtagaaagtattacgttcgtacctttaacgtttaattaccgtgttaccaacgtactaacggttacgttacccgccgtaccttacccgtaacttaccgttaccgtttaccgggaaccgtaaacggggaccaaccgggtaacccgcgtaacggttaacgttacgggaaccgttaagttcggttacggaccgttcggaaccctaccgtagttcccgg

SEQ ID NO: 98952 - DNA, 653 bp, Homo sapiens
  misc_feature: GYAE6OF02GZ7W6.12.31.C09.1.454.CMB.1.raw
  modified_base (457)..(457): a, c, t, g, unknown or other
  misc_feature (457)..(457): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggcctccggaggtgccaggatgtgacatccagctcgacccagtcctccatcctcccgtgtctgcatctgtaggagaacaagtccaccatccacgttcggccgggctaacggagacgttagttcgacctaacgttaatttaaagttggtaatacgaaaacaaaaacggccgaaggaaccgtaaacgtaccccaaaaggtccctaccttagaacttttacgcgtactcgacccacctagtctacgacgtacgggtcggttccgacgtaagttcacggtcggtcgtgactacggaggactaagtacttaccgtctaccgacacgtntagtacgtctacgtacacgtagaagtataacgtcgttaacttcgttaacttctagtcacggtacgaacgttaccgttaccgtaccgtcccttacccgtatttacccgttaccgtttaccggaccgtaaggcccgaccgaccggtacagtacggttcggaaccgttacgtcggacggtcacggacctactaccgttc

SEQ ID NO: 98953 - DNA, 700 bp, Homo sapiens
  misc_feature: GYAE6OF02HW9ZH.12.31.C09.1.454.CMB.1.raw
  modified_base (316)..(316): a, c, t, g, unknown or other
  misc_feature (316)..(316): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctcctgtctgcatctgtaggagacaaagtccaccatcacttggccgggactaacgagagtatgacctacgttaatttaaatggtaatacaaaacaaaagcaaggacaaaacgtacccaaagctcctagtaatttangcctgacccaaccgtagttctaggacgtaaggggttccgggtttaccccgtacgtaacgggttccacggttcgggccggttaggacttaccggaggggtaacaaggttaaacttttaccgtacgttacccaacctagttccgtaagtttacgttacctaacgacgtaccgtaagaaacgtacttaattacgtacctttaactttaactttaaccgttgtacgagtacgtaagtaaccggtttacccgaccgttaccctaccctactttaccgtaaccgtttaccggaaacgtaacgggaacccgtaacggacccgaacgacggtaacggttacggaaccggtaacgttcggtaccggtacgtaccggaccctaccgtattccgg

SEQ ID NO: 98954 - DNA, 683 bp, Homo sapiens
  misc_feature: GYAE6OF02ITM9U.12.31.C09.1.454.CMB.1.raw
  modified_base (251)..(251): a, c, t, g, unknown or other
  misc_feature (251)..(251): n is a, c, g, or t
  modified_base (328)..(328): a, c, t, g, unknown or other
  misc_feature (328)..(328): n is a, c, g, or t
tcagatacgacgtacacgaccggtgctcgatttagacgtctcatcaaggaaggaagggggcaggagtcagtctcagtcaggtcacagcatggacatgagggtcccccgctcagctccgtggggcctcctgctactctggctccgaggtgccagatgtgacatcccagctgaccccagtcctccatccctcctgtctgcatctggaggagaacaagtccaccatcacgttgaccgggactaaacgagtattnttcgacctaacgttaatttaagttgtaatacaaacaaaaagcaggactaaacggtacccaaagtcctactagattangactcaccacatcctgtacgtaagggttccggtacccgtagtaacggttacctacgtcggtaccgtggaacgcggtaagggactaagttaacttactcctaccacgtattacgtaacgttaggtacctaacgtcgtaccgtagtaaatacgttagtaccgttacttaccgtttaagttacgttccgtacgtaacggtacctacgggttaaccttacccggccctacccttacccgtaaccttcccgttaaccgtttacccgggaccgtaaccggacccgtaacccggtaccgcgtaacggtacgtaacggaaccgtacgttcggtacgtacccgtggaccctaccgtcgttaccg

SEQ ID NO: 98955 - DNA, 800 bp, Homo sapiens
  misc_feature: GYAE6OF02HABA6.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctccgtggggctcctgctactctggctccgaggtgccagatgtgacatccagctgacccagtcctccactcctccctgtactgcattctgtaggagacaaagtccacatctactcggccggactaaacgagtagtacttcgtacctaacgttaagttttaaacgttggtaactacaaaacgaaaagcgtaaggactaaacgtaccaaagtcctaccgtagtactttagtcgacttcggacctaccgtagttcctacgtacggtaacgggttccgggttaccgttaacgtaaacgggttcctaacggttcgggtacccgggtttaggaacgttacggtaacgggggtaaaccttaaggttaaacctttttacccgtaccgtaacctaaccgttaactccggtaaacgtttacgttccgtaaacgtacggtaccctaaggtaaacgtattaagtacgtttaaccttaacttttacgtttcgtaagttccgaacgtcgttaaaccggtaaccgtttccccggacgttacctaccccgttaagttaccccttacggtttaacccgggaacccttaaacggggacccctacccgggtaaacccggtgttaaacgggtaccggtttacccgggtaaacggttaaccgttggggttccgaccggttaccggaacccgttcgttaccgttacccgg

SEQ ID NO: 98956 - DNA, 810 bp, Homo sapiens
  misc_feature: GYAE6OF02GNUDT.12.31.C09.1.454.CMB.1.raw
  modified_base (203)..(203): a, c, t, g, unknown or other
  misc_feature (203)..(203): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtcctccatcctcctgtctgcatctgtagganacaagtcaccatcctacttcggcccgggtactaacggagtagttattcggacctacgttaatttaaattggtactacaaaacgaaaaagtcaagggactaaaacgtacccgaaaaggtcctacccgtagtacttttatacggtacctacggacccctaaccgtaacgttccgtacggtaaccggtaaacgggggtttccggggtttacccccgtaacggtaaacggggtttaccaccgggttaccgggacccgggttagggaaccttccgggaacggggtaactacggttaaactttaccggtaccttacccgtaacctacgtacctaacggttacgtacccgtaacgtaacgtccgtaaggtaaacgtagttaacgttcggtacttacctttaagttaacctagtctacggaacgttacggtaccggtttacccggtcgtacccttacccgtaaccgttccgtaacccggtttccgggacccgtaaacggggtaccctaacccgggtaccgtaacccggtaacgggttaccggttaacgggaaacccggttaaccggttagggtacccgggtaccgttacgacccggttaacccgtacttaccggg

SEQ ID NO: 98957 - DNA, 752 bp, Homo sapiens
  misc_feature: GYAE6OF02G12A5.12.31.C09.1.454.CMB.1.raw
  modified_base (109)..(109): a, c, t, g, unknown or other
  misc_feature (109)..(109): n is a, c, g, or t
  modified_base (261)..(261): a, c, t, g, unknown or other
  misc_feature (261)..(261): n is a, c, g, or t
tcagatacgacgtacacgaccggtgctcgatttagacgtctcatcaaggaaggaagggggcaggagtcagtctcgagtcaggtcacagcatggacatgagggtccccgntcagctccgtggggctcctgctactctggctccggaggtgccagtatgtcgacactccagtctgacccagtctccatccctccctgtcctgacatacgtgtaggactaacgaaacgtccaacctatccacgttcggacccggtattaaacgngtaagtcttcggacctaagttaatttaagtacggaatacaaaactaaaaggcaaggacaaacgtacaaacgtctacgtgtaattagtcgactgaccactacgtctagaccggtaggtccgggttaccagttaacggtctaccggtggtaccgtaggacgtacggtaacgggaaccttaggttaaaccttaccgtctacccgtaacgtacgttaactacggttaaccgttaccgtaacgaccgtaacctaaggtaaacgtagtttacgtagttaaccgttacctttaacttacggttacgttacggaaacgtactaaacgggttacccgtaacggtaccccgtaccgttacccgttacgttccccgtttaacggtaacccgggtaaccgtaaccggggacccttaaccgggaccctaaaggtaaccggttacggtaacggtaaaccccggtgttacccgggtagtaccgtaccggaacctacgtcttaccgg

SEQ ID NO: 98958 - DNA, 659 bp, Homo sapiens
  misc_feature: GYAE6OF02JDF9A.12.31.C09.1.454.CMB.1.raw
  modified_base (428)..(428): a, c, t, g, unknown or other
  misc_feature (428)..(428): n is a, c, g, or t
  modified_base (475)..(475): a, c, t, g, unknown or other
  misc_feature (475)..(475): n is a, c, g, or t
tcagatacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtcctccatcccttccctgtcctgcatctgtaggagacaagtcaccatcacttcggccgggtactaacggagtagttacttcgacctaacgttaatttaaagttggtaactacaaaacaaaaagcaaggaccaaacgtacccaaagtcctacctagtatttagcgtctcgcccaactgttcaggaccgtaagggttccgggttccctacgtaacggttcacgtggccgtaggactcgagggactaagtaactttacnctaccactatacgtacgttacgtactacacgtacctaggtaaacgtnttacgttcgtaactttactttacgttaacgtcgtacacgtcgtaagttaccgttacccgccgtaccttacctacgttcctaaccggtttaccggaccgtaaccgggtacctaaccggaccgtacgtaaggtacggtaaccggaacgtaacgttggtccgtaccgcgtacccgacttacgttccg

SEQ ID NO: 98959 - DNA, 800 bp, Homo sapiens
  misc_feature: GYAE6OF02GM2XR.12.31.C09.1.454.CMB.1.raw
tcagatacgacgtacacgaccggtgctcgatttagacgtctcatcaaggaaggaagggggcaggagtcagtctcagtcaggtcacagcatggacatgagggtccccgctcagctccgtggggctcctgctactctggctccgaggtgccagatgtagacatccagctacgaccctagtctaccactccctccctgtctgcatcgtagtagagaacaacgtccacatctacgtcggaccggactaacggagtaagttatacgaccgtaagttaatttaaagtggtaaacttaaccgaaaaacgtaaaaagcgtaacggaacctaaaacggttacccccaaaaggtcctacccgttagttaactttaagcgtccgttaccgacccctaagtcgttccgtacggtacggtaacggggttccgggttaccccgtagtaaacggttccgaacggtcggggtaccgttagggaccgtaagggaaccggggtaactaaacggttaaacttttccgtaccgtaacccgtaaccgttaagtaaccgttaagttacccgttaacctaacggtaccgtaccgtaaagggtaaacttagtttacgtttacgtaacccttttaattttaacgttaaccgtacggttaccaaggttactaacgggtaaccctttacgcccgttaccctaccttagtaccccgttacgttacccgggaaccgtaaccgggactaccggtaacccgaggtaacgtaccggttacgggaaccgtaacgttggtaccggtacgaaccgtacccgttagtacttcccgg

SEQ ID NO: 98960 - DNA, 501 bp, Homo sapiens
  misc_feature: GYAE6OF01DM08E.40.81.H04.1.454.CMB.1.raw
  modified_base (493)..(493): a, c, t, g, unknown or other
  misc_feature (493)..(493): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtgaggcagaagatgttgggatttattactgcatgcaacctctacaaactgtgtggacggtcggccaagggaccaggtggaaatcaagcgaacgtgtggctgcaccatctgtcttcntcttcccg

SEQ ID NO: 98961 - DNA, 522 bp, Homo sapiens
  misc_feature: GYAE6OF01AWEJW.40.81.H04.1.454.CMB.1.raw
  modified_base (517)..(517): a, c, t, g, unknown or other
  misc_feature (517)..(517): n is a, c, g, or t
tcagtctagcgactcacgaccggtgctcgatttagtagtgtagattcgcgggacttgtaggtacagggaactcctcaggtttccacccttcgtctacaagtggaggcgtcccctgctcgacgcgtcctggggcctggctaaagtgcttcctgggtctctggatccaggtggggatattaggtgatgaactcagtctccactctccctgcccgtcactcctggagagccggcctccatctcctgcaggtctagtcagagcctcctaaaacactaatggatactactctttgaattggtacctgcagaagccagggcagtctccacagctcttgatatattggggttcttatcgggcctcggggtccctgacaggttcagtggcagtggatcagtcacagattttacactgaaatcagctgggtgaggcagaagatgtgggatttatactgcatgcaacctctacaactgtgtggacggtcggacaagggaccaaggtggaaatcaagcgaactgtggntgacc

SEQ ID NO: 98962 - DNA, 527 bp, Homo sapiens
  misc_feature: GYAE6OF01EJBCL.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatattggggttcttatcgggcctccgggtccctgacaggttcagtggcagtgatcagtcacagattttacactagaaaatcagcgagggtggaggacagaagatggttagggtatttattacgtgacatgcctaacctctaacaaacttgtaggtggacggtcggaccgaagggaccaagggtaggaaatcaagacgaacgtggtaggctgccacatctgtacttcatccgttccccg

SEQ ID NO: 98963 - DNA, 507 bp, Homo sapiens
  misc_feature: GYAE6OF01CY8PT.40.81.H04.1.454.CMB.1.raw
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (498)..(498): a, c, t, g, unknown or other
  misc_feature (498)..(498): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctacagaggtggcacaaagtatcgacagaactttcagggcagggtcaccatgacctgggacgcgtcatcagcacagtctacatggatctgagcgggactggacctagtcgacgacgtacggcatgtatactgtggaagngacgttgnggcaccgtcggggctggaccgntggggaccg

SEQ ID NO: 98964 - DNA, 624 bp, Homo sapiens
  misc_feature: GYAE6OF01DTD5D.40.81.H04.1.454.CMB.1.raw
tcagtctagcgactcacgaccggtgctcgatttagtagtgtagattcgcgggcgtagactttgtgtttctcggtagtcctccctcgctcacgcgtccttgggcttgctaatgctctggtctctggatccagtgggatattggtgtatgactcagttcgttcctacttcttcccttgcccgttcactcctggagaggccggcctccatcgtcctgcagggtctagtcagagccctctaaacgcctaatggatactactctttgaattggtacctgcagaagtccaggcagtctaccacagctcttgatatagttggggttcttacgtcgggccgtccgggtcccgtagacgtaggttctagtgacgagtgatcgtagtcaacagtaatttacgactgaaaatcgaagacgaagggttgaggacagaagtagttggttagggtaattttacttaactaggacctatcgtacctaaaccttcttaacaaacttagttaggtacggacgggttccggaccgaaacgggtaacccgaagggttacggaaacttcgaaagtcgtaaacgttggtaggacgtacggacctaccgaagttcctagggttactttacgagttccgttaccccg

SEQ ID NO: 98965 - DNA, 543 bp, Homo sapiens
  misc_feature: GYAE6OF01CTIKH.40.81.H04.1.454.CMB.1.raw
  modified_base (383)..(383): a, c, t, g, unknown or other
  misc_feature (383)..(383): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcgggtgaaggtctccgtgcaagatttctggaaacaccctgagcaactactacatacactggatgcggcaggcccctggacaggggtttgagtggatggggtgagtcaaccctaccgagaggtggacacaaagtatcgacagactttcgaggcagggtcacntgactgggacgcgtcatcagcacagtctacatggaatcgtgaggtcggactggaccctacgtacgacgaacgacgggacctagtacggtattacgtaggtagggtaagaggtacgttaggtggccgtaaccggcggggctcggaccgtcggtaccggggg

SEQ ID NO: 98966 - DNA, 499 bp, Homo sapiens
  misc_feature: GYAE6OF01BSBGZ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattgggttcttatcgggcctccggggtccctgacaggttcagtggcagtggatcagtcacagattttacactgaaaatcagctgggtgagcagaagatgttggatttattactgcatgcaacctctacaaactgtgtggacggtcggaccaagggaccaagggtggaaatcgaaagcgaactggtggctgacc

SEQ ID NO: 98967 - DNA, 512 bp, Homo sapiens
  misc_feature: GYAE6OF01D2I1U.40.81.H04.1.454.CMB.1.raw
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (484)..(484): a, c, t, g, unknown or other
  misc_feature (484)..(484): n is a, c, g, or t
  modified_base (503)..(503): a, c, t, g, unknown or other
  misc_feature (503)..(503): n is a, c, g, or t
tcagtctagcgactcacgaccggtgctcgatttagtagtgtagattcgcggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggagtcaacctaccagaggtggcacaaagtatcgacagaactttcagggcagggtcaccatgacctgggacncgtccatcagcacngtctacatggatctgagcgggactggacctacgtgacgaacgtacggccagttcgtattacgtgtgaagngacgttggtaggctaccgngggctacgg

SEQ ID NO: 98968 - DNA, 554 bp, Homo sapiens
  misc_feature: GYAE6OF01D2P2O.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtgggatattgtgatgactcagtctccactctccctgcccgtcactcctggagagccggcctccatctcctgcaggtctagtcagacgcctacctaaacactaatgatactactctttagaattggtacctgcagaagccgaggcagtctccacagctcttgatatagttgggttcttagtcggcctccgggtcctgactaggttcagtgcagtggatcgagtcactagtatttacgactagaaatcagcgagggtggagacagaagtagtgttaggtatttagtacgtgactagtcgacctaaccgttactaactaacgttcgtaggtacgggtaccggtcggaccgaaacgggtaaccgaaagggtacgaaaacgtacgaaaggtaccgtaacgtaggtcggactggaaccc

SEQ ID NO: 98969 - DNA, 517 bp, Homo sapiens
  misc_feature: GYAE6OF01AGG1V.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatatattgggttcttagtcgggcctccgggtcctgacaggttcagtggcaggtgatcagtcacagtatttacactagaaatcagcgagggtggagcagaagatggttggtatttattactgcatgactaactctaacaactgtgtaggacggttcggaccgaagggaccaagggtaggaaactcgaaggacgtaacgtggtaggctgccgtaaccg

SEQ ID NO: 98970 - DNA, 510 bp, Homo sapiens
  misc_feature: GYAE6OF01CZ6GK.40.81.H04.1.454.CMB.1.raw
  modified_base (498)..(498): a, c, t, g, unknown or other
  misc_feature (498)..(498): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggtttgagtggatggggtggatcaacctaccagaaggtggcacaaagtatcgacagaactttcagggcagggtcacatgactgggacgcgtccatcagcacagtctacatgatctgagcggatgacctcgtgacgacacggccatgtattacctgtggaaagagaacggttggtggctaccggcggggctaggaccncgtgggacccgg

SEQ ID NO: 98971 - DNA, 505 bp, Homo sapiens
  misc_feature: GYAE6OF01C44AE.40.81.H04.1.454.CMB.1.raw
tcagtctagcgactcacgaccggtgctcgatttagtagtgtagattcgcgggcacgaccggtgctcgatttagtagcgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggccctggacaggggttgagtggagtggggtgatcaaccgtacagaggtggcacgaaagtatacgacagaactttcgagggcagggtcacatgacctgggacgcgtcatcagcacacgtctacatggatcgtgagcggactgacctcgtacgacgacgacggccagtcgtatcgtagg

SEQ ID NO: 98972 - DNA, 384 bp, Homo sapiens
  misc_feature: GYAE6OF01DU0V1.40.81.H04.1.454.CMB.1.raw
  modified_base (374)..(384): a, c, t, g, unknown or other
  misc_feature (374)..(384): n is a, c, g, or t
tcagtctagcgactcacgaccggtgctcgatttagtagtgtagattcgcggggatactactctttgaattggtacctgcagaagccagggcagtctccacagctcttgatatattggggtccttatcgggcctccggggtccctgacaggttcagtggcagtggatcagtcacagatttttacactgaaaatcagcagggtggaggcagaagatgttgggatttattactgcatgcaacctctacagactgtgtggacggtcggacgaagggaccaaggtgaaatcaagcgaactgtggctgcaccatctgtcttcatccttcccgcatctagaagtcgctagactgaggcggggctgggcaaggcgacatagnnnnnnnnnnn

SEQ ID NO: 98973 - DNA, 508 bp, Homo sapiens
  misc_feature: GYAE6OF01CHDM5.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactggacctcgtgacgacacggccatgtatactgtggaagagacgttggtggctaccggcgggctgaccgcgtggggacccg

SEQ ID NO: 98974 - DNA, 525 bp, Homo sapiens
  misc_feature: GYAE6OF01BX4M1.40.81.H04.1.454.CMB.1.raw
  modified_base (465)..(465): a, c, t, g, unknown or other
  misc_feature (465)..(465): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgaggtggagtggggtggatcaacctaccagaggtggcacaaagtatcgacagaactttcaggcagggtcaccatgacctgggacgcgtccatcagcacagtctacatgatctgagcggactggacctagtacgacgacgacggccagtgtattacgngtacggaaggtagacggttggtcggcgtacggcggggtctaggaccacggtggggacccg

SEQ ID NO: 98975 - DNA, 500 bp, Homo sapiens
  misc_feature: GYAE6OF01C6FVN.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatattgggttcttatcgggcctccggggtccctgacaggttcagtggcagtggatcagtcacagtattttacactagaaaatcagcagggtggagcagaagatgtggatttattactgcagtgcaactctaacaactgtgtggacggtcggaccgaagggaccaaggtggaaatcgaagtcgaatggtgctgacc

SEQ ID NO: 98976 - DNA, 524 bp, Homo sapiens
  misc_feature: GYAE6OF01CI7ZM.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcgagggcagggtcaccatgacctgggacgcgtccatcagcacagtctacatggatctgagcgggctggcctacgtgaccgaacgacggccagtgtacttatcggtggaagtaggaacgttgggtcggcgtaccggcggggactggaccagtggggacccg

SEQ ID NO: 98977 - DNA, 525 bp, Homo sapiens
  misc_feature: GYAE6OF01DJH9V.40.81.H04.1.454.CMB.1.raw
  modified_base (181)..(181): a, c, t, g, unknown or other
  misc_feature (181)..(181): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtnactcctggagagccggcctccatctcctgcaggtctagtcagagcctacctaaacactaaatggatactactctttgaattggtacctgcagaagccagggcagtctccacagctcttgatatattgggttcttagtcgggctccggggtcctgactaggttcagtggcagtggatcagtcacagtatttacactagaaatcagcgagggtggagcagagagtgttaggatttatatgctatagcaaccttactaactaacttgtgtaggacggtcggaccgaagggaccgtaagggtagaaagtcgaaaggcgtaaacgtgtcggtactcggcctaccgtacg

SEQ ID NO: 98978 - DNA, 516 bp, Homo sapiens
  misc_feature: GYAE6OF01BVOK4.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttagtcgggtcctccggggtccctgacaggttcagtggcagtggatcagtcacagattttacactagaaatcagcgagggtggaggcagaagatgttggtatttattactgcatgactaacctctaacaactgtgtggacggtcggaccgaagggaccgaaggtaggaaatcgaacgacgaacgtggtacggctcgcacctacg

SEQ ID NO: 98979 - DNA, 381 bp, Homo sapiens
  misc_feature: GYAE6OF01AZLBH.40.81.H04.1.454.CMB.1.raw
  modified_base (323)..(323): a, c, t, g, unknown or other
  misc_feature (323)..(323): n is a, c, g, or t
  modified_base (362)..(363): a, c, t, g, unknown or other
  misc_feature (362)..(363): n is a, c, g, or t
  modified_base (365)..(381): a, c, t, g, unknown or other
  misc_feature (365)..(381): n is a, c, g, or t
tcagtctagcgactcacgaccggtgctcgatttagtagtgtagattcgcggggatactactctttgaattggtacctgcagaagccagggcagtctccacagctcttgatatattggggtccttatcgggcctccggggtccctgacaggttcagtggcagtggatcagtcacagattttacactgaaaatcagcagggtggaggcagaagatgttgggatttatactgcatgcaacctctacagactgtgtggacggtcggcaaggacaaggtgaaatcaagcgaactggtggctgcaccatctgtctcatctcccgcatcngacgtcgctagactgacgcggctggcaaggcacagtagnnannnnnnnnnnnnnnnnn

SEQ ID NO: 98980 - DNA, 509 bp, Homo sapiens
  misc_feature: GYAE6OF01EE7RP.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagagcctcctaaacactaatggatactactctttgaattggtacctgcagaagccagggcagtctccacagctcttgatatattggggttcttagtcgggcctccggggtcctgacaggttcagtggcagtggatcagtcactagtattttacactagaaaatcagcgagggtggaggcagaagatgttgggtatttatactgcatgactaacctctaacaactgtgtggacggtcggacgaagggaccaggtggtaggaaatcgaagacgaactgtggctacg

SEQ ID NO: 98981 - DNA, 514 bp, Homo sapiens
  misc_feature: GYAE6OF01EWPHU.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcaggtggcagtggatcagtcacagattttacactagaaaatcaagctgggtggaggcaagagatggttgggtatttattactgcatgacaacctctaacaaactgtgtggacggtacggaccgaagggaccaagggtggaaatcaaagacgaactgtacggctggacc

SEQ ID NO: 98982 - DNA, 523 bp, Homo sapiens
  misc_feature: GYAE6OF01D1GK3.40.81.H04.1.454.CMB.1.raw
  modified_base (518)..(518): a, c, t, g, unknown or other
  misc_feature (518)..(518): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatagttggggttcttagtcgggcctcgaggggtccctgacaggttcagtggcagtggatcagtcacagtatttacactagaaatcagctgggtggaggcagaagagtgttgggtatttattacgtgctatgacctaactctaacaacgtgtggtcggacggtcggaccgaaaggggacctaagggtacggaaatacgaagacgaagtggtggntacgg

SEQ ID NO: 98983 - DNA, 531 bp, Homo sapiens
  misc_feature: GYAE6OF01CUXTF.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttctggaaacacctgagcaactactacatacactggatgcggcaggcccctggacgaggggtttgagtggagtggggtggatccaacctaccgagaggtgacaacaaagtatcgacagtaactttcgaggcagggtcacatgactgggacgcgtccatcagcacagtctacatggatctgagcgactggacctgtcgacgacgtacggccagtgtatacgtggtaggaagaggtacggttgggtacggcgtaccggcggggtactacggaccgtggtaccggggg

SEQ ID NO: 98984 - DNA, 519 bp, Homo sapiens
  misc_feature: GYAE6OF01C54SX.40.81.H04.1.454.CMB.1.raw
  modified_base (405)..(405): a, c, t, g, unknown or other
  misc_feature (405)..(405): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttggggttcttagtcgggcctccggggtccctgacaggttcagtggcagtggatcagtcacagtatttacactgaaaatcagcagggtgagcagagatgttggatttattacngcatgcaactctaacaactgtgtgggacggtcggaccgaagggaccgaaggtcggaaaatcaaagtcgaaacgtggtaggctgaccacatctagtccttcattcccttaccccg

SEQ ID NO: 98985 - DNA, 515 bp, Homo sapiens
  misc_feature: GYAE6OF01C335R.40.81.H04.1.454.CMB.1.raw
  modified_base (414)..(414): a, c, t, g, unknown or other
  misc_feature (414)..(414): n is a, c, g, or t
  modified_base (503)..(503): a, c, t, g, unknown or other
  misc_feature (503)..(503): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgagtggagtggggtggatcaaccctacagaggtgcacaagtatcgacagaacttcgaggcaggtcacatgactgggacgcgtcatcagcacagtctacatggatcngagcggactgacctcgtgacgacacggccagtcgtatacgtgtaggaagagtacggttggtcgacgtaccgggcgggtactggacccgngtggggacccgg

SEQ ID NO: 98986 - DNA, 577 bp, Homo sapiens
  misc_feature: GYAE6OF01BMXDA.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactctttgaattggtacctgcagaagccagggcagtcctccacagctcttgatatagttggggttcttagtcgggccgttccggggtccctgacgtaggtcaggtggctaggtggatcgagtcacgtagtactttacactagtaaactcagacgagggtggaggacgaagaagtagtggttagggtatttaagttactgactagtacgacctaacctactaactaaacgttggtacggtagggaccgggtacggaccggaaagggaccgtaagggtaggaaactacgaaagaccggaaacgttggtacggactcgaccgaccgtacg

SEQ ID NO: 98987 - DNA, 511 bp, Homo sapiens
  misc_feature: GYAE6OF01CWQ5E.40.81.H04.1.454.CMB.1.raw
  modified_base (502)..(502): a, c, t, g, unknown or other
  misc_feature (502)..(502): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatattggggttcttagtcgggcctccggggtccctgacaggttcagtggcagtggatcagtcacagtattttacactagaaaatcagcgagggtggaggcagaagatgttgggatttattactgcatgacaactctaacaactgtagtggacggtcggacgaagggaccaaggtacggaaatcgaaagcgaacgtggtggctgcacatctgtnttcatctcg

SEQ ID NO: 98988 - DNA, 689 bp, Homo sapiens
  misc_feature: GYAE6OF01DELFM.40.81.H04.1.454.CMB.1.raw
  modified_base (258)..(258): a, c, t, g, unknown or other
  misc_feature (258)..(258): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtctctgcagtattcgaggaaacncctgacgacaactactacatacacgtaggatcggccggcgacggccccgtggacgtaggggttgaggtggaggtggggtgagtaccaaccgacgacggtagggtcggtacgaacgtaaagtaacttacgaacgtaacggtaacctttaccggaacggggtaccggtaacggggtaccgtaaacccgtacgttaccgggaacccggttaccgggggaccgtacccgttaccccgtaacgttaccgaacgggtaccaacccgttacgttaacccgtaaacgtacgttaacgggtaccgtttacgtacgggtacgggacccgggtaccggtaaccggggtaacggtaaaccgggccggtactaaaggtacgggacaacgtacgtccggaaggtacgatacgacgacgacgtagacgtacgacgacgcgtgngng

SEQ ID NO: 98989 - DNA, 508 bp, Homo sapiens
  misc_feature: GYAE6OF01A180A.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattgggttcttatcgggcctccgggtcctgacaggttcagtggcagtggatcagtcacagtattttacactagaaatcagcagggtgaggcagaagatgttgggatttatactgcatgctaacctctaacaacgtgtggtggacggtcggaccgaagggaccaagggtaggaaatcgaaggcgaactggtaggctgcgtaaccg

SEQ ID NO: 98990 - DNA, 516 bp, Homo sapiens
  misc_feature: GYAE6OF01ASPEM.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcgaggcagggtcaccatgacctgggacgcgtccatcagcacagtctacatggatctgagcggactgacctcgtagacgacacggccagtagtattacgtgtggaagaggtcgttggtggccgtaccggcggggactcggaccgcgtcgggg

SEQ ID NO: 98991 - DNA, 702 bp, Homo sapiens
  misc_feature: GYAE6OF01AJMCY.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcagtctccactctccctgcccgtcactcctggagacgcccggcctccatctcctgcaggtctagtcagacgcctacctaaacactaagtggaactactacttctttagaatttggtacctgcagaacgccgagggcagtctccacagctcttgattattagtttcgggttcttacgtccggggccgttccggggtccctggacgtaggtttccgaggtcggctaggtcggtaactcgagttaccgaacgtagttacttttaacaacgttaagtaaaacgttccgtaaggtccgggttaggggtacgggacgggtaacgtaaggtaaaggtagtttagggtttagggttaattttaacgttacgttgtacctagttacgtaacctaaccgttacttaaaccgtaacgttaggttcgggtacgggtaccgggtacgggtaacccggtaaacggggtaaccggtaaaggggttaacgggtaaaacgttaaccggaaacggtaaccggttaacggttagggtcggtaccgtacggtaaaccccg

SEQ ID NO: 98992 - DNA, 529 bp, Homo sapiens
  misc_feature: GYAE6OF01ECK7N.40.81.H04.1.454.CMB.1.raw
  modified_base (449)..(449): a, c, t, g, unknown or other
  misc_feature (449)..(449): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatccgggcctccgggtccctgacaggttcagtggcagtggatcagtcacagtattttacactagaaaatcgagcgagggtggaggcaaggaagagtggttagggtattttattactgctagtgactaaccttntaacaaacttgtagtggacggtcggaccgaagggaccaagggtaggaaatcgaaagacgtaacgtggtggctgctaaccg

SEQ ID NO: 98993 - DNA, 505 bp, Homo sapiens
  misc_feature: GYAE6OF01C7OG4.40.81.H04.1.454.CMB.1.raw
  modified_base (489)..(489): a, c, t, g, unknown or other
  misc_feature (489)..(489): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagtatttacactagaaaatcagcagggtggaggcagaagatgttggatttattactgcatgctaacctctaacaactgtgtggacggtcggccaagggaccagggtgaaatcaagcgaacgtgtgctgcaccatcgtntcttcattcttacccg

SEQ ID NO: 98994 - DNA, 505 bp, Homo sapiens
  misc_feature: GYAE6OF01E0T87.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccgggtccctgacaggttcagtggcagtggatcagtcacagtattttacactagaaatcagcagggtgaggcagaagatgttgggtatttatactgcatgacaactctacaactgtgtggacgggtcggaccgaagggaccaaggtggaaatcaagacgaacgtgtggctgcacatctgtacttcatcttcccg

SEQ ID NO: 98995 - DNA, 510 bp, Homo sapiens
  misc_feature: GYAE6OF01CI0RP.40.81.H04.1.454.CMB.1.raw
  modified_base (502)..(502): a, c, t, g, unknown or other
  misc_feature (502)..(502): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagatttacactgaaaatcagcagggtggaggcagaagatgttgggatttatactgcatgcaactctaacaactgtagtggacggtcggaccaagggaccaagggtaggaaatcgaaagcgaaacgtggtaggctgcaccatctgtacttcntctccccg

SEQ ID NO: 98996 - DNA, 503 bp, Homo sapiens
  misc_feature: GYAE6OF01BCNUF.40.81.H04.1.454.CMB.1.raw
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcgcaggcccctggacgagggtttgagtggagtggggtgatcaaccctaccgagaggtggcacaaagtatacgacagaactttcgaggcagggtcaccatgaccgtgggacgcgtaccatcgagcacagtactacatggatcgtgagcggctaggcctagcgacgtacgacgcagtgtactgtgngacgagnggtgtgacgcgcgggtanagcngnggacg

SEQ ID NO: 98997 - DNA, 666 bp, Homo sapiens
  misc_feature: GYAE6OF01C67UN.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagacgccggcctccatcctcctgcaggtctagtcagagcctacctaaacactaatggatactacttctttgaattggtacctgcagaagccagggcagtctccacagctctgatatagtttgggttcttagtccggccgttccgggtcctgactaggttcagtggctagtgatcgagtcacagtatttacactagaaatcagtacgagggtgaggacaagaagtagttaggttacgggttaatttagtacgtgactagtacgacctaaaccgtactaaaccgtaaacgttgggtacggttacggggtaacccgggtccgggtaaacccggaaacggggtaacccgtaaagggtaacgggtaaaacttacggaaaaccggtaccggtaaaaccggttgggttaccggaaccgttacggtaaccccgaacgttaaccgtttccgttacggtttaaccctttccgtaacccgtttccccgtttaacccccgg

SEQ ID NO: 98998 - DNA, 502 bp, Homo sapiens
  misc_feature: GYAE6OF01B04PV.40.81.H04.1.454.CMB.1.raw
  modified_base (494)..(494): a, c, t, g, unknown or other
  misc_feature (494)..(494): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagagatgttgggatttatactgcatgcaacctctacaactgtgtggacgggtcggaccgaagggaccaagggtggaaatcaagcgaactgtggctgcaccatctgtctcntctccccg

SEQ ID NO: 98999 - DNA, 519 bp, Homo sapiens
  misc_feature: GYAE6OF01B2VQF.40.81.H04.1.454.CMB.1.raw
  modified_base (474)..(474): a, c, t, g, unknown or other
  misc_feature (474)..(474): n is a, c, g, or t
  modified_base (505)..(505): a, c, t, g, unknown or other
  misc_feature (505)..(505): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagtattttacactagaaaatcagcagggtggaggcgagaagatggttgggtatttattactgcatgacaacctctaacaactgtagtggacgggtcggaccgaagggaccgaaggtaggaaanacgaagacgtaactggtggctgccacatctntctcatcttccccg

SEQ ID NO: 99000 - DNA, 603 bp, Homo sapiens
  misc_feature: GYAE6OF01AXRO8.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatcctcctgcaggtctagtcagacgccctacctaaacactaaatggaatactactctttagaattggtacctgcagaacgccgagggcagtcctccacagctctgatatagttgggttcttagtccgggccgtccggggtcctgactaggttcaggtcggctaggtggactcgagtccagagtatttacactagaaaatcagtcgtgggtggaggacgaagaagtagttggttaggtatttagttacgtagtactagtacgtacctaaccttactaaccgtaaacgttggtacggtacgggaccggtaccgggaacccggaacggggtaaccgtaaagggtacggaaaacgtacgaaacggtaccgaacgttagggtacggtcgtacggtaacccg

SEQ ID NO: 99001 - DNA, 614 bp, Homo sapiens
  misc_feature: GYAE6OF01D2JPE.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggtctccgtgacaagtatttcgtaggaaaccaccctgagacaactactacatacactggatggcggcgacggccccgtggacgtaggggtttgaggtggagtggggtgacgtaccgaacccgtacgaggaggtcgacaacgaaagtagtacgaacgagtaacttcgagggtcagggtacacgtagtcgaccgtggacgcgtacagtcgagcactagtcctagagtggactcgtagacgacggacgtacgaccgtgtacggaccgtaacgaccggactagttagtacgttacgtggtaacggtaaggtacggtacgggttcgggacggtaccggtacccgggtcggggtacgtaccggaccggtaccggtcgggggtaaccccgg

SEQ ID NO: 99002 - DNA, 563 bp, Homo sapiens
  misc_feature: GYAE6OF01C17VK.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatatagttgggttcttagtcggcctccggggtccctgacagtcagtgcagtgatcagtcacagtatttacatagaaatcagcgagggtggagcagaagagtagtggtatttatactgactagttagactaaccgtctaacaaacttggtacgtacgggaacgggtccggaccgtaaaacggggaacccgtaaagggtaggaaacgttacgaaacggtaccgtaaacgtacggttacggaccgttacggccgtaacccgttaacg

SEQ ID NO: 99003 - DNA, 511 bp, Homo sapiens
  misc_feature: GYAE6OF01AYKFH.40.81.H04.1.454.CMB.1.raw
  modified_base (459)..(459): a, c, t, g, unknown or other
  misc_feature (459)..(459): n is a, c, g, or t
  modified_base (499)..(499): a, c, t, g, unknown or other
  misc_feature (499)..(499): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtgatcaacctaccagaggtggcacaaagtatcgacagaactttcagggcagggtcaccatgacctgggacgcgtccatcagcacagtctacatggatcgtgagcggactgacctcgtgacgacacggcagtgtattacgngtggagagacgttggaggctacggcggggctaggacccgngtcggggtaccg

SEQ ID NO: 99004 - DNA, 383 bp, Homo sapiens
  misc_feature: GYAE6OF01BWQXR.40.81.H04.1.454.CMB.1.raw
  modified_base (367)..(367): a, c, t, g, unknown or other
  misc_feature (367)..(367): n is a, c, g, or t
  modified_base (374)..(383): a, c, t, g, unknown or other
  misc_feature (374)..(383): n is a, c, g, or t
tcagtctagcgactcacgaccggtgctcgatttagtagtgtagattcgcggggatactactctttgaattggtacctgcagaagccagggcagtctccacagctcttgatatattggggtccttatcgggcctccggggtccctgacaggttcagtggcagtggatcagtcacagattttacactgaaaatcagcagggtggaggcagaagatgttggatttatactgcatgcaacctctacagactgtgtggacggtcggaccaagggaccaaggtggaaaatcgaaagcgaactgtggctgccaccatctgtcttcatccttcccgcatctgaagtcgctagactgagcgggctgggcaagggcncagtagnnnnnnnnnn

SEQ ID NO: 99005 - DNA, 757 bp, Homo sapiens
  misc_feature: GYAE6OF01DSLHK.40.81.H04.1.454.CMB.1.raw
  modified_base (743)..(743): a, c, t, g, unknown or other
  misc_feature (743)..(743): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagagccgtggggcctcggtgaaggtctccgtgacaagtatttcgtaggaaaaccacccgtagacgacaaactactaacatacacgttggatggcggcgacggcccctaggacgtaggggttttgaggtgggtaaggtgggggtaggactacccgaaacccgttaccgaagggacgggtcggacaaacgtaaaaggtactccggaaacgtaacgttaaacgttttcggaacggggtccggtaacgggggttacccaacccgtaacgttacggtaaacccgggtacgggggtaaccggtacccgggttacccaacgttaccgaacggtaccctaaaccgtaacggttacccttaaaccgaaggtttacgggtaacgttacccggttagggaaaccgggtccggggtaaccgtacgggtaacccgttaaccggtacggtaaccgtaaaccggtaccgggacctagtacgttaactttaacgtggttaaggaaacggtaggtaacggttggtacggtaccgtaacccgggngggttcgaaccggg

SEQ ID NO: 99006 - DNA, 557 bp, Homo sapiens
  misc_feature: GYAE6OF01CXQM7.40.81.H04.1.454.CMB.1.raw
  modified_base (231)..(231): a, c, t, g, unknown or other
  misc_feature (231)..(231): n is a, c, g, or t
  modified_base (389)..(389): a, c, t, g, unknown or other
  misc_feature (389)..(389): n is a, c, g, or t
  modified_base (423)..(423): a, c, t, g, unknown or other
  misc_feature (423)..(423): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagcccggcctccatcctcctgcaggtctagtcagancctacctaaacactaatggatactactctttgaattggtacctgcagaagccaggcagtctccacagctcttgattatagttggggttcttagtccgggtccgttcccggggtccctaggacgtaggtttcgaggtcggacgtaggtggatcagtcanagttatttacactagaaatcagcgagggtggagngaagaagagttggttagggtaattttagtactgactagtcgactaacctactaacaacgtgtaggtcggacggtacggaccgaaagggaccaagggtacggaaactacgaagtacgtacgtggcgcgtgaaccg

SEQ ID NO: 99007 - DNA, 527 bp, Homo sapiens
  misc_feature: GYAE6OF01AG0ZH.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaaacactaatggatactactctttgaatttggtacctgcagaagccagggcagtctccacagctcttgatatattggggttcttagtcgggcctccggggtccctgacaggttcagtggcagtggatcagtcacagtattttacactagaaaatcagcgtgggtggaggcagaagtatggttgggtatttattactgactatgacaacctctaacaactgtgtggtacggtcggaccgaagggaccaagggtggaaactcgaaaggacgaacgtggtcggcgtgacccg

SEQ ID NO: 99008 - DNA, 384 bp, Homo sapiens
  misc_feature: GYAE6OF01ESGAP.40.81.H04.1.454.CMB.1.raw
  modified_base (238)..(238): a, c, t, g, unknown or other
  misc_feature (238)..(238): n is a, c, g, or t
  modified_base (309)..(309): a, c, t, g, unknown or other
  misc_feature (309)..(309): n is a, c, g, or t
  modified_base (366)..(384): a, c, t, g, unknown or other
  misc_feature (366)..(384): n is a, c, g, or t
tcagtctagcgactcacgaccggtgctcgatttagtagtgtagattcgcggggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgtggatttatactgcatgcaacctntacaaactgtgtggacggtccggccaaagggaccaaggtggaaatcaaagcgaactgtggctgcaccatcngtctcatctcccgcatctagagtcgctagactgagcgggctggacaaggcacatagnnnnnnnnnnnnnnnnnnn

SEQ ID NO: 99009 - DNA, 500 bp, Homo sapiens
  misc_feature: GYAE6OF01ECYLT.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagatttacactgaaaatcagcagggtgaggcagaagatgtgggatttattactgcatgcaactctaacaactgtagtggacggtcggccaagggaccaaggtggaaatcaagcgaacgtgtggctgcaccatctgtcttcatctccccg

SEQ ID NO: 99010 - DNA, 528 bp, Homo sapiens
  misc_feature: GYAE6OF01C28M5.40.81.H04.1.454.CMB.1.raw
  modified_base (519)..(519): a, c, t, g, unknown or other
  misc_feature (519)..(519): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttagtcgggcctccggggtccctgacaggttcagtggcagtggatcagtcacagtattttacactagaaatcgagcgagggtaggaggcaggaagtagtggttgggtaattttagttactgtcatgacctaaccctctaacaactggtaggtggacggtcggaccgaagggaccagggtagaaatcgaaagcgaacgtgtggctgcacatctgtcttcnttcctcccg

SEQ ID NO: 99011 - DNA, 616 bp, Homo sapiens
  misc_feature: GYAE6OF01CFL22.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgcaggtctagtcagacgcctacctaaacactaatggatactactctttagaattcggtacctgcaagaacgccgagggcagtcctaccacagtctcttagatattagttggggttcttagtccgggtccgtccggggtcctagacgtaggttcaggtggctaggtggtatcagtcaacgtagtactttaacaactagtaaaatcgagcgaggggtggaggacaaggaagtagttagggtttaggttaatttaattacgtgacagtacgacctaaacctactaacgtaacttggtacggtacggtaccgggtaccgggaaccggtaaacggggtaaccgtaaaggggtaaggaaaacttaacggaaacggtacggtaacgttaggggtcgtccgtcgtacccg

SEQ ID NO: 99012 - DNA, 540 bp, Homo sapiens
  misc_feature: GYAE6OF01A3KM9.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatcctcctgcaggtctagtcagagcctacctaaacactaatggatactactctttgaattggtacctgcagagccagggcagtctcacagctcttgattatagttggggttcttagtccggggtccctccggggtccctgacgtaggttcaggtggcagtggatcgagtacacagtatttacactagaaatcagcgagggtggaggcaaggagagtggttaggtatttagtactgactagtgacctaaccttactaactaacgtgtggtaggaccggtcggaccgtacgggaccgtaagggtgaaatacgaagtccgaacgtggtcggctgacc

SEQ ID NO: 99013 - DNA, 507 bp, Homo sapiens
  misc_feature: GYAE6OF01B2SF4.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtcctgacaggttcagtggcagtggatcagtcacagattttacactagaaaatcagcagggtggaggcagaagatgttgggatttatactgcatgcaacctctaacaactgtgtggacggtcggaccgaagggaccaagggtggaaatcgaaaggtcgaacgtgtcggctggacc

SEQ ID NO: 99014 - DNA, 527 bp, Homo sapiens
  misc_feature: GYAE6OF01BJAUH.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggggcctcggtgaaggtctcctgcaagatttctggaaacaccctgagcaactactacatacactggatgcggcaggcccctggacagggggtttgaggtggatggggtggatcaaccctacagaggtggcacaaagtatcgacagaactttcagggcagggtcaccatgacctgggacgcgtccatcagcacagtctacagtggatctgagcgggactcgacctcgtgacgacgacggccagtgttagtacgtgtaggaagaggtacggttggtggaccgtaccggcggggactcggccgcggtccgggg

SEQ ID NO: 99015 - DNA, 526 bp, Homo sapiens
  misc_feature: GYAE6OF01APZJR.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctaacatggatcgtgacgcggactgacctagtcgacgacgacggacatgtatacgtggtagaagagtacggttggtacggcgtacccggcgggtactaggaccgagtcggggacccgg

SEQ ID NO: 99016 - DNA, 514 bp, Homo sapiens
  misc_feature: GYAE6OF01D0UNI.40.81.H04.1.454.CMB.1.raw
  modified_base (502)..(502): a, c, t, g, unknown or other
  misc_feature (502)..(502): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactcttgaattggtacctgcagaagccagggcagtctccacagctcttgatatagttgggttcttatcgggcctccgggtccctgacaggttcagtggcagtggatcagtcacagtatttacactagaaaatcagcgagggtgaggcagaagtatggttagggtatttattactgctagtgactaactctaacaatgtgtggacggtcggaccaagggaccaagggtgaaatcgaagcgaagtgtggctgacacatctagtcttcnttccgtaccccg

SEQ ID NO: 99017 - DNA, 515 bp, Homo sapiens
  misc_feature: GYAE6OF01DJVN2.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggccctggacaggggtttgaggtggagtggggtggatcaaccctaccagaggtggcacgaaagtatcgacagaactttcagggcagggtcacatgaccgtgggacgcgtccatcagcacagtctacatggatctggagcgggactcggacctacgtcgacgacacggccagtgtatactggtggaagtagacgttggtagcgtacggcgggcgtacgg

SEQ ID NO: 99018 - DNA, 532 bp, Homo sapiens
  misc_feature: GYAE6OF01AOZOS.40.81.H04.1.454.CMB.1.raw
  modified_base (454)..(454): a, c, t, g, unknown or other
  misc_feature (454)..(454): n is a, c, g, or t
  modified_base (465)..(465): a, c, t, g, unknown or other
  misc_feature (465)..(465): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttctggaaacacctgagcaactactacatacactggatggcggcacggccccgtggacgtaggggtttgaggtggagtggggtggactaccgaaccctaccgaggacggtggacaacgaaagtatacgacaagtaactttcgagggtcgagggtacacgagtcgaccgtgggacgcgtcagtcagcacgagtctacagtgatnagacgcgtacngacctcgcgacgacgacgccatcgtatagtgtggagagtacggttggtacgcgtcggcgggtgtcgg

SEQ ID NO: 99019 - DNA, 521 bp, Homo sapiens
  misc_feature: GYAE6OF01A3GP3.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatatattgggttcttagtcggcctccgggtcccgtgacgaggttcagtggcagtggatcgagtcactagtatttacactagaaatacagacgagggtggaggcgaagaagtatggttggtatttagttactgacatgactaacctctaacaactgtgtaggacggtcggaccgaagggacgaaggtgaaactacgaagacgaacgtgtggcgtgaccg

SEQ ID NO: 99020 - DNA, 556 bp, Homo sapiens
  misc_feature: GYAE6OF01ATMVP.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgaggtggagtggggtggatcaaccctacgagaggtggacacgaaagtatcgacagaactttcgagggcagggtcacagtcgaccgtgggacgcgtccatcagcacagtctacagtggatcgtggacgcggactgacctcgtacgaccgacgacggcctagtgttattacgtggtaggaagtaggtacggttgggtcggaccgtacccgggcggggtactacggacccgtacggtcggggtaacccggg

SEQ ID NO: 99021 - DNA, 517 bp, Homo sapiens
  misc_feature: GYAE6OF01DGRQI.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtgggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatatagttggggttcttagtcgggcctccggggtccctgacaggttcagtggcagtggatcagtcacagtattttacactagaaatcagcgagggtggaggcagaagagtgttagggtatttatactgcatgacaactctaacaactgtgtggacggtcggaccgaagggaccaaggtagaaatcgaaagcgaacgtgtgctgacacatctgtacttcatccttacccg

SEQ ID NO: 99022 - DNA, 529 bp, Homo sapiens
  misc_feature: GYAE6OF01C53P8.40.81.H04.1.454.CMB.1.raw
  modified_base (475)..(475): a, c, t, g, unknown or other
  misc_feature (475)..(475): n is a, c, g, or t
  modified_base (516)..(516): a, c, t, g, unknown or other
  misc_feature (516)..(516): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgtaggggttgagtggagtggggtggatcaaccctacagaggtggcaacgaaagtatacgacagtaactttcgagggcagggtcaccagtgaccgtgggacgcgtcatcagcacagtcacatggatcgtagagcggactgacctcgtagacgactacggcctagtcgttatactggngaagtagaggttgggcgcgtaccggcggggtctacggaccnggtggggacccgg

SEQ ID NO: 99023 - DNA, 496 bp, Homo sapiens
  misc_feature: GYAE6OF01DD4TI.40.81.H04.1.454.CMB.1.raw
  modified_base (486)..(486): a, c, t, g, unknown or other
  misc_feature (486)..(486): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggccctggacagggtttgagtggatgggtggatcaacctacagagtgcacaaagtatcgacagaactttcaggcagggtcaccatgactggacgcgtcatcagcacagtctacatggatctgagcggactgacctcgtgacgacacggaccatgtattactgtaggaagagacgtggtggctaccgcgggctagaccngtgggaccgg

SEQ ID NO: 99024 - DNA, 538 bp, Homo sapiens
  misc_feature: GYAE6OF01DYJRT.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgagtggagtggggtggatcaaccctaccagaggtggcacaaagtatcgacagaactttcgagggcagggtcaccagtcgaccgtgggacgcgtccagtcagcacagtctacatggatctgagcggactcggacctcgtacgacgacgacggaccagtgtattactaggtaggaaagaggtacgttgggtggtacgtaccggcggggcttcggaccgcggtaccggggg

SEQ ID NO: 99025 - DNA, 541 bp, Homo sapiens
  misc_feature: GYAE6OF01BPKCN.40.81.H04.1.454.CMB.1.raw
  modified_base (458)..(458): a, c, t, g, unknown or other
  misc_feature (458)..(458): n is a, c, g, or t
  modified_base (532)..(532): a, c, t, g, unknown or other
  misc_feature (532)..(532): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcgggtgaacggtctccgtgcaaggtatttctaggaaaccaccctgacgcaactactacatacactggatggcgcacggccctaggacgaggggttgagtggagtggggtgatccgaaaccctacgaggaggtcggacaacgaaagtcgtacgacaagtaacttcgagggacagggtcaacgatcgacgtgggacncgtcagtcacgcacagtactacagtggatcgtagacggtcggactaggaccgtacgcgacgacgtacggcagtntagttgacg

SEQ ID NO: 99026 - DNA, 535 bp, Homo sapiens
  misc_feature: GYAE6OF01B4PS7.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcgggtgaaggtctcctgcaagatttctggaaacaccctgagcaactactacatacactggatgcggcaggcccctggacaggggtttgagtggatggggtgactcaacctacgagaggtggcaacgaaagtatcgacagtaactttcgagggcagggtcaccgagtgaccgtgggacgcgtccatcagcacgagtctacagtggatcgtagaggcggtactcgacctcgtgaccgacacggccagtgtacttactggtaggaagaggtacggttgggtcggacgtacccgggcggggcgtacggg

SEQ ID NO: 99027 - DNA, 693 bp, Homo sapiens
  misc_feature: GYAE6OF01DI1ZP.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagacgccggcctccatctcctgcaggtctagtcagagcctacctaaacactaatggatactactctttagaattggtacctgacagaagccgagggcagtctaccacagtctcttgatatagttgggttcttacgtcgggccgtcccggggtcctggacgtaggtttcaggtcggacgtaggtcggatcagtcaacgtagtaacttttacaacgtaagaaaatcgagcgtaggggtacgggaggacgaaggaagtagttagggtttagggtaattttaagttaacgtcgtaacgtaacgtacgtaaccctaaacccttacgtaaaaccgtaaacgtttgggtacggtacgggtaacccgggggttaccggaaaccggggtaaacgggtaaccgggtaaaggggtaacgggtaaaaacttacggaaacggaacgggtaaaccgttggggtacgggaccctaggaccctaacccggtacttcgttacgttcccttacttaccgtcccgtttaccccgg

SEQ ID NO: 99028 - DNA, 597 bp, Homo sapiens
  misc_feature: GYAE6OF01BJ7LG.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggaccaggggtttgaggtggagtggggtggatacaaccctacgagaggtggacacgaaagtatacgacagaactttcgaggcagggtcaccgagtcgaccgtggacgcgtacagtcgacgacacgacgtactacgagtcggtactcgtggacggcggtaacgtacggtacccgtacggtacgaccgtaacgacggactacgtagtaacgttacgtaggtagggaacgtaggtacggttcgggtacggtacgttaaccgggccggggtacgttacggacccgacgggtcggggaaccccggg

SEQ ID NO: 99029 - DNA, 485 bp, Homo sapiens
  misc_feature: GYAE6OF01DYA66.40.81.H04.1.454.CMB.1.raw
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (461)..(462): a, c, t, g, unknown or other
  misc_feature (461)..(462): n is a, c, g, or t
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (476)..(477): a, c, t, g, unknown or other
  misc_feature (476)..(477): n is a, c, g, or t
  modified_base (480)..(480): a, c, t, g, unknown or other
  misc_feature (480)..(480): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggagtggggtggatcaaccctaccagaggtggcacaaagtatcgacagaactttgagggcagggtacacatgaccgtgggacgcgtccatcagcacagtcacatggatctgagcggctgacngtcgacacacggcatnatatgngagnngtgngcgtcgnggnngcngtcgg

SEQ ID NO: 99030 - DNA, 529 bp, Homo sapiens
  misc_feature: GYAE6OF01BR8Q6.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgaggtggatggggtggatcgaaccctaccagaggtgcacaaagtatcgacagaactttcgaggcaggtcacatgacctgggacgcgtcatcagcacagtctacatggatcgtgacgcggactcgacctctagacgacacggccagtgtattacgtggtaggaagaggtacggttgggtcggtaccgtaccgggcggggactcggcccgacggtccggggg

SEQ ID NO: 99031 - DNA, 512 bp, Homo sapiens
  misc_feature: GYAE6OF01ERPHH.40.81.H04.1.454.CMB.1.raw
  modified_base (297)..(297): a, c, t, g, unknown or other
  misc_feature (297)..(297): n is a, c, g, or t
  modified_base (377)..(377): a, c, t, g, unknown or other
  misc_feature (377)..(377): n is a, c, g, or t
  modified_base (391)..(391): a, c, t, g, unknown or other
  misc_feature (391)..(391): n is a, c, g, or t
  modified_base (507)..(507): a, c, t, g, unknown or other
  misc_feature (507)..(507): n is a, c, g, or t
tcagtctagcgactcacgaccggtgctcgatttagtagtgtagattcgcgggcacgaccggtgctcgatttagtaggtgtagattcgcggggagagcatcacccagcaaccacatctgtcctctagagaatcccctgagagctccgttcctcaccatggactggacctggaggatcctcttcttggtggcagcagccgcagggagcccactcccaggtgcagctggtgcagtctggggctgaggtgaagaagcctggggcctcggtgaaggtctcctgacaagatttctggaaaccnccctgacgcaactactacatacactggatgcggcaggccctggacaggggtttgagtggagtggggtgatcaacctcagnggtgacacaaagtntcgaacagaacttcgagggcagggtcacgatgaccgtggacgtcgtccatcagcactagtctacatggatcgtgacggcggtacgtggactacgcgaacgacgtacggacagtgtntgtag

SEQ ID NO: 99032 - DNA, 687 bp, Homo sapiens
  misc_feature: GYAE6OF01C1G3F.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagacgccggcctccatcctcctgcaggtctagtcagacgcctaccaaaacactaatggactacttacttctttgaattcggtacctgcaagaacgccgagggcacgtcctaccacagtcttcttagattagttaggtttcggggttcttacggtccgggtcccgttccggggtccctaggacgtaggttcgaggtggacgtaggtcggactcgtagtacctagtaagttaactttaacaacgttaagtaaaacgtcgaaggacgggtaaggggtaggaagggacgtaaaggtaaaggttaggtttagggttttaagggttaacttttaacgttaacgtcggtaacttacgtacgtaccttaaccgttaacgttaacgtaacggttggtacgggtacgggtaccgggtaccgggaaccggtaaacgggtaacggtaaagggtaacgaaaacgtacggaaacggtacggtaacggttggtacgcgtccgtaacccg

SEQ ID NO: 99033 - DNA, 526 bp, Homo sapiens
  misc_feature: GYAE6OF01AOMGS.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcacatgacctgggacgcgtccatcagcacagtctacatggatcgtgagcggactggacctcgcgaccgacgacggaccagtgtattacgtgtaggaagcggtacgttgggcggtacgtaccggcggggctcggaccgtcggtaccggggg

SEQ ID NO: 99034 - DNA, 503 bp, Homo sapiens
  misc_feature: GYAE6OF01APMN6.40.81.H04.1.454.CMB.1.raw
  modified_base (354)..(354): a, c, t, g, unknown or other
  misc_feature (354)..(354): n is a, c, g, or t
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggagtgggggtggatcaaccctaccagaggtgcacaaagtntcgacagactttcgaggcagggtcaccatgacctgggacgcgtcatcagcacagtctacatggatctgagcggactggacctagtcgacgacacggcatgtattacgngtggagagcgttggngcgtacggcgggtancgcgcgtcggg

SEQ ID NO: 99035 - DNA, 517 bp, Homo sapiens
  misc_feature: GYAE6OF01EQLQ7.40.81.H04.1.454.CMB.1.raw
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (511)..(511): a, c, t, g, unknown or other
  misc_feature (511)..(511): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactctttgaattggtacctgcagagccgagggcagtcctccacagtctctgattatagtttgggttcttagtccgggtccgtccggggtccctgactaggttcaggtggctagtgatcagtcatagtatttacactagaaatcagcgagggtggaggacagaagtntggtgtattatangacatgactactactaactaactgtagtcggacggtcgaccgaaggacgaaggtagaagtcgaagacgagtcggagctcgcncgtacg

SEQ ID NO: 99036 - DNA, 551 bp, Homo sapiens
  misc_feature: GYAE6OF01EWI8G.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagagcctactaaacactaatggatactacttctttagaattggtacctgcagaacgccagggcagtctccacagctcttgatattagttggggttcttagtccgggccgttccggggtccctgacgtaggttcaggtggactaggtggactcgagtcacgtagtacttttacactagaaactcgagcgagggtggaggcgaagaagtagtggtttaggtaatttattacgtgactatcgactaacctactaactaacgtgtaggtcggacggtccggacgaaacgggtacgaaggtgaaatcgaagacggtaacgtgcggctgacc

SEQ ID NO: 99037 - DNA, 464 bp, Homo sapiens
  misc_feature: GYAE6OF01CXOEA.40.81.H04.1.454.CMB.1.raw
  modified_base (426)..(426): a, c, t, g, unknown or other
  misc_feature (426)..(426): n is a, c, g, or t
  modified_base (454)..(464): a, c, t, g, unknown or other
  misc_feature (454)..(464): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggggcctcggtgaaggtctcctgcaagatttctggaaacaccctgagcaactactacatacactggatgcggcaggcccctggacgaggggtttgagtggagtggggtgatcaaccctacgagaggtggcaagaaagtatacgacagaactttcgagggcagggtcacatgacctgggacgcgtccatcagcacagtctacagtggatcgngagcgggctgggacaagggcgcagtagnnnnnnnnnnn

SEQ ID NO: 99038 - DNA, 525 bp, Homo sapiens
  misc_feature: GYAE6OF01EJMWS.40.81.H04.1.454.CMB.1.raw
  modified_base (514)..(514): a, c, t, g, unknown or other
  misc_feature (514)..(514): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttggggttcttagtcgggtcctccggggtccctgactaggttcagtggcagtggatcagtcacagtatttacactagaaaatcagcgagggtggagcagaagatggtaggtatttattactgctatgactaacctactaacaactgtaggtcggacggtcggaccgaagggaccaagggtagaaatcgaaggacgaagtgtggctgacacatctagtcttcnttccgtacccg

SEQ ID NO: 99039 - DNA, 551 bp, Homo sapiens
  misc_feature: GYAE6OF01C43U8.40.81.H04.1.454.CMB.1.raw
  modified_base (431)..(431): a, c, t, g, unknown or other
  misc_feature (431)..(431): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtggggcctcgggtgaaggtctcctgcaagtatttctggaaacaccctgagcaactactacatacactggatgcggcaggcccctggacaggggtttgagtggatggggtgatcaaccctacaggaggtggcaacgaaagtatcgaacagtaactttcgaagggcaagggtcaccgatcggaccgtgggacgcgttccgatcagcacgagtctaacngtgatcgtagaggcgacgtgacctcgtgaaccgacacggccagtgtattaccgtagtggaagtagaggttcggtgggtcctaaccggcggggactggaacccgtaggtcggggtacccgg

SEQ ID NO: 99040 - DNA, 538 bp, Homo sapiens
  misc_feature: GYAE6OF01ATKJZ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagagcctacctaaacactaatggatactactctttgaattggtacctgcagaagccagggcagtctccacagctcttgatatagttggggttcttagtcgggcctccggggtccctgactaggttcagtggcagtggatcagtcacagtattttacactagaaatcagcgagggtggagcagaagattggttaggtatttatactgactagtcgtacaaccttactaacaacgtgtcggtcggtacggtccggaccgaacgggaccgaagggtacggaaatacgaagtaccgaacgtggtacggcgtgacccg

SEQ ID NO: 99041 - DNA, 630 bp, Homo sapiens
  misc_feature: GYAE6OF01CL22S.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgattattagtttgggttcttagtccgggtccgtccggggtcctgacgtaggttcaggtggcaggtggatcgagtcacgtagttactttaacaactagaaactcgaagtcgagggtaggaaggacgaaggaaggtagttagggttagggttaattttaacgttaacgtagtacgtaagtacggtaacctaaacccgttacttaaacgtaaacgttggttacggtacgggtaaccgggttaccggaaccggaaacggggtaaccggtaaagggtaaggaaaacgtacgaaacggtacgtaaacgtggtacggacgtacgaccgtaaccgtaacg

SEQ ID NO: 99042 - DNA, 529 bp, Homo sapiens
  misc_feature: GYAE6OF01BDHFY.40.81.H04.1.454.CMB.1.raw
  modified_base (509)..(509): a, c, t, g, unknown or other
  misc_feature (509)..(509): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgaggtggatggggtgatcaacctacagaggtgacacaaagtatcgacagaactttcaggcaggtcacatgacctgggacgcgtccatcagcacagtctacatggatctagagcggactggacctacgtacgaccgacgaccggtacagtagtattaccgtggtaggaagaggtcggttggtggaccgtaccgggcgggnttcggaccgcggtacggggg

SEQ ID NO: 99043 - DNA, 635 bp, Homo sapiens
  misc_feature: GYAE6OF01D2JXV.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctggtgaaggtctccgtgcaagatttcgtaggaacacctgagacaactactacatacactggatgcggcacggccctggacgtaggggtttgaggtgggagtggggtaggataccgaacccgtacgaggaggtcggacaacgaaaggtactacggaactaagtaactttcgaagggcgtaaggggtaccaacgtagtacggaccgtcgggaccgtccggtaccagtccaagcaacagtactacagtaggacttcgtaggacgcgggtacgtacggtaccctacggtcgaaccgacgaacgggacctaagttacggtaacttcgtaggtagggtaaacggtaggtacggttcgggtacgggaccgttaccggggacggggtacctacggtacccgtacgggtccgggggaacccgg

SEQ ID NO: 99044 - DNA, 514 bp, Homo sapiens
  misc_feature: GYAE6OF01A0E0P.40.81.H04.1.454.CMB.1.raw
  modified_base (505)..(505): a, c, t, g, unknown or other
  misc_feature (505)..(505): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaggtctctgcaagatttctggaaacacctgagcaactactacatacactggatgcggcaggcccctggacaggggtttgaggtggagtggggtgatcaacctaccagaggtgacacgaaagtatcgacaagaactttcgagggcgagggtcaccatcgaccgtgggacgcgtcatcagcacagtctacatggatcgtagaggcggctggacctacggcgaccgagtacggcatgtactagacgtaggagaggacgtggtcggacgtacggnggcgtacgg

SEQ ID NO: 99045 - DNA, 654 bp, Homo sapiens
  misc_feature: GYAE6OF01DEXWJ.40.81.H04.1.454.CMB.1.raw
  modified_base (298)..(298): a, c, t, g, unknown or other
  misc_feature (298)..(298): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctaaagaatccctgagagctccgttcctcaccatggactggacctggaggatcctcttcttggtggcagcagccgcaggacgcccactcccaggtgcagctggtgcagtcgtggggctggaggtgaagagccgtggggcctcggtgaaggtctcctgacaagatttcgaggaaaccnccctgacgacaactactacatacacgtggatgcggcgacggccctggacgtaggggttgaggtggaggtggggtgactaccgaacccgtacgaggtacgggtcgacaacgtaaagtactaccggaacgtacgtaaacgtttcggaacggggtacgaacggggtacctaaccgtacggtacggacccgttacggggacccgtacccggtccgtaacgtccgaacgacccgtacgtacggttacctacgaacgttacgggacttaccggtaggacgggtccggtaccgtacggtacccgttacggtaccggaaccgtaccgaccggtacctagttacgttacttacggtggtaacggg

SEQ ID NO: 99046 - DNA, 566 bp, Homo sapiens
  misc_feature: GYAE6OF01DCHJ4.40.81.H04.1.454.CMB.1.raw
  modified_base (508)..(508): a, c, t, g, unknown or other
  misc_feature (508)..(508): n is a, c, g, or t
tcagtctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctaggaaacacctgagacaactactacatacactggatgcggcacggcccgtggacgtagggttgagtggagtgggtggatacaaccctacgagacggtggacagaaacgtatacgaacgaacgtaactttcgagggacgagggtacaccaagtcgaaccgtgggaaccgccgtaccaagtcgaacgacacgagtctaacgagtggatcgtagagtcggactacggacgtacgtagacgacgtacgccgatcggtatacgtagnggtaagagtaaccggttggcggtacctcgggaccggcgtacgaccgtgtcgggaccgg

SEQ ID NO: 99047 - DNA, 890 bp, Homo sapiens
  misc_feature: GYAE6OF01D8ZMV.40.81.H04.1.454.CMB.1.raw
  modified_base (227)..(227): a, c, t, g, unknown or other
  misc_feature (227)..(227): n is a, c, g, or t
tcagtctagcgactcacgaccggtgctcgattttagtagtgtagattcgcgggcggtagactttgtgtttctcgtagtctccctgctcagctcctcggggcctgcttaatgctctggttctctggactccagtggggactattgtgatgactcagtctccacgtctccctgcccgtcacctcctggagagtccggcctccatcgtcctgcgacgtctagtcaggacncctacctaaacacgtaatcggatactactctttgaagttgtactgactaggaacgccaagggcacgtacgtaccggacagtcgttcgttaggtacttaagttacgtttacgggggtttactttaaggtccgggggtacccgttaccgggggttccccgtaggtacctaacgggtttacctaggttcggggaccgtacgggtttagggaacgttaccgaacggtttacctaaaccgtaagttaacttttttaaccaaaccgtttaaggaaaaaacttccggaacggtaccgaaaggggtacggaacggtaacgtaaggtaaagttaaggttagggtttaaggttaaacgttttaacgtttaacgtacgggtactaacggtttaacgaacccgtaaaccccgttaaccgttaaacctaaaccgggttggttaccggggtttaacggggttaaccggggtttcccgggaaacgggtaaaccgggggtaaccgggtaaaacggggttaaacggggtaaaacgttaaccggaaacggttaaaacccggttaaccggttacggttaaccggtacccggtttaacggaccccttaaaccggtacgtttacccggtttacgggtttaacccggtttaccggtaaccggtttcccccggttaaccccccggg

SEQ ID NO: 99048 - DNA, 527 bp, Homo sapiens
  misc_feature: GYAE6OF01EBQKH.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtgatcaaccctaccgagaggtgcacaaagtatcgacagaactttcgaggcagggtcaccatgacctgggacgcgtccatcagcacagtctacatggatctgagcggactgacctacgtgaccgacgtacggccagtagtagttactggtaggaaggaggtacggttagggtggcgtaccggcggggctcggaccgacggtacgggg

SEQ ID NO: 99049 - DNA, 563 bp, Homo sapiens
  misc_feature: GYAE6OF01CF92G.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagacgcctacctaaacactaatggatactacttctttagaattggtacctgacaggaacgccgagggcagtcctcacagtctcttgattatagttgggttcttagtccgggccgtccggggtcctgactaggttcagtggcagtggatcagtcactagtatttacatagaaatcgagcgtagggtaggagtagaagtgtggttaggtatttagttactgctatcgacctaacctctaaactaagttggtaggtacggtacggtaccggaccgaaacgggaccgtaagggtacggtaaacgtcgaaaggtacgtaacgtggtaggtctacgctaaccg

SEQ ID NO: 99050 - DNA, 508 bp, Homo sapiens
  misc_feature: GYAE6OF01EZ67Q.40.81.H04.1.454.CMB.1.raw
  modified_base (494)..(494): a, c, t, g, unknown or other
  misc_feature (494)..(494): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtgatcaacctaccagaggtggcacaaagtatcgacagaactttcagggcagggtcacatgacctgggacgcgtccatcagcacagtctacatggatctgagcggactggacctagtcgacgacacggccagtcgtatactgtggaagagtacgtggtgacgtaccgggcgggntcgccgagtcgggg

SEQ ID NO: 99051 - DNA, 542 bp, Homo sapiens
  misc_feature: GYAE6OF01CEANH.40.81.H04.1.454.CMB.1.raw
  modified_base (381)..(381): a, c, t, g, unknown or other
  misc_feature (381)..(381): n is a, c, g, or t
  modified_base (533)..(533): a, c, t, g, unknown or other
  misc_feature (533)..(533): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtctccgtgcaagtatttctaggaaaaccacccgtgacgacaactactacatacactggatgcgcacggccctggacgtaggggtttgaggtggagtggggtggactcgaaccctacgaggaggtgacaacgaaagtacncgacagtaacttcgagggcagggtcaccagtcgaccgtgggacgcgtacatcagcacgagtctacatgatcgtagacggcggtactcggaccgtaggcgacgtacgacggtcatcgtatacgtgtggagtgtacggtggacggacgtccggnggtctacgg

SEQ ID NO: 99052 - DNA, 616 bp, Homo sapiens
  misc_feature: GYAE6OF01B1QKD.40.81.H04.1.454.CMB.1.raw
  modified_base (397)..(397): a, c, t, g, unknown or other
  misc_feature (397)..(397): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctgggagagccggcctccatctcctgcaggtctagtcagacgcctacctaaacactaatggatactactctttagaattggtacctgacaagaacgccgagggcagtctccacagctctgattatagtttggggttcttaggtccgggtccgttcccggggtccctggactaggttcagtggcaggtgatcgagtcaactagtacttttacactagaaatcagngagggtggaggacaaggtaagtagttaggttagggtaatttagttacgtgtactagtacgtacctaaacccgttactaaccgtaaacgttggttaggtcgggtaacgggtaccgggaccggaaacgggacggtaagggtacgaaacgtacgaaacggacgtaacgtggtaggcgtcgaccgtacctacttctacgttaccttactacgttccgtacccg

SEQ ID NO: 99053 - DNA, 547 bp, Homo sapiens
  misc_feature: GYAE6OF01AVDX2.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgagtggagtggggtggatcaaccctaccgagaggtgcacgaaagtatcgacagaactttcgagggcagggtcaccatcgacctgggacgcgtccatcagcacagtctacatggatcgtgacgcgggactggacctacgtcgaccgacgacggccagttcgattactggtaggaagtaggtacggttggtacggaccgttaccggggcgggtacgtggacccgcggtcggggtaacccgg

SEQ ID NO: 99054 - DNA, 544 bp, Homo sapiens
  misc_feature: GYAE6OF01AHED9.40.81.H04.1.454.CMB.1.raw
  modified_base (532)..(532): a, c, t, g, unknown or other
  misc_feature (532)..(532): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgaggtggagtggggtggatcgaaccctaccgaggaggtggcacgaaagtatcgacagaactttcgaggcagggtcaccatgacctggggacgcgtccatcgagcacagtacctacagtggatcgtgacggcggactcgacctcgtgacgacgacggccagtcgtacttacgtggtggaagaggtcggttgggtcggcctaccgggcggggtactcggacccgnggtacccggggg

SEQ ID NO: 99055 - DNA, 608 bp, Homo sapiens
  misc_feature: GYAE6OF01DKNWC.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaggtctcctgacaagtatttcgtaggaaaccaccctgagacaactactacatacactggatggcggcgacggccccgtggacgtagggggtttgaggtgggagtgggggtaggactaccgaaccctaaccgaggacggtggacaaacgaaagtactacgaacgaacggtaacttttcggaagggaccggtagggtaccaaccgtagtaccggaaccggtacggggaccgtccggtaccctactacgaacgacaacgtacgtacctaacgagtaggacttcgaggacggcgggacgtggaccgtacggtacgacgacgacggctagtcgtatacgagtgagacgtgtggtgacgacggtcggactgacgtcgtgggaccg

SEQ ID NO: 99056 - DNA, 383 bp, Homo sapiens
  misc_feature: GYAE6OF01ETAG9.40.81.H04.1.454.CMB.1.raw
  modified_base (371)..(383): a, c, t, g, unknown or other
  misc_feature (371)..(383): n is a, c, g, or t
tcagtctagcgactcacgaccggtgctcgatttagtagtgtagattcgcggggatactactctttgaattggtacctgcagaagccagggcagtctccacagctcttgatatattggggtccttatcgggcctccggggtccctgacaggttcagtggcagtggatcagtcacagattttacactgaaaatcagcagggtggaggcagaagatgttgggatttattactgcatgcaacctctacagactgtgtggacggtcggccaagggaccaaggtggaaatcaagcgaactgtggctgcaccatctgtcttcatctcccgcatctagaagtcgactagactgagcgggctgggacaaggcgcagtagnnnnnnnnnnnnn

SEQ ID NO: 99057 - DNA, 577 bp, Homo sapiens
  misc_feature: GYAE6OF01AI72F.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgaggtggagtggggtggatcaaccctacgagaggtggcaacaaagtatcgacagaactttcgagggcgagggtcaccgagtcgaccgtgggaccgcgtccatcgagccacgagtctacgataggactcgtagacggcggtacctcggaccctcgtacggaaccgacgaccggacctagtagtacttaccgtggtacggtaaaggaggtacggttgggtacggtaccgtacccgggtcggggccgtaggacccgacggtcggggacccgg

SEQ ID NO: 99058 - DNA, 577 bp, Homo sapiens
  misc_feature: GYAE6OF01BIC28.40.81.H04.1.454.CMB.1.raw
  modified_base (348)..(348): a, c, t, g, unknown or other
  misc_feature (348)..(348): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctactaaacactaatggatactactctttagaattggtacctgcagaagccagggcagtctccacagctcttgatatagttgggttcttagtcggtccgtccgggtccctgacgaggttcaggtgctagtggancagtcacagtatttacactagaaatcagcgagggtgagcgagaagagtggtaggtatttatacgtgcatagacaacctactaacaaacgtgtacggtcggtacgggtcggaccgtaaacgggaaccgaagggtacggaaaatacgaaacggacgaaacgtggtagggctacggaccgtaaccgtacgttaccgttacgttaccttaccgtaacttcccggttacccccg

SEQ ID NO: 99059 - DNA, 553 bp, Homo sapiens
  misc_feature: GYAE6OF01DHFET.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggtctcctgcaagatttctaggaaaccaccctgagcaactactacatacactggatgcggcaggcccctggacgtaggggtttgaggtggagtggggtgacttaccaacccgtaccgaggagggtcggacaacgaaagtactacgaacaagtaactttacgagggtacgagggtacaccgtatcgaccgtggacgccgtcatcagcacgacgtactacgtatggatcgtcgaggccggactcggaccgtcgacgacgacgacggacagtacgtagtacgtaggg

SEQ ID NO: 99060 - DNA, 547 bp, Homo sapiens
  misc_feature: GYAE6OF01CFX8B.40.81.H04.1.454.CMB.1.raw
  modified_base (427)..(427): a, c, t, g, unknown or other
  misc_feature (427)..(427): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcagatttctggaaacaccctgagcaactactacatacactggatgcggcaggccctggacaggggtttgagtggagtggggtggatcgaaccctacgagaggtggacacaaagtatcgacagtaactttcgagggcagggtcaccgatcgaccgtgggacgcgtccatcagcacagtctacatggatcgngacgcggactcgacctcgtagaccgacgacggccagttgtattaccgtggtaggaacggtagtacgggttgggtagggccgtaccgggcgggtacgtaggaccgcggtcggggacccggg

SEQ ID NO: 99061 - DNA, 647 bp, Homo sapiens
  misc_feature: GYAE6OF01CI5IE.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccaggtggggatattgtgatgactcagtctccactctccctgcccgtcactcctggagacgccggcctccatctcctgcaggtctagtcagacgccctacctaaacactaatggaatactacttctttagaatttcggtacctgacagaacgccgagggcagtctccacagctcttagatattagttgggttcttaggtccgggtccttccggggtccctgtacgtacgggttcaggtggcgtaggtggactcgagtcaactagtactttacactagaaatcgagcgtagggtaggaggacgaaggaagtagttagggtttagggttaattttaagttacgtagtactaagtacggtacctaaacccttactaaacgtaaacgttggttacggtacgggtaaccgggttaccggaaccggtaaacggggaacccgtaaagggtaacggtaaaacgtacggaaacggtaaccggtaacggttcggtacggtaccgtacgtaaccgtaccgtacg

SEQ ID NO: 99062 - DNA, 532 bp, Homo sapiens
  misc_feature: GYAE6OF01A7PIA.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgattatattggggttcttagtcggggcctccggggtccctgactaggttcaggtggcagtggatcagtcacagtatttacatagaaatcagcgagggtggaggcagaagagtggttggtatttattactgacatagcctaacctactaacaaacgtgtaggtcgggacggtcggaccgaagggaaccgagggtaggaaatcgaaagacgaacgtggtaggacctgccacctacg

SEQ ID NO: 99063 - DNA, 584 bp, Homo sapiens
  misc_feature: GYAE6OF01D6QJ1.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactcttgaattgtacctgcagagccgaggcagtctccacagctcttgattatagttggggttcttacgtcgggtcccgtccggggtccctgacgtaggttcaggtggacaggtggatcagtcactagtactttacaactagaaatcagcgagggtaggagcgagaagtagtggttagggtatttagttactgctagtcgactaaccgtactaactaaacgttggtacggtacggggtaccggtaccggaccggtaaaggggacccgtaaagggtaggaaacgttcgaaacggtacggaaacggtggtacgggtctaacggcccgtaccgtaacg

SEQ ID NO: 99064 - DNA, 567 bp, Homo sapiens
  misc_feature: GYAE6OF01EDFHQ.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtgggcctcggtgaaggtctcctgcaagatttctggaaacaccctgagacaactactacatacactggatgcggcacggccctggacgtaggggtttgaggtggagtggggtgataccaacccgtaccgaggaggtggacaacgaaagtactacgacagtaactttcgaggcgagggtcacgatgaccgtgggacgcgtacatcgacgcacacgtctacgagtggatcgtagagcggtactcgaccgtcgtacgaccgacgacggcctagtgtacttacgtgtaggaagtaggtacggttgggtcggtaccgaccgggtcgggctacggaccgtacggtcggggtaacccggg

SEQ ID NO: 99065 - DNA, 537 bp, Homo sapiens
  misc_feature: GYAE6OF01BA4GB.40.81.H04.1.454.CMB.1.raw
  modified_base (266)..(266): a, c, t, g, unknown or other
  misc_feature (266)..(266): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcgggtgaaggtctcctgcaaggatttctggaaacnccctgagcaactactacatacactggatgcggcaggcccctggacgaggggtttgagtggagtggggtgatcaaccctaccgaggaggtggcaacgaaagtctacgaacagtaacgtttcgagggctagggtcaccatgaccgtggacgcgccatcgagcacagtctacagtggatctagacgcgggtactcggactcgtcgaccgacacggcctagtgtattagnggtacggaagngtacggttggacggtcgtaccggngggtctacgg

SEQ ID NO: 99066 - DNA, 578 bp, Homo sapiens
  misc_feature: GYAE6OF01CXE9Q.40.81.H04.1.454.CMB.1.raw
  modified_base (355)..(355): a, c, t, g, unknown or other
  misc_feature (355)..(355): n is a, c, g, or t
  modified_base (561)..(561): a, c, t, g, unknown or other
  misc_feature (561)..(561): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtggggcctcggtgaaggtctcctgcaagatttcgtaggaaaccacctgagcaactactacatacactggatgcggcacggcccctggacgaggggtttgaggtggagtggggtggatccaaccgtacgaggaggtggacaanaaagtatacgacagtaactttcgagggacgagggtcacgatacggacccgtgggaccgccgtaccagtcaagacactagtacctacgagtcggattcgtaggacggcggaacgtggaccctacggtacgaccgacgacggacagtcgtattacgtggtaggaacgtaggacggttggtcggtcgtaccgggcgggactacggaccncgggtggggtaccccgg

SEQ ID NO: 99067 - DNA, 533 bp, Homo sapiens
  misc_feature: GYAE6OF01EA0I1.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgagtggagtggggtggatcaaccctaccgagaggtggcaacaaagtatcgacagaacttcgaggcaggtcacatgaccgtgggacgcgtcatcagcacagtctacagtggatctagagcggactgacctcgtacgaccgacgacggccatgtattacgtggtacggagaggacggttcgggtggaccgtacccgggcggggtactcggaccgcggtccggggg

SEQ ID NO: 99068 - DNA, 557 bp, Homo sapiens
  misc_feature: GYAE6OF01A0NQ1.40.81.H04.1.454.CMB.1.raw
  modified_base (545)..(545): a, c, t, g, unknown or other
  misc_feature (545)..(545): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctctgatatagttgggttcttagtcgggcctccggggtccctgactaggttcaggtggcagtggatcagtcacagtatttacatagaaatcagacgagggtggaggcgagaagagtggttagggtattttattacgtgactagtacgacctaacctactaactaaacgttggtaggtacgggacgggtaccggaccgaacgggaccgaaggtacggaaatacgaagtacgtaacgtggtgcgtcgacactactcgtactcttacncgttccgtcccg

SEQ ID NO: 99069 - DNA, 670 bp, Homo sapiens
  misc_feature: GYAE6OF01DALGI.40.81.H04.1.454.CMB.1.raw
  modified_base (308)..(308): a, c, t, g, unknown or other
  misc_feature (308)..(308): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgccggcctcatcctcctgcaggtctagtcagacgccctacctaaaacactaaagtggaataacctacttctttagaattggtaacctgacaagaacgccgagggcacgtctccanacgtctcttagaattaagtttagtttaggggttccttaaggtccgggtccttccggggttcctggacgtaggttcgagtggcaggttggactcaggtacacgtagttactttaacaatagtaaaactcgaagtcggaagggtagggaaggcgaagggtaaaggtagttagggttacgggttaattttaagttactgtactaagtacgtaacctaaaccgttactaaacgttaaacgttgggttacggtacgggtaaccgggtaccgggaaaccggtaaacgggaaaccggtaaagggtaaggtaaaacgtaaccgaaacggacgtaacggttaggacggtacgtacgcccgtaacgtaaccg

SEQ ID NO: 99070 - DNA, 579 bp, Homo sapiens
  misc_feature: GYAE6OF01CGWK0.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgagtctctggatccagtggggatattgtgatgactcagtctccactctccctgcccgtcactcctggagagccggcctccatctcctgcaggtctagtcagagcctacctaaacactaatggatactactcttgaattgtacctgcagaagccgaggcagtctccacagctctgatagttagttgggttcttagtcgggtccgtcccggggtcctgacgaggttcaggtggcagtggatcagtcacagtatttacactagaaatcagcgagggtggaggacgaaggaagtagtaggttagggtattttaagttacgtgactaagtcgaacctaacctactaacaaacgttggttaggtcgggtacgggtaccggaaccgtaaacgggaccgtaaagggtaggaaacgttaccgaaaggacgtaacgtggtacggctcgactaccacttcgtagttcttcgtcttccccg

SEQ ID NO: 99071 - DNA, 519 bp, Homo sapiens
  misc_feature: GYAE6OF01DOSZ5.40.81.H04.1.454.CMB.1.raw
  modified_base (510)..(510): a, c, t, g, unknown or other
  misc_feature (510)..(510): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttctaggaaacaccctgagcaactactacatacactggatgcggcacggccctggacgtagggtttgaggtggagtggggtgatcaacctacgagaggtggcaacaaagtatacgacagtaactttcgagggcgagggtcacatgaccgtgggacgcgtcatcagcacagtctacatgatctagaggcggactgacctagtcgacgaaccgacgctagtgtagttacgtggtgaagtagtaggttggacggcgaccggngggctacgg

SEQ ID NO: 99072 - DNA, 693 bp, Homo sapiens
  misc_feature: GYAE6OF01AC4XE.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactccgtggagacgcccggcctcatctcctgcaggtctagtcagacgcctactaaacactaatggatactactcttagtaattggtacctgacagaacgccgagggcagtcctaccacgagtcctcttagattacgtaggtttcggggttctttacgtccgggtccgtcccggggtccctaggacgtacggttcgaggttggacgtaggtcgggtactccgtacgttaccaacgtaagttaacttttaaccgacgttaagtaaaacgttacgaacggtaacggtacgggggtacggaacggtaccgtaaaggtaaggtacgttaggtttagggttaatttaacgttaacgtacgtacgtaagtcgtaacctaaccgttaacctaacgttaaacgtggtacggttacgggaccgggttaccggaccggtaaacggggtacccgtaaagggtacggtaaaccgtacggtaaacgtaccggtaacggttcggtacggtaccgtgaccgtaccg

SEQ ID NO: 99073 - DNA, 512 bp, Homo sapiens
  misc_feature: GYAE6OF01EH5B9.40.81.H04.1.454.CMB.1.raw
  modified_base (415)..(415): a, c, t, g, unknown or other
  misc_feature (415)..(415): n is a, c, g, or t
  modified_base (483)..(483): a, c, t, g, unknown or other
  misc_feature (483)..(483): n is a, c, g, or t
  modified_base (507)..(507): a, c, t, g, unknown or other
  misc_feature (507)..(507): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttctggaaacaccctgagcaactactacatacactggatgcggcaggcccctggacgtagggtttgagtggagtggggtgatacaacctaccgagaggtgacacaaagtatcgacagaactttcgaggcagggtcaccgatcgacgtgggacgcgtacatcgancacagtctacagtgatcgtagaggcggtactgacctagcgacgacgacgcatgtattacgagtgaagngacgttggacggactcggcgggtntacgg

SEQ ID NO: 99074 - DNA, 546 bp, Homo sapiens
  misc_feature: GYAE6OF01A1L0T.40.81.H04.1.454.CMB.1.raw
  modified_base (286)..(286): a, c, t, g, unknown or other
  misc_feature (286)..(286): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttcnggaaacaccctgagcaactactacatacactggatgcggcacggcccctggacgtaggggttgaggtggagtggggtgatccgaaccctacgagacggtggcaacgaaagtatacgacagtaacgtttcgagggacgagggtcaccgagtcgaccgtgggaccgcgtccacgtcgacgccacgagtctacagtgactcgtgacggtccggacgtcgaccgtcgacgaccgaccgtacggacctagtcgtagttcgtacgg

SEQ ID NO: 99075 - DNA, 535 bp, Homo sapiens
  misc_feature: GYAE6OF01BNBCE.40.81.H04.1.454.CMB.1.raw
  modified_base (498)..(498): a, c, t, g, unknown or other
  misc_feature (498)..(498): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaaccaccctgagcaactactacatacactggatgcggcaggccctggacgaggggtttgagtggagtggggtgatcaacctacgagaggtggacaacgaaagtatacgacagtaactttcgagggcagggtcacgagtcgacgtgggacgcgtccagtcagcacgagtctacagtcggatcgtagacgcggtactcggacctcgtcgacgacgacgcctagtcgtattagtgtggaagnggtacgttggcggtacgtaccggtcgggtcgtacggg

SEQ ID NO: 99076 - DNA, 606 bp, Homo sapiens
  misc_feature: GYAE6OF01CHLLX.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtactgcagaagccagggcagtctccacagctcttgatatagttggggttcttagtcgggtccgtccggggtccctagacgtaggttcaggtggcgagtggactcgagtacacagtatttacactagaaatcagcgagggtggaggcaagaagtagttggttaggtaatttagttactgctatcgaacctaaccttactaactaacgttggtacggtacgggaaccgggttcggaaccggaaagggaaccgaagggtaagaaacgttacggaaacgtaccggtaaacgtcggtacggtactaggacccctaacgtacttccgttacgttaccttaccgtccttcccgttacccccg

SEQ ID NO: 99077 - DNA, 637 bp, Homo sapiens
  misc_feature: GYAE6OF01DX82W.40.81.H04.1.454.CMB.1.raw
  modified_base (248)..(248): a, c, t, g, unknown or other
  misc_feature (248)..(248): n is a, c, g, or t
  modified_base (585)..(585): a, c, t, g, unknown or other
  misc_feature (585)..(585): n is a, c, g, or t
  modified_base (621)..(622): a, c, t, g, unknown or other
  misc_feature (621)..(622): n is a, c, g, or t
  modified_base (624)..(637): a, c, t, g, unknown or other
  misc_feature (624)..(637): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactccccaggtgcagctggtgcagtcgtggggctggaggtgaagaagccgtggggcctggtgaaggtctcctgcaagtntttctaggaaacacctgagacaaactactacatacacgtggatggccggcgacggtccccgtgggacgtacggggtttgaggtgggagtggggtgactaccgaaccgtccgaaggtaggtcggacctaaacgtaaaaggttacgtaccgaacgtaacggttaaaccgttttcggaacgggggtacctaacgggggttaccctaacccggtaacgttaccgggtacccgggttacgggggaaccccggttacggttaaccccgaacttaccgaaacgggtaccaacgtaacggttacctaacgtacgttagggtaacttcgtagggacggtcggggtnaccgggtacaaacgggccgacgaaggtagcagctgnngnnnnnnnnnnnnnn

SEQ ID NO: 99078 - DNA, 552 bp, Homo sapiens
  misc_feature: GYAE6OF01CQRKJ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagacgcccggcctccatctcctgcaggtctagtcagacgcctacctaaacactaatggatactactctttagaattggtactgcagaagccgagggcagtctccacagctcttgatatagttgggttcttagtcggccgtccggggtccctgacgtggttcaggtggcagtggatacagtcacagtactttacacgtagaaatcagacgagggtggaggacgaagagtagtggttaggtatttagttagtgactagtgacctaacttcgtaactaacgtgtggtacggaccgggtcggacgaacgggaaccgaaggtaggaaactacgaagaccggtaactggtcgtcgtcgtaacccg

SEQ ID NO: 99079 - DNA, 590 bp, Homo sapiens
  misc_feature: GYAE6OF01A3A20.40.81.H04.1.454.CMB.1.raw
  modified_base (338)..(338): a, c, t, g, unknown or other
  misc_feature (338)..(338): n is a, c, g, or t
tcagtctagcgactcacgaccggtgctcgatttagtagtgtagattcgcgggcggtagactttgtgttctcgtagtctccctgctcagctcctggggcctgcttaatgcgtctgggttctctggactccagtcggggactattgtgatgactcagtcgtccactcgtccctgcccgtcactcctggagagccggcctccatcgtcctgcaggtctagtcagacgcctcctaaacactaatggattactaacttcttttgaagttggtacctgacgtaggaacgcccgaagggccacggtcgtaccgacagtcttcgttgatacttagtttcggggttnttagtcgggtccgtccgggtcctgacaggttcagtcggcgagtggatcgagtcacacgtatttacactagaaatcgagcgagggtagagcagagtatggtagtaatttagtagtgcatagaccaacctacaactaacgtgtaggtcggtacggtcggacgtaagggaccgaagggtacggaactacgaagacgtacgttcgtacggctcgacctaacgtgttaccgtgttaccgtcgtacgtcccgtacccg

SEQ ID NO: 99080 - DNA, 633 bp, Homo sapiens
  misc_feature: GYAE6OF01BHW4H.40.81.H04.1.454.CMB.1.raw
  modified_base (269)..(269): a, c, t, g, unknown or other
  misc_feature (269)..(269): n is a, c, g, or t
tcagtctagcgactcacgaccggtgctcgatttagtagtgtagattcgcgggggagcatcacccagcaaccacatctgtcctctagagaatcccctgagagctccgttcctcaccatgcactggacctggaggatcctcttcttggtggcagcagccgcaggagcccactcccaggtgcagctggtgcagtcgtggggctggaggtagaagaagccgtgggcctcggtagaaggtctccgtggactaagtacttttacgacggaaaccnccgtagacgacaactactaacatacacgtggatcggcggacacggcccgtggacgtaggggtttgaggtggagtggggtgactaccaaccgtacgaggagggtacgacaacgtaaagtacgtacgaacgtaacgtaaaccgtttcggaacggacgtacgggtaccaaccgtagtacggacccggtaggggacccgaccggtaccagtaccgagtaccacgtacgtacctaacgaggtcggtacttcgagacggccgtactcgtaccgtacgacgacgaccgacgctagtgtacttacgtaggaggagtacggttcggtcggccgtacggtaccggcggagttaccgaccggtcggtacccgggg

SEQ ID NO: 99081 - DNA, 564 bp, Homo sapiens
  misc_feature: GYAE6OF01B5CCU.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtgggggcctcgggtgaaggtctcctgcaagatttctaggaaacaccctgagcaactactacatacactggatgcggcaggcccctggacgtaggggtttgaggtgggagtggggtggatcaaccctaccgagaggtggcaacaaagtatacgacagtaactttcgagggcgagggtcacagtcgaccgtgggacgcgtccatcagacacagtctacagtgatcgtagaggccggactcgacctcgtacgaccgaccgacggccagtagtacttacgtggtaggaaggaggtcggttgggtcggaccgttaccgggcggggtactcgggacccgtcgggtaccggggg

SEQ ID NO: 99082 - DNA, 561 bp, Homo sapiens
  misc_feature: GYAE6OF01CEOPD.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacacctgagcaactactacatacactggatgcggcaggcccctggacgaggggtttgagtggagtggggtggatcaaccctaccgaggaggtggcacaaagtatacgacagaactttcgaggacgagggtcaccgatcgaccgtgggacgcgtccatcagcacagtctacatggatcgtgaagcggactacgaccgtacgacgacgaaccgacgacctagtacgtattacgtaggtacggaagacggtacgggttacggtacggtccgtaaccgggcggggccgtacggacccgtaggtacccggggg

SEQ ID NO: 99083 - DNA, 504 bp, Homo sapiens
  misc_feature: GYAE6OF01BL378.40.81.H04.1.454.CMB.1.raw
  modified_base (366)..(366): a, c, t, g, unknown or other
  misc_feature (366)..(366): n is a, c, g, or t
  modified_base (486)..(488): a, c, t, g, unknown or other
  misc_feature (486)..(488): n is a, c, g, or t
  modified_base (490)..(492): a, c, t, g, unknown or other
  misc_feature (490)..(492): n is a, c, g, or t
  modified_base (494)..(504): a, c, t, g, unknown or other
  misc_feature (494)..(504): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagtatttctaggaaacaccctgagcaactactacatacactggatgcggcacggcccctggacgtaggggtttgaggtggagtggggtggatacaacccgtacgagaggtggacaacaaagtancgaacaagtaactttcgacggtcgagggtcaccagtcgaccgtgggacgcgtccatcgagaccacgacgtactacatggactcgtaggaggcgggcgtgggacgtaaggcgtacagtagnnngnnngnnnnnnnnnnn

SEQ ID NO: 99084 - DNA, 841 bp, Homo sapiens
  misc_feature: GYAE6OF01E1M5V.40.81.H04.1.454.CMB.1.raw
  modified_base (307)..(307): a, c, t, g, unknown or other
  misc_feature (307)..(307): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctggaggtgaagaagccgtggggcctcggtgaaggtcctccgtgacaagttacttcgtacggaaaccaccgtagacgaccaactaactacactacacgtaggtacnggccggcgacggccccgttggaccgtaggggggttttgagggttgggaagttcggggggtaggtacgtaccgaaaccccgttaaccgaacggtaacggggtacgggacctaaaccggaaaaacgttaacgtaaccggtaaccgaaacgggttaaaccctttttaccgggaacgggggtacccgtaacggggggttaccccaaacccgtaacgtaccgggtaacccggttacggggggaaccccggtacccgggttacccctaaacgttacccgaacggtacccgaaccgtaacggttacccgaaccgtaacggttacggggtaacgttaccggttacgggaacgggtacccggggtaaccgttaccgggaaccccgttaaccggtaccggtaacccggaaccggtacccggacctacggtacgttaacgttaccgtaggtacgggtaaagggtacgggttacggttacggggtacgggtacccggtacccgggaccggggtaccgtccgggtaacccgtccgggtaaccggggg

SEQ ID NO: 99085 - DNA, 730 bp, Homo sapiens
  misc_feature: GYAE6OF01AJVP5.40.81.H04.1.454.CMB.1.raw
  modified_base (180)..(180): a, c, t, g, unknown or other
  misc_feature (180)..(180): n is a, c, g, or t
  modified_base (189)..(189): a, c, t, g, unknown or other
  misc_feature (189)..(189): n is a, c, g, or t
tcagtctagcgactcacgaccggtgctcgatttagtagtgtagattcgcgggggagcgatcacccagcaaccacatctgtcctctagagaatcccctgagagctccgttcctcaccatggactggacctgggaggatcctcttcttggtggcagcagccgcaggagcccactcccaggtncagctggtncagtcgtggggctgaggtgaagagccgtggggcctcggtgaacggtctccgtgcaaagtctttacgtggaaaccaccctggacgactaacgtactacgactacacgtaggatggcggcacggcccgtggacggtaggggtttacgaggttgggacgtggggtgtacgtaccgaaccgtaccgaggacggtcggacaacgtaaggtatacggaacgacgtaacgttcgaacgggtcagggtacaacgtagtacggacgtagggtaccgacgtaccgtaagtaccgaggaccaacgtaggttacctaacgacggttggtaacttcggtacggtaacggtacggggtctaaccgggtaccgtacgggttaccggaacgtaccgggtaacccggtacgtaacggttagttaaccgtacggggtaacggttcgggggtaaactaccgggggttacggtttacgggtaccgggtaacccgggttcccggaccgggggttcctaaaccgggtacccccgttaaaggggtccccggggtaaccccgggg

SEQ ID NO: 99086 - DNA, 565 bp, Homo sapiens
  misc_feature: GYAE6OF01EZ0DR.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcacgggcccctggacaggggtttgagtggagtggggtgactcaaccctaccgagaggtggcaacaaagtatcgacagtaactttcgagggcagggtcaccagtcgaccgtgggacgcgtccatcgagcacagtctacatggactcgtgaggcggaactgacctcgagacgacgacggccaagtgttaacgttacgtaggtaggaaaggacggtaacgggtttcgggtaggaccggtacccgggcgggggacttacggacccgacggtacccgggggg

SEQ ID NO: 99087 - DNA, 606 bp, Homo sapiens
  misc_feature: GYAE6OF01EM9GY.40.81.H04.1.454.CMB.1.raw
  modified_base (198)..(198): a, c, t, g, unknown or other
  misc_feature (198)..(198): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
  modified_base (604)..(604): a, c, t, g, unknown or other
  misc_feature (604)..(604): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgnaggacgcccactcccgaggtgcagctggtgcagtcgtggggctgaggtgaagacgcgtgggcctggtgagtcnctgcaagtatttcgtagaaccnccgtgacgcaactactacactacagtgtagtgccgcgacggcccgtggacgtaggggtttgaggtggacggttggggnggactacccgaaaccgttaccgaggtacgggtagacgaacgtaaagtacgtacgaacgtaacgtaacgtttacgacgggacgtacggtacgaaccgtagtacggaccggtcgggaaccgtccgtaccgacgtaccgacggtaccaacgtacgttaacgtaccgtagtacggaagttccgtaggaccgggacgggtcgtagggaccggtagggtaccgaccgagtagacatgcnga

SEQ ID NO: 99088 - DNA, 525 bp, Homo sapiens
  misc_feature: GYAE6OF01B9TJR.40.81.H04.1.454.CMB.1.raw
  modified_base (244)..(244): a, c, t, g, unknown or other
  misc_feature (244)..(244): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagntttctggaaacaccctgagcaactactacatacactggatgcggcaggcccctggacgaggggtttgagtggagtggggtgatcaacctaccagaggtggcacgaaagtatcgacagaactttcgaggcagggtcacatcgaccgtgggacgcgtaccatcagcacagtctacagtggaatcgtagagcggactggaccctgtcgacgacacggcatgtatacgtgtggaagaggtacgttgggtcggcgtaccggcggggctcggcccgtggtaccgggg

SEQ ID NO: 99089 - DNA, 507 bp, Homo sapiens
  misc_feature: GYAE6OF01DLYUO.40.81.H04.1.454.CMB.1.raw
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
  modified_base (501)..(501): a, c, t, g, unknown or other
  misc_feature (501)..(501): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctgggaaacaccctgagcaactactacatacactggatgcggcacggccctggacaggggttgagtggatggggtgatcaaccctacagacggtgcacaaagtactcgacagtaaactttcgagggcagggtcacatcgacctgggacncgtcatcagcanagtctacatggatcgtagacgcgggactggactacgcgaacgactacggcagtgtntcgtgg

SEQ ID NO: 99090 - DNA, 704 bp, Homo sapiens
  misc_feature: GYAE6OF01AQRE1.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagagccgtggggcctcggtgaaggtctccgtgacaagtatttctaggaaaccacccgtgacgacaactactacatacacgtggatgcggacacggcccgtggacgtaggggtttgaggtggaggtggggtgtataccgaaccctacgaggtagggtaggacaaacgtaaagtacgtacgaactaacggtaactttcgaagggacgtacggggtaccaaccgtagtacggaccggttcggggaccgtcggtacccagtacgacgtacaacgtacgtacctaacgacgttaggacttacgtacgggaacggacggtaccgtacgtacccgttcgtacggaaccggtaaccgaccggaccctaagttacggttaaaccgtttacgtagggttaacgggtaaagggtacgggttaccgggtttcggggtacggtaacccgggttacccggggccgggggtaccgttaccgggtaacccggtacggggtaccccgggggg

SEQ ID NO: 99091 - DNA, 639 bp, Homo sapiens
  misc_feature: GYAE6OF01CSNOP.40.81.H04.1.454.CMB.1.raw
  modified_base (227)..(227): a, c, t, g, unknown or other
  misc_feature (227)..(227): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtgggcctcggngaaggtctcctgcaagtatttctaggaaacacctgacgcaactactacatacactggatcggcgcgacggcccgtaggacgtaggggtttgaggtggagtgggtcgataccgaacctaccgaggacggtagacaacgtaaagtacgtacgaacgtaagtaacgtttcgaacgggcaacgggtcaccgtagtacggaccgtggggaacctcgtactacgtacgaacgacacgtacgtactaacgagttacggtaacttcgtaggacggaccggtaacgttcggtacctcgtacgaaccgtacgacgtaccgtagttacgttaacgtcgtaggtaacggaagtacgggtacggttagggtcggtaccgtacccggggtacggggtacctacggaacccggtgggtacccggggg

SEQ ID NO: 99092 - DNA, 540 bp, Homo sapiens
  misc_feature: GYAE6OF01DA9V2.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctcctaaacactaatggatactactctttgaattggtacctgcagaagccagggcagtctccacagctcttgatatagttgggttcttagtcgggcctccggggtcctgacgtaggttcaggtggcagtggatcagtcacagtatttacactagaaatcgagcgtgggtggaggcgaagaagagttggttaggtatttagtacgtgcatgacaacctctaactaacgtgtggtacggacgggtcggaccgaaagggacctaagggtacggaaactacgaaaggtcgaaacgtggtacggcgtggtaccg

SEQ ID NO: 99093 - DNA, 729 bp, Homo sapiens
  misc_feature: GYAE6OF01DY1UZ.40.81.H04.1.454.CMB.1.raw
  modified_base (254)..(254): a, c, t, g, unknown or other
  misc_feature (254)..(254): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcttggtggcagcagccgcaggagcccactcccaggtgcagctggtgcagtctggggctgaggtgaagagcctgggcctggtgaaggtctcctgcaagtatttctaggaaacncccgtagacgacgaactactacatacactaggatgcggcacggccccgtggacgtaggggtttgaggtggagtggggtaggtacgtaccgaacccgtacgaggacggtggacgtaacgaaaggtcgttacgaaacgtacggtaaacgtttacgacgggtacgtaacgggtaccaacccgtaacgttcggtaacccggtacggggtaaccggtcccgttacccgaacgttaccgaacggtaccaaccgttaacggtacccgttaacgtaacggttacgtacgttcgttacggaacgggtaccggtaaccgttaccggtaacccgtcggtaccggtaacccgtaacccgaaccgggtaccgtaacgttcggttaacgttacgtgggtaacgggtaagttaccggtaggtttacgggccggttaccggtacccgggtcgggtaccgtaccggaccggtcgggtccggggtaaccccgg

SEQ ID NO: 99094 - DNA, 690 bp, Homo sapiens
  misc_feature: GYAE6OF01C0WC4.40.81.H04.1.454.CMB.1.raw
  modified_base (194)..(194): a, c, t, g, unknown or other
  misc_feature (194)..(194): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgnggggctgaggtgaagagcctggggcctggtgaaggtctcctgacaagtattcgtaggaaccaccctgacgactaaactactacatacacgtggatcggcggcacggcccgtggacgtaggggtttgaggtggtagtggggtacgactaccgtaacccgtacgaggaggtgacaacgaaagtatacgactaagaactttcgagggtcgaagggtcaacgtagtcgtaccggtacgggaccgtcgtaccgtagtaccgacgacccgtacgtaacggtacctaacgacgtagtaacgtcgtaggaccgtacgggtaaccgtacggtacccgttaccgtaacgaaccgtaaccgacccggtactaagtacggttaaaccgttacggtagggtaacggtaagggtaacgggttcgggttacggggtaccggtacccggtaccggggtaccgggggtacctacgggaacccggtaccggggtacccgggggtaaccccgggg

SEQ ID NO: 99095 - DNA, 588 bp, Homo sapiens
  misc_feature: GYAE6OF01BCWE2.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactcttgaattggtacctgcagaagccagggcagtctccacagctcttgatatagttggggttcttagtcgggcctccggggtccctgacaggttcagtggcagtgatcagtcacagtatttacactagaaatcagcgagggtggaggcaagaagagttggttagggtattttattactgacagtcgacctaacccttactaaactaaacgttggttaggtcgggaaccgggttccgggacccgtaaacgggggtaacccgtaaaggggttagggaaaacgttaccggaaacggaccgtaaaccgttgggtacgggccgttacggacccgaccgttaacg

SEQ ID NO: 99096 - DNA, 511 bp, Homo sapiens
  misc_feature: GYAE6OF01B5RSA.40.81.H04.1.454.CMB.1.raw
  modified_base (499)..(499): a, c, t, g, unknown or other
  misc_feature (499)..(499): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgagtggagtggggtggatcaaccctacagaggtggcaacaaagtatcgacagaactttcagggcagggtcacatgacctgggacgcgtccatcagcacagtctacagtggatctgagcggactgacctcgtgacgacacggcatgtatactgtggagagacggttggtggcgtaccggcgggctaggaccngtggggacccgg

SEQ ID NO: 99097 - DNA, 570 bp, Homo sapiens
  misc_feature: GYAE6OF01EVZLX.40.81.H04.1.454.CMB.1.raw
  modified_base (258)..(258): a, c, t, g, unknown or other
  misc_feature (258)..(258): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaaacactaatggatactactntttgaattggtacctgcagaagccagggcagtcctccacagctcttgattatagtttgggttcttacgtccgggtcccgtccggggtccctgacgtaggttcaggtggctaggtggtatcagtcacgagtacttttacactagtaaatcagtcgtgggtaggaggacgaagaagtagttggttggtatttagttactgactagtacgtactaaccttactaacgtaactggtgtacgggtcggtaccggaccgaagggtaaccgaagggtagaaacgtacgaaacgtacgtaagtaggtcggcgtcgtaccg

SEQ ID NO: 99098 - DNA, 532 bp, Homo sapiens
  misc_feature: GYAE6OF01AKF61.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagagccctacctaaacactaatggatactactctttgaattggtacctgcagaagccagggcagtctccacagctcttgatatagtttgggttcttagtcgggtcctccggggtccctgacgaggttcaggtggcagtggatcgagtcacagtactttacactagaaatcagcgagggtggaggcagaagagtgttggtatttatactgcatcgactaacctctaacgtaactgtcggtacggacggtacggaccgaaagggtaccgaagggtaggaatacgaagcgtaacgtggtagctgctaaccg

SEQ ID NO: 99099 - DNA, 579 bp, Homo sapiens
  misc_feature: GYAE6OF01CGEF5.40.81.H04.1.454.CMB.1.raw
  modified_base (432)..(432): a, c, t, g, unknown or other
  misc_feature (432)..(432): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagacgcctacctaaacactaatggaatactacttctttagaattggtacctgcagaacgccgagggcagtcctaccacagcttcttagattattagttggggtttacttagtccgggtccgtccggggtccctgacgtaggttcgaggtggctagtgatcgagtcatagtactttacactaagaaatcgagcgtagggtggagganaaggaagtagttggttaggtattttaagttctgtactagtcgtactaacctactaactaacgtgtacggtggaccggtacggaccggaacgggtacgaaagggtacggaaacgacgaacggacgtaacgtgtacggtgtcggtaccg

SEQ ID NO: 99100 - DNA, 553 bp, Homo sapiens
  misc_feature: GYAE6OF01ECU3D.40.81.H04.1.454.CMB.1.raw
  modified_base (400)..(400): a, c, t, g, unknown or other
  misc_feature (400)..(400): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtgggggatattgtgatgactcagtctccactctccctgcccgtcactcctggagagccggcctccatctcctgcaggtctagtcagagcctcctaaaacactaatggatactactcttgaattggtacctgcagaagccagggcagtctccacagctcttgattattagttggggttcttagtccgggtccgttcccggggtccctgacctaggttcaggtggcagtggatcagtcacagtatttacactagaaaatcagcgagggtggagganagaagtagtggttagggtatttagtactgacatcgacctaacctactaactaagtgtacggtacgggacggtacgggaccgaaagggacaagggtagaaagtacgaaggacgaagtggtgctcgacactagtcgtgtcttctacgtcctcccg

SEQ ID NO: 99101 - DNA, 544 bp, Homo sapiens
  misc_feature: GYAE6OF01CBYP2.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctccgtgcaagatttctggaaacaccctgagtcaactactacatacactggatgacggcacggcccctggacgagggtttgagtggagtggggtggagtcaacctacagaggtgcaacaaagtatacgacagtaactttcgagggcgagggtcacatcgacctgggaccgcgtccatcaggtcacgacgtctaacagtggaatccgtagacggtcgggacgtcggactaacggcgacgacgtaacggcagtacgagttacgacgttgagtagacggttagcggacgtacggcggtgtaaccgg

SEQ ID NO: 99102 - DNA, 659 bp, Homo sapiens
  misc_feature: GYAE6OF01EHAKB.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccgagggtgcagctgggtgcagtcgtggggctggaggtgaagagccgtggggcctcgggtgaacggtcctcctgcaagtattttcgtacggaaaccaccgtagacgacaactaactacatacacgtggagtcggcggcgacggcccgtaggacgtaggggtttggaggtggagtggggtagactaccgaaccgtacgaggacggtaggacaacgtaaagtacgtacgaacgtaagtaaacgtttcgacggggtacgacgggtaccaacgtacgtcggaccggtagggaccgcgtacccatcgaacgtacacgtacgtactacgtgtagatcgacggacggcggtcgtaccgacccgtaggtaccgaccgtaacggaccgacgtaacgttcgtaacgttacgtacggtagggaacgtaggtacgggttacggcgggtaccgtacgggccgggtactaccgggaccgtaagggtcccgggaaacccggg

SEQ ID NO: 99103 - DNA, 581 bp, Homo sapiens
  misc_feature: GYAE6OF01D113Q.40.81.H04.1.454.CMB.1.raw
  modified_base (424)..(424): a, c, t, g, unknown or other
  misc_feature (424)..(424): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattgtacctgcagaagccaggcagtctccacagctcttgatattagttggggttcttagtccgggtccgtcccggggtccctgactaggttcaggtggcagtggatcagtcacagtactttacactagaaaatcagcgagggtgaggacagaagtagtggttaggtatttattactgtnagtcgacctaaccttactaactaaacgtggtaggtacggtacgggtaccgggaaccggaaacgggaaccgaagggtacggaaaacgtacgaaagtaccggaacgtggtaggctcggaccaccgacttcctagttctttacctcgttccgttaccccg

SEQ ID NO: 99104 - DNA, 609 bp, Homo sapiens
  misc_feature: GYAE6OF01CBFTS.40.81.H04.1.454.CMB.1.raw
  modified_base (235)..(235): a, c, t, g, unknown or other
  misc_feature (235)..(235): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagagccgtggggcctggngaaggtctccgtgactaagtatttagtaggaaacaccctagagacaactactacatacactgatgcgcacggccctggacgtaggttgagtggagtgggagactacgaccgtacgagaggtgacgaacaaagtactacgacgaagtaacttgaagggcgaaggtcaacagtacgacgtggacgcgtaccatacgagtcacgacgtacctagacgttagggtactcggttacggaggtaccgggtacgtacggaccgttacgacggtaaccgaacggtaaccggacctaagtacggttaacgttacggaacggttagggaaacgtacggttaacggttgggtacggtacccggtacggggttcggacgtaacggg

SEQ ID NO: 99105 - DNA, 529 bp, Homo sapiens
  misc_feature: GYAE6OF01BDA6L.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctaggaaacaccctgagcaactactacatacactggatgcggcacggccccgtggacgtaggggttgaggtggagtggggtggatcgaaccctacgaggaggtcggacaacaaagtatcgacagtaacttcgagggcagggtcaccgatcgaccgtggacgcgtcagtcagcacacgtctacagtaggactcgtgagcggtactgacctcgtcgacgacgacggactagtcgtagttacgtaggg

SEQ ID NO: 99106 - DNA, 527 bp, Homo sapiens
  misc_feature: GYAE6OF01COQDK.40.81.H04.1.454.CMB.1.raw
  modified_base (245)..(245): a, c, t, g, unknown or other
  misc_feature (245)..(245): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcagattcnggaaacacctgagcaactactacatacactggatgcggcacggccctggacgaggggtttgaggtggagtggggtgactccgaacccgtacgagaggtggacaacgaaagtatacgacagtaactttcgagggcagggtcaccgtagtcgaccgtgggacgcgtccacgtcacgcacagcttttacacgtgacgtctacgacgcggtacgtcggacgtacgtcgacgacacggacagtgtatacgtgtgtagagngtgcgngacgcggcngacngnggtacg

SEQ ID NO: 99107 - DNA, 580 bp, Homo sapiens
  misc_feature: GYAE6OF01C1XBJ.40.81.H04.1.454.CMB.1.raw
  modified_base (301)..(301): a, c, t, g, unknown or other
  misc_feature (301)..(301): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtgggctggaggtgaagaagccgtggggcctcggtgaacggtctccgtgcaagtactttctaggaaaccnccctgagcaactactacatacacgtggatgccggcacggccccgtaggacgtaggggtttgaggtggaggtggggtgacgtaccaaccccgtacgaggagggtcgacgaacgaagtacgtacgaacgaagtacgtttacgacgggacgtacgggtcaccgagtcggtaccgtcgggacgccgtacctacgacacgaccacgacgttactacgagtgtatcgtaggacgacggcgtacgtacctcgtacgaccgacgacgacatcgttagttcgtacggg

SEQ ID NO: 99108 - DNA, 539 bp, Homo sapiens
  misc_feature: GYAE6OF01DK1O6.40.81.H04.1.454.CMB.1.raw
  modified_base (534)..(534): a, c, t, g, unknown or other
  misc_feature (534)..(534): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagagcctcctaaaacactaatggatactactctttgaattggtacctgcagaagccgagggcagtctccacagctcttgattattagttggggttcttagtccgggccgttcccggggtccctgactaggttcaggtggcaggtgatcagtcatagtatttacacgtagaaaatcagcgagggtggaggcgaagaagtagttggttaggtattttattacgtgactatgactaacctactaacaacgtgtggtggaccgggtcggaccgaacgggaaccgaggtagaaagtcgaagtcgaagtgcggntgacc

SEQ ID NO: 99109 - DNA, 799 bp, Homo sapiens
  misc_feature: GYAE6OF01EHJ5E.40.81.H04.1.454.CMB.1.raw
tcagtctagcgactcacgaccggtgctcgatttagtagtgtagattcgcgggcgtagactttgtgtttctcgtagtctcccttctcagctccgtggggctgctaatgctctgggtctctggatccaggtgggatattgtgatgactcagtcctccactcctccctcgcccgtcactccgtggagacgcccggcctccatcctcctgcgaggtctagtcagacgtccctaacctaaaactacgttaaagtggtaacttaccttacgttctttagaagtttcggtacctgacgaagaacgcgaggactacgtcctaccgacagtcttacgttagattagtttaggtttcgggtttaccttacggtcccgggtacccggttcccgggttccacgtacgttacggttccgaggtcggacgtaggtggactacgtagtaccgtagtaaggttaacttttaaccgacgttaaagtaaaaccgttcggaaacggtaccgggtagggggttacgggaacggtaacggtaaagggaaggtttagggttgggttttaaggtaacgtttttacgttacggtacgacgttacgtaccgtaaacccttaaccgttaacgtaaaccgttaacggttgggttaccggggtaacgggtacccgggtaaccccggggaaccggtaaaccggggtaaccgtaaaggggttacggtaaacggaacggtaaaccgggtacgtaacggtcgggtaccgagtaccgaccctaaccgtattcccgttacgttaccttaccttcccgttcccgtacccggtcg

SEQ ID NO: 99110 - DNA, 705 bp, Homo sapiens
  misc_feature: GYAE6OF01EO3Y1.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtctcctgacaagtatttcgtaggaaaccaccctgagacaaactactacaatacacgtggatggccggcgaccggccccgtagggacgtagggggtttcgaggtggaggtggggtgacgtaccgtaaaccctacgaggaggtcggacaacgaaagtactacgactaaggtaacttcgacgggcgtagggtccaaccgagtcgtaaccggtgggaccgtcgtaccgactacgacgtaccaacgtacgttaccctaagtacggttacgggtaacttaccggtacgggaacgggtcccggggtaaaccgttaccgggtaaccccgttaacggggtaccggaaccgggtaaccggtaaccgggttaccctaaggttaccggttaacgtttacggttcggtaaagggtaaacgtaggtaacgggttcgggtacgggtacccgtaccggggtccggggtctaacccgggg

SEQ ID NO: 99111 - DNA, 522 bp, Homo sapiens
  misc_feature: GYAE6OF01BU52R.40.81.H04.1.454.CMB.1.raw
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactacttctttagaattggtacctgcagaagccagggcagtctccacagctcttgatatagtttggggttcttacgtcgggtcccgtcccggggtccctgacgtacggttcaggtggcagtggatcagtcaacagtacttttacactagaaatcagacgagggtaggaggacagaagagtggttaggtatttatactgctagtgactaactctaacaatgtgngggacggtcggacaagggaccaaggagaancaagcgaatggtgctcgacacntctntctnctctcc

SEQ ID NO: 99112 - DNA, 592 bp, Homo sapiens
  misc_feature: GYAE6OF01DL4W7.40.81.H04.1.454.CMB.1.raw
  modified_base (430)..(430): a, c, t, g, unknown or other
  misc_feature (430)..(430): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtgggcctcggtgaaggtctcctgcaagtatttcgtaggaaacacctgacgacaactactacatacactggatgcggcacggccccgtggacgtaggggtttgaggtaggagtggggtaggactaccgaacctaccgaggaggtcggacgaacgaaagtactacgaacaagtaactttacgaggacgacgggtacacgagtacgacgtgggacncgtaccatcgagcacgagtctacgagtggactcgtagacgtcggacgtcgtaccgtcgtacgacgtacgacggacgtagtacgtacttacgtaggtacggaagtacggttacggtcggtacggaccgtaccgggcgggtactacggaccgtcgggtaccggg

SEQ ID NO: 99113 - DNA, 501 bp, Homo sapiens
  misc_feature: GYAE6OF01BVB34.40.81.H04.1.454.CMB.1.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
  modified_base (496)..(496): a, c, t, g, unknown or other
  misc_feature (496)..(496): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagaagcctggggcctcggtgaaggtctcctgcaagatttctggaaacaccctgagcaactactacatacactggatgcggcaggcccctggacgaggggtttgagtggagtggggtgatcaacctacagaggtgcacaagtatcgacagaactttcgagggcagggtcacgatcgacgtgggacgcgtcatcagcacngtctanatggatctagagcggactgacctgcgacgacgacggcatgtattanggtaggaagagacgttggcggactcggcgggntacgg

SEQ ID NO: 99114 - DNA, 521 bp, Homo sapiens
  misc_feature: GYAE6OF01EN1DI.40.81.H04.1.454.CMB.1.raw
  modified_base (315)..(315): a, c, t, g, unknown or other
  misc_feature (315)..(315): n is a, c, g, or t
tcagtctagcgactcacgaccggtgctcgatttagtagtgtagattcgcgggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagacgcctacctaaacacctaatggatactactctttgaattggtacctgcagaagccagggcaggtctccacagctcttgatatttangggttcttatcgggcctccggggtcccgtgacaggttctagtggcgagtggatcagtcacagtattttacactagaaaatacagcagggtggaggcagaagagtgttgggtatttattatgcatgacaacctctaacaactgtgtggacggtacggccgaagggacaaggtaggaaagtacaagacggtactagtggctggtaccg

SEQ ID NO: 99115 - DNA, 546 bp, Homo sapiens
  misc_feature: GYAE6OF01D1ZT0.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccgggtccctgacaggttcagtggcagtggatcagtcacagtatttacactagaaaatcgagcgagggtggaggcagaagtatggttagggtatttattactgcatgacctaacctctaacaactgtgtcggacggtcggaccgaaagggaccaagggtagaaatcgaaaggaccgtaacgtggtaggactcggactaccattccgtgttacctttcagttcccgttacccccgg

SEQ ID NO: 99116 - DNA, 654 bp, Homo sapiens
  misc_feature: GYAE6OF01CGIRK.40.81.H04.1.454.CMB.1.raw
  modified_base (635)..(635): a, c, t, g, unknown or other
  misc_feature (635)..(635): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtggggcctcggtgaaggtctccgtgcaagtatttctaggaaacaccctgagacaactactacatacactggatcggcggcacggccctggacgtaggggttgaggtggagtggggtgacgtaccgaacccgtacgaggaggtcggacaacgaaagtacgtacgaacgtaagtaaccgtttacgacgggtacgacggggtacaccgtagtacggaccgtagggacccgcgtacccagtaccgacgtaccaacgtacgtaccgtaacgtagtacggaacttcgtaggaacggtccggacgtcggtaccgtacggtaccggaaccgacgaaccggtacagttagttaacgtacggtaggtaacgggaaggtagggttacggttgggtacggtaccggttaccgggcgggtacgaccgggaccncgggttccgggaacccggg

SEQ ID NO: 99117 - DNA, 632 bp, Homo sapiens
  misc_feature: GYAE6OF01C7NZB.40.81.H04.1.454.CMB.1.raw
tcagtctagcgactcacgaccggtgctcgatttagtagtgtagattcgcggggtgaatcaggactcctcagttccaccttctcacaatgaggctccctgctcagctccgtgggctgctaatgctctgggtctctggatccgagtgggatattgtgatgactcagtctccactctccctgcccgtcactcctggacgacgccggcctccatcctcctgctaggtctagtcagtacgcctactaaacactaatggatactacttcttagaagtttcggtacctgacagagccgaggcagtcctcacagcttctagattatagtttcgggtacttacgtccgggtcccgttcccgggtacctggtaactacggttcaggtcggctaggtcgatcgagtacacgtagtactttacactaagaatcgagcgtagggtggacgacaagaagtagtggtttagggtattttagtacgtgtactagtacgtacctaccgttactaacgttaacgttggtacggtacgggtaccggtacggaaccggaaacgggtaacccgtaagggttaacggtaaacgtaaccggtaaacggtaccggtaacggttacgggtacggtaccgtaggtacccgttaacccg

SEQ ID NO: 99118 - DNA, 556 bp, Homo sapiens
  misc_feature: GYAE6OF01B04OC.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattgggttcttagtcggtccgtccggggtccctgactaggtcaggtggcaggtgatcagtcacgagtatttacactagaaatcagcgagggtggaggcagaagagtgttagggtatttatacgtgactagtacgacctaacctactaacaacgttggttcggtagggtaccggtacgggaccgaacgggtaccgaagggttacggaaacgtaccgaaaggtaccgtaacgttaggtcggtcgtcgacccg

SEQ ID NO: 99119 - DNA, 520 bp, Homo sapiens
  misc_feature: GYAE6OF01AHM0L.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattgggttcttatcgggcctccgggtccctgacaggttcagtggcagtgatcagtcacagattttacactagaaatcagcagggtgaggcagaagagtgttgggtattttatactgctaatgactaacctctaactaacgtgtggtgggaccggtcggaccgaaaggggaccgaaggtaggaaatacgaagcgaaacgtggtaggcgtgcctaccg

SEQ ID NO: 99120 - DNA, 787 bp, Homo sapiens
  misc_feature: GYAE6OF01A2R99.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtgggatattgtgatgactcagtctccactcctccctgcccgtcactcctggagacgcccggcctccatcctcctgcaggttctagtcacgacgtccctaacctaaacacttaatcggtaattaccttacgttctttagaattcggtacctgacaagaacgccgagggcctagttcctaccacgacgtcttcttagacttagttaggtttcgggttacttacggtccgggtcccggttccggggtccctggtacgtacggttacgaggtcggcgtaggtacggtacttacggtaacgtacctaaacgttaagtttaaccgtttaacgtaaccggttaagtaaaacgtcggtaacggtacggtaagggggttaacggagggtaaccgtaagggtaaaggttaggtttagggtttaggttaatttttaacgttaacgttcgtaaccgtacgtaccgtaacccgttaaacccgtttaaccgttaacgttaaccggtttcggttacggggttaacccggggtacccggggttaaccggtaaaccgggtaaaaccggggtaaaccgggtaaacgggtaaacggtaaacggtaaccgtaaaccgggtaaccgtaacgttcggggtaccgtacggtaccgtaacccgtcgttaaccg

SEQ ID NO: 99121 - DNA, 685 bp, Homo sapiens
  misc_feature: GYAE6OF01EDSMI.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggtatccttcttcgttggtggcagcacgccgcgaggacgcccactcccgaggtcgcaggctggtgcaggtcgtggggctggaggtagaaaggacggccggtggggtccgtcgggtagtaacggtcctccgtgaacgtaagtacttttacgaacgggaaacctcccgtaggacgacctaaacctactacaactacagtggagtcggcggacgaccggcccgtagggacgggttaggggttgaggtgggaggtggggactacgtacccgtaacccgtaaggagggacgggtacgaacgtaaacgtaaacggttacgtaacggaactaaggttaacgttacggaacggggtaccgtacggggtaccaaccggtagtaccggtaaccggtcgggtaacccgccgggtaacacgtaccaacggaccgtaacgtacggtaactacgtagtcggtatcggtacggacgtccggtactaccgtacgtcgacgacggacgtacggacttagtctagtcggtagg

SEQ ID NO: 99122 - DNA, 827 bp, Homo sapiens
  misc_feature: GYAE6OF01B7DIU.40.81.H04.1.454.CMB.1.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtcgcagctggtgcagtctgggctgagtgaagagcgtggggcctcggtgaggtctcngcagnttcnggaaccacctgagcaactactacactacactggatggcggcacggcccctggacgtaggggtttgagtgggagtggggtagtactaccgaacccgtacgagacggtggaccaacgtaaagtacgtaccggtaacgtaacggtaaaccttttacggaacgggtacgtaacggggttaccaacccgtagttaccgggtacccggttacggggaaccggtaccggtcccaaacgttcgaaccggaccgtaaccgtaacggtttaccgtaaaccgtacggttacgggtaactttccggttaacgggaaccggttaccgggtaacccggttaccggtaacccccggtttacggtaccgggtaaaccccggaaccgggttaacccgggtaccgtaacggtttaaccgggtttaaaccgtttaaaccgggttttacggggtaaacggggttaaacgggttaaacggggtttaccgggtttttcgggggtaaccgggggttaaccccggttaacccgggggttacccggggggttacccgtttaaacccggggtaaaccccggttaacccggggggttaaaccccggggggg

SEQ ID NO: 99123 - DNA, 743 bp, Homo sapiens
  misc_feature: GYAE6OF01BWIHR.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagacgccggcctccatcctcctgcgaggtctagtcagacgcctactaaacactaatggatactactcttagaattggtactgacagaacgccgagggctacgtcctacactagcttacttagtaattagttaggtttcggggtttacttacggtccggggtacccgttcccggggtccctaggtacgtacggttcaggtcggacgtaggtggactacgacgtctaacgtagttaactttaacaacgttaagaaaactcgaaggtacgggtaggggtcggaaagggtacgaaaggtaaacggttaggttagggtttaagggtttaacgtttttaacgtttaacggtacgtacgtaagttacggtaaccctaaaccttacgtaaaccttaacgggttcgtacgggtacgggtaaccggggttacccggaacggtaaacgggaaccggtaagggtaacgtaaaacgtcgtaaacggacggtaaaccggtggtacgggtacttaccgggaccttaacccgtacgttacccgggttactttaaccttcccgaacgtttccccgtaaccccg

SEQ ID NO: 99124 - DNA, 429 bp, Homo sapiens
  misc_feature: GYAE6OF01DEM20.40.81.H04.1.454.CMB.1.raw
  modified_base (312)..(312): a, c, t, g, unknown or other
  misc_feature (312)..(312): n is a, c, g, or t
  modified_base (383)..(429): a, c, t, g, unknown or other
  misc_feature (383)..(429): n is a, c, g, or t
tcagtctagcgactcacgaccggtgctcgatttagtagtgtagattcgcggggatactactctttgaattggtacctgcagaagccagggcagtctccacagctcttgatatattggggtccttatcgggcctccggggtccctgacaggttcagtggcagtggatcagtcacagattttacactgaaaatcagcagggtggaggcagaagatgttgggatttatactgcatgcaacctctacagactgtgtggacggtcggccaagggaccaaggtgaaatcaagcgaactgtgctgacaccatctgtctnatcttcccgcatctgaagtcgctagactgacggcgggtctcgggacaaagggcgtacaagttaggcagtgnnnnnnnnnnnnnnnnnnnnnnnnnnnnnnnnnnnnnnnnnnnnnnn

SEQ ID NO: 99125 - DNA, 508 bp, Homo sapiens
  misc_feature: GYAE6OF01D0KX6.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatcctcctgcaggtctagtcagagcctacctaaacactaatggatactactctttgaattggtacctgcagaagccaggcagtctcacagctcttgatatattgggtcttatcggcctccggggtcctgacaggtcagtgcagtggatcagtcacagtatttacactgaaaatcagcgagggtggaggcaagaagatggttggtatttattactgcatgactaacctctaacaactgtgtggacgtcggacgaagggaccaaggtaggaaatacgaaagcgtaacgtggtcggcgtgacccg

SEQ ID NO: 99126 - DNA, 531 bp, Homo sapiens
  misc_feature: GYAE6OF01C245I.40.81.H04.1.454.CMB.1.raw
  modified_base (499)..(499): a, c, t, g, unknown or other
  misc_feature (499)..(499): n is a, c, g, or t
  modified_base (519)..(519): a, c, t, g, unknown or other
  misc_feature (519)..(519): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctcacagctcttgatatagttgggttcttagtcgggccctccggggtccctgacgaggttcagtggcagtggatcagtcacagtactttacactagaaaatcagcgagggtggaggcgaagaagagttggttagggtattttattactgcagtgactaacctctaacaactgtaggtggacgggtcggaccgaagggaccagggtagaaatacgaagcgaacgtggngctgacacatctagtcttcncgttcctacccg

SEQ ID NO: 99127 - DNA, 652 bp, Homo sapiens
  misc_feature: GYAE6OF01CVXBS.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctgggctgctaatgctctgggtctctggatccagtggggatattgtgatgactcagtctccactcctccctgcccgtcactcctggagacgcccgcctccatcctcctgcaggtctagtcagacgcctacctaaacactaatggatactactctttgaattcggtacctgcagaacgccagggcagtctccacagctctgattattagttgggttcttagtccgggtccgttccgggtcctggactacggttcaggttcggcgtaggtacggtatcgagtaccaacgtagttaattttaaccacttagtaaagtcgagtacggtaggggtaggacggacgaaggtaagtagttaggttagggttatttacgtttacgtggtactaagtacgacctaacccttacctaactaaacggttcggttaggtacggggtaccgggtaccgggaacccggaacgggggtaaaccgtaaaggggttaacggtaaaactacggaaacggtacccggtaaacgttacgggtacggccgttcggaccctaaacccgg

SEQ ID NO: 99128 - DNA, 731 bp, Homo sapiens
  misc_feature: GYAE6OF01D6KY4.40.81.H04.1.454.CMB.1.raw
  modified_base (167)..(167): a, c, t, g, unknown or other
  misc_feature (167)..(167): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattcnccactctccctgcccgtcactcctggagacgcccggcctccatctcctgcaggtctagtcagacgcctacaaacactaataggatacctactctttagaattcggtacctgacaagaacgccgaggctacgtctccacacgtctctgattagttagttcgggttcttacggtccgggtcccgttccggggtccctaggaccgtacggttcgacggtggactaggtacggactacgaggtactaacgtaacggttaacttttaaccgtaaccgttaagtaaaacgtacggtaacggtacgggtaagggggtagggaacgggaccgtaaagggtaaaggttaagtttacgggtttaaggggtttaattttaacgtttaacgtaggtacttaacggtacgtaacccgttaaacccgttaactaaccgtaaacggtcggttacggttaaccgggggtacccgggtaacccgggtaaccgggtaaaacgggtaaccggtaaacggggtaacggtaaaaccgtaccgaaacggtacggtaacggttaggtcggtaccgtacgtaaccccg

SEQ ID NO: 99129 - DNA, 682 bp, Homo sapiens
  misc_feature: GYAE6OF01DEQA9.40.81.H04.1.454.CMB.1.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcnggggctggaggtgaagaagcctggggcctcgggtgaaggtcctcctgcaagatttctggaaaccnccctgagcaactactacatacactggatgcggcacggcccctggacgaggggtttgaggtggagtggggtgactaccaaccgtaccaggtaggtggacaacgtaaagtacgtacgaacgtaacgtaaccgttttacggacgggtaccgtacggggtaccaccgaacgttacggacccggttggggaacccggtccgtaaccctacgtacgaacggaccgaacgtacgtccgtaaccgtagtagggtacttacggttacggacgggtcccgggtaacgttaccggtaccgtaccgtacggaaccgaaccggtccggaacctaacgtagtaactttacgtagggtaaggaaaggtacggtacgggttcgggtacggtccgttaacccgggcggggtactccggaccgtacccgggtaccggggg

SEQ ID NO: 99130 - DNA, 743 bp, Homo sapiens
  misc_feature: GYAE6OF01DFBLE.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccacctcccaggtgcagctggtgcagtcgtgggctggaggtgaagagccgtgggccgtggtgaggtctctgacgtagtatttcgaggaaaccacccgtgacgaccaactaacctacataacacgtggataggccggcgacggccccgtggacggtagggggtttagagggtggtaggtgggggtagaacgtacccgaacccgtaccgaggtacgggtacggaacctaaacgtaaacggttactaaccggaacgtaacggttaaaccgttttacgggaacggggtaccggtaacgggttacccgaaccgtacggttaccggtaacccgggtttacggggggaacccggtccgttaaccccgaacgttaccgaacggtaccgtaaccgtaacgttaccctaacgtaacgttcgggtactacggtgggacggtaccgggtacgtccggtaccgtacggtaccggaccgtaaccggtacggaccgtacgtactaccgttaggtacggtagggaagttacggtacggttgggtacggtaccggtaccgggcgggtactccggaccgtcgggtacccgggg

SEQ ID NO: 99131 - DNA, 647 bp, Homo sapiens
  misc_feature: GYAE6OF01C2EIY.40.81.H04.1.454.CMB.1.raw
  modified_base (275)..(275): a, c, t, g, unknown or other
  misc_feature (275)..(275): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
tcagtctagcgactcacgaccggtgctcgatttagtagtgtagattcgcggggtgatcaggactcctcagttcaccttctcacaatgaggctccctgctcagctccgtggggctgctaatgctctgggtctctggatccaggtggggatattgtgatgactcagtctccactctccctgcccgtcacctccgtggagacgcccggccttcccattcctcctgacaggtctagtcagacgccctacctaaacacttaaatggaacttacctacttntttagaattggtacctgacagaacgccgtagggcagtcctccangcctntagatagtagttgggttctacgtcggtcctccgggtcctagtactaggttcaggtcggacgaggtggacttcgagttccaacgtagtactttacacgtaagtaaatcgaggtacgaaggggtaggaggtacgaaggaaggtagttagggtttacgggttaattttagttacgtgactaatccggtaacctaacctacttaacgtaacgttcgggtaggtaccgggacgggtaccgggtaaccgaaacggggtaaaccgaagggtaaggaaaccgtacgtaaacggaccgtaaacggttacggacggtcctaggtccgtaaccg

SEQ ID NO: 99132 - DNA, 625 bp, Homo sapiens
  misc_feature: GYAE6OF01AP4J9.40.81.H04.1.454.CMB.1.raw
  modified_base (284)..(284): a, c, t, g, unknown or other
  misc_feature (284)..(284): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctggaggtgaagagccgtgggctcggtgaggtctccgtgctaagtnttcgtaggaaccacctgagacaactactacatacacgtggatcgcggcacggcccgtaggacgtaggggttgaggtggagtggggtgactaccgaacccgtacgaggacggtaggactaacgtaaagtactacgaacgtaacgtaacgtttacggagggcgaacgggtaccacgtacgtacggaccgtgggacccgcgtaccgactccgacgacctaacgtacgtaccgtacgacgtaggtactccggtacggacggtaccggacgttacccggtacccgttcgaccgggaacccgacccgtaccggtacctaggttacgtttaaccgttacggtaacggg

SEQ ID NO: 99133 - DNA, 618 bp, Homo sapiens
  misc_feature: GYAE6OF01EP3TE.40.81.H04.1.454.CMB.1.raw
  modified_base (244)..(244): a, c, t, g, unknown or other
  misc_feature (244)..(244): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagcctggggcctggtgaggtctcctgcaagtnttcgtggaaccacctgagcaactacacatacactggatgcggcgacggccccgtggacgtaggggttgaggtgggaggtggggtagactaccgaacccgtaccgaggaggtggacaacgaaagtacacgaacgagtaacgtttacgaggacgacgggtacacgtagtcggaccgtgggaccgtcgtaccatacgagaccacgtacgtacctaacgtagtcggtacgtcgtaggacgggccggtacgtacggacctacgtacggaaccgtacgacggtccgagttacgttagttacgttaggtacggtaaggtacggttacggttcgggtaggaccggttaccgggcgggtacgtccggaccgtcgggtccgggg

SEQ ID NO: 99134 - DNA, 580 bp, Homo sapiens
  misc_feature: GYAE6OF01DJLT3.40.81.H04.1.454.CMB.1.raw
  modified_base (260)..(260): a, c, t, g, unknown or other
  misc_feature (260)..(260): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctccgtgcaagtatttcgtaggaaaccnccctgagacaactacctaacatacacgtggatggcggcgacggcccctaggacgtaggggttgaggtggagtggggtagactaccgaaccctacgaggaggtgacaacgaaagtctacgacgagtaacttcgaggacagggtcacgagtcgaccgtggaccgcgtacagtcacgcacgactctacgagtcggatcgagacgcgtactcgacctgtacgacgacgacgctagtgttactagtgtaaggacgtaggtacggttgggtacggcccggttaccgggcgggtactaccggtaccgtacggtccggggtaacccgg

SEQ ID NO: 99135 - DNA, 578 bp, Homo sapiens
  misc_feature: GYAE6OF01BR6K3.40.81.H04.1.454.CMB.1.raw
  modified_base (397)..(397): a, c, t, g, unknown or other
  misc_feature (397)..(397): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagacgcctacctaaacactaatggatactactctttgaattggtacctgcagaacgccagggcagtctccacagctcttagatattagttgggttcttacgtccggggtccgtccggggtccctgacgtagggttcagtggcaggtggatcgagtcacagttatttacatanaaatcagcgagggtaggagacaagaagtagtggttaggtatttattagtgactagtagtacctaacttactaactaacgttggtaggtacgggtaccggtaccggaccgggtaaacgggaacgaagggtaacggaaacgtacgaaacggtacgtaaacgttcggtacggtcgtcgtaaccg

SEQ ID NO: 99136 - DNA, 635 bp, Homo sapiens
  misc_feature: GYAE6OF01DMK43.40.81.H04.1.454.CMB.1.raw
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtcctccactcctccctgcccgtcactccgtggagacgccggcctccatcctcctgcaggtctagccagacgccctacctaaacacttaagtggaactactacttcgtttagaattcggtacctgacaagaacgccgagggcagtccaccangtcttntgattagtagttggttcttacgtcggccgtccgggtccngtacgtaggttcaggtcggcgtaggtgactcgagtctaacgtagttactttaacaacgtaagaaactcgaaggtacgaaggggtaggacggaacgaaggtaaaggtagttagggtttaaggttaatttaagttacgtcgtactagtacgaccctaaccgtactaacgtaacgttggtacggtacggtaccggaccgggaaccgaaacgggtaccgtaaagggtacggtaaaacgtacgaaacggtacgtaacgttacggaggacgtacgcgtaaccg

SEQ ID NO: 99137 - DNA, 626 bp, Homo sapiens
  misc_feature: GYAE6OF01D11JT.40.81.H04.1.454.CMB.1.raw
  modified_base (619)..(619): a, c, t, g, unknown or other
  misc_feature (619)..(619): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcattctccactcctccctcgcccgtcactccgtggagacgccggcctccattcctcctgctaggtctagtcaggacgcctacctaaaacactaatggaactacttacttctttagaattcggtacctgacaggaagccgaggcacgtccaccacagtcttcttagattagttagtttggggttcttagtccggggtcccgttccggggtccctagacgtaggttcgaaggtcggactaggtacggactcgaacgtaccaactaacgttaacttttaacaacgttaagaaaactcgaagacggtaaggggtaggaggacgaaggaagtagttagggttaggttatttaagtactgactatacgacctaaccttacgtaactagtcggtagtacgggtaccggtacggtaccgaacgggaactaagggtagaactacgaaacgtcgtaacgtggtacgngtacgac

SEQ ID NO: 99138 - DNA, 542 bp, Homo sapiens
  misc_feature: GYAE6OF01DW5R9.40.81.H04.1.454.CMB.1.raw
  modified_base (532)..(532): a, c, t, g, unknown or other
  misc_feature (532)..(532): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttctggaaacaccctgagcaactactacatacactggatgcggcaggcccctggacaggggtttgaggtggatggggtgatcgaaccctacaggaggtggcaacaaagtatcgaacagaactttcgagggcagggtcaccatgacctgggaacgcgtaccatcagtacacagtctacagtggatcgtgacgcgggactgggacctaaggccgtaacacgtaacggctgtagtacgagttagcggtaagagtacggtagacggtacttaacggtcgggactggacccgngtcggaccgg

SEQ ID NO: 99139 - DNA, 634 bp, Homo sapiens
  misc_feature: GYAE6OF01CH6HR.40.81.H04.1.454.CMB.1.raw
  modified_base (184)..(184): a, c, t, g, unknown or other
  misc_feature (184)..(184): n is a, c, g, or t
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (310)..(310): a, c, t, g, unknown or other
  misc_feature (310)..(310): n is a, c, g, or t
  modified_base (450)..(450): a, c, t, g, unknown or other
  misc_feature (450)..(450): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtgggatattgtgatcgacttcagtctccactctcccgtgccctnactccnggancgccgcctccatctctgcaggtctgtcagacgcctacctaaanactaatggactactacttnttagaattggtacctgacgaagaacgccgaagggtcacttcaccaactgccttnttagattataggttttcggggtacttaggtccgggcccgttaccgggtcctaggacgtaggttccaaggtcggacaggtcggtactcgacgtcaacgtagttatttaacacgtagaaaatcgagaggaagggtaggaganaaggtagtagtggtttaaggtactttagtacctagtacgagttacgacctaaccgtaaccttaagtaagtagggttacgtagggaccgggttaccggaaccggtaaacgggacgaaacggggtaacggtaacgaacgaacggtaaccggtaacgttggttacggaccgttacgccgtaaaccgg

SEQ ID NO: 99140 - DNA, 775 bp, Homo sapiens
  misc_feature: GYAE6OF01ESQCZ.40.81.H04.1.454.CMB.1.raw
  modified_base (756)..(756): a, c, t, g, unknown or other
  misc_feature (756)..(756): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctggagggtgaagaagccgtggggacccctcgggtagaacggtcctccgtgacaagtatttcgtaggaaaccacctgagactaactactacatacacgtggatcggcggcacgggccccgtaggacggtaggggtttggaggtacgggtaggtgggggtacggtacgtacccgtaaaccccgtaacccggtaggggaacgggttacgggaacctaaaaccgtaaaaaggttaccgttaacccggaaacgtaaacggttaaacccgtttttaccgggaaacgggggtaccggtaaacggggttacccaaacccgtacggttaccggtacccggttacgggggaacccggtcccggttacccgtaacgtaccgaacggtacctaaccggtaacgttaccgttaaccaggtttacgacgttcggtacggacggtaccggacgtaccggtaacccttgtaccgaaccgacccgaccggtacctagtcgtagttaccgtaggtacggaaggtacgttacggttggtccggaccggtacgggtccggtacgtaccggacccgngggtcggggtaaccccggg

SEQ ID NO: 99141 - DNA, 529 bp, Homo sapiens
  misc_feature: GYAE6OF01DVDKV.40.81.H04.1.454.CMB.1.raw
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtggggcctcggtgaaggtctcctgcaagtatttctaggaaacaccctgagcaactactacatacactggatgcggcacggcccctggacgtaggggttgaggtggagtggggtggatccgaaccctaccgaggaggtggacaacgaaagtactacgacagtaactttcgagggcagggtcacgagtcgaccgtcgggacgcgtcagtcagcacagtctagagtggatcgtagacggcgggactcggaccgacggacgacgagtacgcngtgntacgngngagtagcgtgtcgcgtacgcggncgcgngtacgg

SEQ ID NO: 99142 - DNA, 676 bp, Homo sapiens
  misc_feature: GYAE6OF01D2GTI.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcttggtggcagcagccgcaggacgcccactcccaggtgcagctggtgcagtcgtggggctggaggtagaagaggccgtggggcctcggtagaaggtctcctgacaagtatttcgtaggaaaccacccgtgacgacaactactacatacacgtggatcgcggcgacggcccgtaggacgtaggggtttgaggtggaggtggggtaggactaccgaacccgtaccgaagtacggtaggacaacgtaaagtacgtacgaacgtaaggtaaccgtttacgacgggtacgtaacgggtaccgaacccgtaagtaccggaaccggtcgggaaccggtaccggtaccgacgtccgaagaccgaacgtacggtaccttaacgagttacggatcgtaggacggcggtaccgtacgtacccgtacgtacgaccgacgacgaccgtagttcgtaagttacgttaggtaggtaaggtacggtacgggttcgggacggtacggtaccgggtcgggtacgaggtaccgtggtacggggtaaccccggg

SEQ ID NO: 99143 - DNA, 721 bp, Homo sapiens
  misc_feature: GYAE6OF01B4QVE.40.81.H04.1.454.CMB.1.raw
  modified_base (279)..(279): a, c, t, g, unknown or other
  misc_feature (279)..(279): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctactaaacactaatggatactactctttgaattggtacctgcagaagccgagggcagtctccanatcttctagattattaggttggttcttacggtccgggtcccggtccgggtcctggtacgtaggttcgaggtggacgtaggtagacgtacgacgtacaacgtaagtttaacttttaaccaacgtaaagtaaacgtacgagtacgggtaggggtacgggaggacgaaaggtaagttaggttagggttaaggtttaagtttaacttacgtacggactaacgtacgtaaccctaaccttactaaaccgtaaacggtttggtacgggttacggggaacccggggttacccgggaaaccgggaaacgggtaacccggtaaaggggttaaacgaaacgttacgaaaacggtaccggtaacggttcgggtacggtaccgtaccgaacccgaaccgtttactaccgtttcgtttaccgtttacctaccgttttacccccgttaacccccgg

SEQ ID NO: 99144 - DNA, 549 bp, Homo sapiens
  misc_feature: GYAE6OF01D5H9W.40.81.H04.1.454.CMB.1.raw
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagntttctggaaacaccctgagcaactactacatacactggatgcgcaggccctggacgaggggtttgagtggagtgggtgatcaacctacgagaggtggcaacgaaagtntcgaacagtaactttcgagggcagggtcaccatcgaccgtgggacgcgtccatcgagcacagtctacgatggatcgtgacgcggactgacctgtcgacgacacggaccagtacgtattactggtacggaaggtagtacggtttgggacggtccgttaccgggcgggtacctacggaaccgtcggtcggggaaccccggg

SEQ ID NO: 99145 - DNA, 580 bp, Homo sapiens
  misc_feature: GYAE6OF01CI794.40.81.H04.1.454.CMB.1.raw
  modified_base (184)..(184): a, c, t, g, unknown or other
  misc_feature (184)..(184): n is a, c, g, or t
  modified_base (190)..(190): a, c, t, g, unknown or other
  misc_feature (190)..(190): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (304)..(304): a, c, t, g, unknown or other
  misc_feature (304)..(304): n is a, c, g, or t
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
  modified_base (471)..(471): a, c, t, g, unknown or other
  misc_feature (471)..(471): n is a, c, g, or t
  modified_base (570)..(570): a, c, t, g, unknown or other
  misc_feature (570)..(570): n is a, c, g, or t
tcagtctagcgactcacgaccggtgctcgatttagtagtgtagattcgcggggacgtgatcaggactcctcagttcaccttctcacaatgaggctccctgctcagctcctgggctgctaatgctctgggtctctggatccagtggggatatgtgatgactcattctccactctccctgcccgtnactccnggagacgccggcctcagtctctgcaggtctagtcaganctacctaanactaatggatactactcttagaattcggacctgaccaagaacgccgaaggtcctagttcctaccaangtcctgttgattaagtcgttggggttactacggtccggggtccttccggggtaccctggaacctggttaccaaggttggcgtagtcggaatccgaggtccaanagtatttacactagaaactcgagtcgagggngagggatagaagtatggttacgagttactacgngacagtcaccaaacgttcaaccgtaatcggtgcggaccggtacggaccgtaaagggcccaaagggttcgaaaactccgaaagtaccgtaactaggtcgngtcgaacccg

SEQ ID NO: 99146 - DNA, 550 bp, Homo sapiens
  misc_feature: GYAE6OF01ARA0U.40.81.H04.1.454.CMB.1.raw
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
tcagtctagcgactcacgaccggtgctcgatttagtagtgtagattcgcgggcgacgaccggtgctcgatttagtagtgtagattcgcggggagagccatcacccagcaacccacatctgtcctctagagaatccccctgagagctccgttcctcaccatggactggaccctggaggatcctcttcttggtggcagcagccgcaggagcccactcccaggtgcagctggtgcagtctggggctgaggtgaagaagccgtgggcctcggtgaaggtctccgtgacagtattcgtacggaaccaccgtgagactaactaacgtacatacagtggatcgcggacgacggccccgtaggacgtaggggttgagtggnggtgggtcgactaccgaacccgtacgagaggnggacacaagtacgacgacagtacttacgacggtcgaggtccacagtcgaccgtggacgcgtcatccgagcacgtacgtctacagtgagttcgtacgaggtccggagtcgaccgtcgcgacgacgtacgacagtgtcgtcgtacgg

SEQ ID NO: 99147 - DNA, 678 bp, Homo sapiens
  misc_feature: GYAE6OF01EQPKW.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctggtgaaggtctcctgacaagtattcgtacggaaaccaccctgacgactaactactacaatacacgtggatcgcggcgacggcccgtaggacgtaggggttgaggtgggagtggggtagactaccaacccgtacgaggacggtcgacgaacgaaagtactacgaacgagtaactttcgagggacgtagggtaccaacgtacgtacggtaccgtacggggaccgccgtaccagtaccgagaccaacgtagtacctaacgtagtacggtactcgtagacggtacggtactaccggtacctcgtacggaaccgaccgaccgggtacctaagttacgttaacttacggtaggtaagggtaacggtagggttacgggttacgggtaccgggtaccggttaacccggggcggggttaccgtaccgggtaacccggtacggggtaccggggtaacccccgggg

SEQ ID NO: 99148 - DNA, 521 bp, Homo sapiens
  misc_feature: GYAE6OF01AUJZW.40.81.H04.1.454.CMB.1.raw
  modified_base (426)..(426): a, c, t, g, unknown or other
  misc_feature (426)..(426): n is a, c, g, or t
  modified_base (500)..(500): a, c, t, g, unknown or other
  misc_feature (500)..(500): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttgaggtggatggggtggagtcaaccctaccgagaggtggcacaaagtatcgacagaactttcagggcagggtcaccgatgacctgggacgcgtcatcagcacagtctacatggatcngagcgggacttggacctacgtcgacgacgacggccatgtattactggtgaggtagcgttaggtggcgtaccggngggacctgaccgacgtcgggg

SEQ ID NO: 99149 - DNA, 604 bp, Homo sapiens
  misc_feature: GYAE6OF01ECEOS.40.81.H04.1.454.CMB.1.raw
  modified_base (420)..(420): a, c, t, g, unknown or other
  misc_feature (420)..(420): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtgggggatattgtgatgactcagtctccactctccctgcccgtcactcctggagacgccggcctccatcctcctgcaggtctagtcagacgcctacctaaaacactaatggatactacttctttagaattggtacctgacaagaacgccgagggcagtctccacagtctcttgattagttagttggggttcttacgtccgggtccgtccgggtccctggacgtaggttcaggtggcgtaggtggatcgagtcaactagtattttacactaagaaatcagacgagggtaggaganaagaagtagtggttaggtatttagtactntanatcgactaacttactaactaacgtgtacggtacggacggtcggaaccgaacgggaaccgaaggtaacggaaactacgaaacggacgtaacgtcggtaggctacggacctaacgtacttcgtacgttaccttactaccgttcccgttaccccg

SEQ ID NO: 99150 - DNA, 577 bp, Homo sapiens
  misc_feature: GYAE6OF01A8YC1.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttggggttcttagtcgggtcctccggggtccctgacaggttcagtggcagtggatcgagtcacagtatttacactagaaatcagcgagggtggaggcagaagattggttagggtatttagttacgtgactatcgacctaaccttctaactaacgtgtaggtagggaccgggtacggaccgaagggaccgaaggtaggaaagtcgaaagaccgtaaacgtggtaggcgttacgacctaaccgtacttccgtaggttccctttaccgtactttccccgttacccccg

SEQ ID NO: 99151 - DNA, 550 bp, Homo sapiens
  misc_feature: GYAE6OF01BTRSZ.40.81.H04.1.454.CMB.1.raw
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcgggtgaagggtctcctgcaagtatttctggaaacaccctgagcaactactacatacactggatgcgcaggccctggacaggggtttgagtggatggggngatcaacctacgagaggtgcaanaagtatcgacagtaacttcgagggcagggtcacagtcgaccgtggaccgcgtccatacgagccactagtcctaacgagtaggtatcgaggacggacgggtaccgtgtaccgtacgtagaccgacgacggccagtacgtattacgtggtaggaagtacgtacggttcggtacggtaccgtccggcggggtctaccggg

SEQ ID NO: 99152 - DNA, 585 bp, Homo sapiens
  misc_feature: GYAE6OF01BLA2Y.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactcttgattggtacctgcagagccagggcagtctccacagctctgtatattagtttggggttcttagtccgggtcccgtccggggtccctggactaggttcgagtggctaggtgatcagttcacgtagtatttacactagaaatgagcgagggtggagacgagaagtagtggttagggtatttagttacgtgactagtacgacctaaccgttactaaccgtaaacgttggtacggtacgggtaccgggtccggaccggtaaacggggaaccgtaagggtaaggaaacgtcggaaacgcggtaaacgtgggtacgtacgtcgccgtaccgttacg

SEQ ID NO: 99153 - DNA, 662 bp, Homo sapiens
  misc_feature: GYAE6OF01AHAE9.40.81.H04.1.454.CMB.1.raw
  modified_base (162)..(162): a, c, t, g, unknown or other
  misc_feature (162)..(162): n is a, c, g, or t
  modified_base (648)..(648): a, c, t, g, unknown or other
  misc_feature (648)..(648): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactnagtctccactctccctgcccgtcactccgtggagacgcccggcctccatcctcctgcgaggtctagtcagacgcctactaaacactaaagtgatactacttctttagaagttcggtactgacgaagaacgccgaggacagtcctacactagcctacttagtattagttaggtttcggggtttactacggttccggggtcccggttccggggtccctaggacggtacggttacgagggtcggacgtaggtacggtacttacgagttaccaacgtaatttaacgtttaacaacgtaagtaaaactcgaaggtacgggtaaggggtaggacgggtaacgaaggtaaaggttagtttaggggtttaaggtttaattttaacgttcgtacgtacgtatacgtaacctaacctactaaccaagttggttaggtacggaccggtacggacggaaccgggtaacgaaggtacgaaagtacgaacggtagtacgnggtacgctcgaccg

SEQ ID NO: 99154 - DNA, 544 bp, Homo sapiens
  misc_feature: GYAE6OF01BKJNZ.40.81.H04.1.454.CMB.1.raw
  modified_base (448)..(448): a, c, t, g, unknown or other
  misc_feature (448)..(448): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagcctgggggcctcgggtgaaggtcctcctgcaagatttctggaaaccacctgagcaactactacatacactggatgcggcaggccctggacgtaggggtttgagtggagtggggtggatcaaccctaccgaggaggtaggcacgaaagtacgtcgaacagtaacttcgagggcagggtacacagtcgaccgtgggacnccgtccagtcagccacgagtctacagtcggattcgtggagcggactcggaccgtcgtacggaacgtaccgcggacctagtcgttagttactacggg

SEQ ID NO: 99155 - DNA, 570 bp, Homo sapiens
  misc_feature: GYAE6OF01ARMSM.40.81.H04.1.454.CMB.1.raw
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (533)..(533): a, c, t, g, unknown or other
  misc_feature (533)..(533): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagagccgtggggcctcggtgaaggtctcctgcaagtatttctaggaaacaccctgagacaactactacatacactggatggcggcacggccctggacgtggggttgaggtggagtggggtggactcgaacccgtaccgagaggtcggacaacgaaagtacgtcgacagtaactttcgagggctaggtcacngtacgaccgtcgggacncgtaccagtcagtcaactacggttccaacagtggtaattcgaggacggcggtacctacggacctcgtacgacacgaccggctagtcgttactactggtaggaggagtcggttggnggccgtacggcgggactcgaacccggtggtaccgggg

SEQ ID NO: 99156 - DNA, 590 bp, Homo sapiens
  misc_feature: GYAE6OF01DBZGG.40.81.H04.1.454.CMB.1.raw
  modified_base (572)..(573): a, c, t, g, unknown or other
  misc_feature (572)..(573): n is a, c, g, or t
  modified_base (575)..(575): a, c, t, g, unknown or other
  misc_feature (575)..(575): n is a, c, g, or t
  modified_base (578)..(587): a, c, t, g, unknown or other
  misc_feature (578)..(587): n is a, c, g, or t
  modified_base (589)..(590): a, c, t, g, unknown or other
  misc_feature (589)..(590): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggacgcccactcccgaggtgcagctggtgcagtcgtggggctggaggtagaagaagccgtggggcctcggtagaaggtctccgtgacaagtatttctaggaaaaccaccctgagcaactactacactacacgtgatcgcggcgacggcccgtggacgtaggggtttgaggtggaggtggggtagacgtacaacccgtacgaggaggtggacaacgaaagtacgacgaactaacgtaacgtttacgacgggacgtacgggtaccaccgaagtacggaccggttcgggaccgtacggtaccacgttacgaacgaccaacgtacggttacctaagtacgtagggtaactcggttaggacgggtccggggtcggtacgggaccgaagggtccgaacgtacgtagcgnngngannnnnnnnnngnn

SEQ ID NO: 99157 - DNA, 558 bp, Homo sapiens
  misc_feature: GYAE6OF01B4GH3.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctccgtgcaagatttctggaaacaccctgagcaactactacatacactggatgcggcaggcccctggacgaggggtttgagtggagtggggtgatcaaccctaccgagaggtgacacgaaagtatacgacagtaactttcgaggcagggtcacatcgaccgtgggacgcgtcatcagacactagtactacagtggatcgtagagccggtactacggacccgtacgtcgaaccgacgaccggtaccattcgtacttacgtaggtaggaagtaggtacggttggtcggtccgtaccgggtcgggacctcggccgcgggtaccgggg

SEQ ID NO: 99158 - DNA, 724 bp, Homo sapiens
  misc_feature: GYAE6OF01DIYLT.40.81.H04.1.454.CMB.1.raw
  modified_base (294)..(294): a, c, t, g, unknown or other
  misc_feature (294)..(294): n is a, c, g, or t
  modified_base (373)..(373): a, c, t, g, unknown or other
  misc_feature (373)..(373): n is a, c, g, or t
tcagtctagcgactcacgaccggtgctcgatttagtagtgtagattcgcggggacccaaaaaccacacccctccttgggagaatcccctagatcacagctcctcaccatggactggacctggagcattccttttcttggtggcagcaaacaacgaggtgcccactcccaggttcagctggtacagtcgtggagctgagatgaacgaagccgtggggcctcgaggtgaaggtctccgtgacaaggtcttcgtaggttaacctacctttaccaattagtggtatcgaggtttgggngacgaacgacggtccccgtagggaaccgtaagggtcttaggaggttggagtgggtaatggtatcgagcgtacctttaanaagttcggaccaacaaacaaattacgacgactaaccgaacgtaacccgcggaggacaacggacgtaccacaagtcgaaaccactacgaacctacactaccgacgaacgtccgacggacctaacgacgtacggacctaggaacggacgtacctaggagtaacgttcgaacggaaccgaaccggtaccggtccgttagttaacgtttcgtacgggtacgtaacggtaggtaaacggtacggtaaaccggggttaaatttaccggttttacggtaacgtttcccggttacccctttaggttaccggtaacggttccggacggggtaacccgtaaccgggtaaccccttaccggg

SEQ ID NO: 99159 - DNA, 559 bp, Homo sapiens
  misc_feature: GYAE6OF01EV27T.40.81.H04.1.454.CMB.1.raw
  modified_base (242)..(242): a, c, t, g, unknown or other
  misc_feature (242)..(242): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctctgcaagnttctggaacaccctgagcaactactacatacactggatgcggcacggcccgtggacgaggggttgaggtggagtgggggtgataccgaacctaccgaggaggtcggacaacgaaagtatacgaacgacgtaactttcgagggcagggtcacagtcgaccgtggacgcgtaccatcagcaacacgtactacagtcgatcgagacgcggactacgacctcgagacgacgacgactagtgtaacttacgtaggtaggaagtaggtacggttggcggtacgtaccgggtcgggacgtcgaccgtacggtcggggaacccgg

SEQ ID NO: 99160 - DNA, 655 bp, Homo sapiens
  misc_feature: GYAE6OF01CRTOI.40.81.H04.1.454.CMB.1.raw
  modified_base (244)..(244): a, c, t, g, unknown or other
  misc_feature (244)..(244): n is a, c, g, or t
  modified_base (325)..(325): a, c, t, g, unknown or other
  misc_feature (325)..(325): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagtnttcaggaaccacctgagcaactactacatacacgtggatggcggcacggcccctggacgtggggttgaggtggagtggggngatccgaaccctacgaggaggtggacaacgaaagtacgtacgaacagtaacttcgagggcgtacgggtccaaccgtagtacggaccgtgggaccgtacgtaccatcgacgtaccaacgtacgtactaacgagtacggacttcgtaggaacggtcggtaccgtacggtacccttacggtacggaaccgtaaccgaccggtacctaaggttcgttaacgttaccggtaggtaagggtaacggtacgggttaacggtttcggggtacgggtaacccgtacccggggtaccggggtacctacggacccggtacgggtccgggggtaaccccggg

SEQ ID NO: 99161 - DNA, 728 bp, Homo sapiens
  misc_feature: GYAE6OF01C8A3X.40.81.H04.1.454.CMB.1.raw
  modified_base (244)..(244): a, c, t, g, unknown or other
  misc_feature (244)..(244): n is a, c, g, or t
tcagtctagcgactcacgaccggtgctcgatttagtagtgtagattcgcggggactgatcaggactcctcagttcaccttctcacaatgaggctccctgctcagctccgtggggctgctaatgctcgtgggtctctggactccgaggtggggatattgtgatgactctattcctccactcctcccgtcgcccgtcacctcctggacgcgccgcctccatcctcctgcgtaggtctagtcagacncctaacctaaacaactaagtagtaactacttacggggttactttagtaattacgtaccgtgacgaacgaacgaccgacggacgtacgtcctaccgacacgtcgttcttagtattagttaggttacgggttcgttacggtccgggtcccggtcccggggtccctacggtacgtacggttacgtaggtcggtacgtagggtagtacgtacgtacgtacacgtaagttaactttaactaacgtaagaaaacgtcgtaagacgggtaggggtaggaggacggaaggtaaaggtagtttagggtttaggttaacttttagttacgtagtactacgtacgtaacctaaccgttaacgttaaacgtaacgtaggttacggtaccgggaccgggttaaccggaaccggtaaacggggtaaacccggtaaagggtaaacggtaaacgtaccggtaaacggtacggtaaacgtaggtacggtcgtacgtaaccg

SEQ ID NO: 99162 - DNA, 840 bp, Homo sapiens
  misc_feature: GYAE6OF01BT40V.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcgggtgaaggtcctccgtgactaagtacttcgtaggaaaccaccctgacgacaactacacatacactggatgcgcacggtcccgtggacgtaggggttttcgaggtgggtaagttgggggtaggtactaccgaaacccgttacgaaggtacgggtcggacgaaacgtaaaaggtactacggaaacgtaacgtaactttacggagggtacaacggggttaccaaccgtaagttccggaacccggttaggggaaccggtaccggtacccgtaacgtaccgtaacggtacctaaccgtacgggtttaccctaagtaaccggttaggtaaccgtttaccggttaacggaaccgggttacgggtaacccgtttacggggtaaccccgttaaccggggtaacgggtaacccgggtaaaccgtaacccgggggtaccttaacgggttaacgtttaaccgtttaaccggtacggggttaaacggtaaccgggtaacgggttaaccgggtttaccggggtaccggggttaaccccggttaacccggggggttaacccggggttacgggttaaccccgaaaccccgggttacccggggttaacgggggggttaaacccccccgggg

SEQ ID NO: 99163 - DNA, 818 bp, Homo sapiens
  misc_feature: GYAE6OF01A4PT3.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagcccggcctccatcctctgcaggtctagtcagacgccctacctaaacactaatggatactacttcttagtaattcggtacctgacagaacgccgagggcagtcctccacgacgtcttcttagtattagttacggttttggggtttaccttacggtccggggtaccccgttccccgggggttccctacggtaaccgtacgggtttaccgtaacgggtcggaccggtaagggttacgggtaacttaccgtaacggttaccgtaaaccgtaagtttaaactttttaaccgaaaccgtttaaaggttaaaaaccgttaccggaacgggtaacgggtaaacggggggttaacgggtaacggggaaccgttaaagggtaaagggttaacgtttaggggttttaagggttaacttttttaaacgttaacggttagtaacctacggttaccgtaacccgttaaacccgttaaccgttaaaccgtaaaccgttagggttacgggtaaccggggttaccgggtacccgggaaaccgggtaaacggggtaaaccggtaaacggggtaaacggtaaaacgtaccggtaaacggtaaccggtaaaccggtgggtaccggtacgtccggtaacccg

SEQ ID NO: 99164 - DNA, 523 bp, Homo sapiens
  misc_feature: GYAE6OF01B9EBB.40.81.H04.1.454.CMB.1.raw
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggggcctcgggtgaaggtctcctgcaagtatttctaggaaacaccctgagacaactactacatacactggatgcgcagcccctggacaggggtttgagtggagtggggtggatccgaacctaccaggaggtgcaacaaagtancganagtactttcgaggcagggtcacatgactgggacgtcgccatcgagctaacngtactacngtggaatctggacgcggacgtcggacctcggtacgacgacgacggcatgtactatgaggaagnggacgttgtgctacccggggnggactcgccgtgtcgg

SEQ ID NO: 99165 - DNA, 522 bp, Homo sapiens
  misc_feature: GYAE6OF01A0OGW.40.81.H04.1.454.CMB.1.raw
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagtatttctggaaacaccctgagcaactactacatacactggatgcggcaggcccctggacgaggggtttgagtggagtggggtggatcaaccctaccagaggtggcacaaagtatcgacagtaactttcgagggcagggtcaccgatcgacgtgggacgcgtccatcagcacacgtctacatggatcgtggacggccgggacttcggaccgtaggcgacgaacgtacggctangtatagtgtganaggtcgtagtgacgtaccgcggntcgcgcgtacggg

SEQ ID NO: 99166 - DNA, 751 bp, Homo sapiens
  misc_feature: GYAE6OF01B48AO.40.81.H04.1.454.CMB.1.raw
  modified_base (187)..(187): a, c, t, g, unknown or other
  misc_feature (187)..(187): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtncagtcgtggggctggaggtgaagaagtccgtggggcctcggtgaacggtcctccgtgacaagtaccttcgtaggaaaccaccctagaacgacctaaactaacctactaactaactacgtggtaactcggccggtaccgaccgggtacccccgtaggggtaaccgggttacggggggttttacggaacgggttacggggtacgggttaggggggtacggtaaccgtaccccgaaaccccgttaaccggaaggggtaacgggttacggggaacctaaacggtaaagttacgtaccggaaacgtaacgtaacgtttcggaagggcgtaacgggtaccaccgtaagtccggtaaccggttacggggaccgtccgtaacgtacgtacgacggtacgtaacgtagttacctaaacgtaggttagtacgtcgtacggtacgtcggtacgtacgaccgtacggtacgaccgacgtaccgtaccgtagttagtacgtaccgtaggtacggaacgtgttaccgggttggtcccggtctaccgggtcgtcgaccgtcggtcggtcgggaacccgg

SEQ ID NO: 99167 - DNA, 734 bp, Homo sapiens
  misc_feature: GYAE6OF01B9BHD.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctcgtgggtctcgtggactccgaggtggggatagttgtgatgactcagtctccactcctccctcgcccgtcactccgtggacgacgcccgcctccatcctccgtgacgtaggtctagtcacgacgtacctaacctaaactactaagtggtaacttaaccttacttcgtttagaacgtttcggtacctgacgaagaacgccggaggtctacgtcctaccacacggtcttacgttagtattagtttacggttcggggtttacttacggtcccggggtcccgtttcccggggtacctaggacggttacggttcgaagggtcgacgtaggtacggacttacgacgtactaacgtagttaactttacaacgttaaggaaactgacggtagggtaagggtaggaacgtacggaaaggtaacggttaggtttagggtttaacggttaattttaacgtacgtcgtaagtacgtaccgtaaccttaaccgttaacgtaaccgtaacgttgggtacgggtaccgggtaccgggtaccggaacgggtaaacgggtaaccggtaaggtaacgaaacgtaccgtaaacggtaccgtaacggtggtacggtcgtacgtaaacccg

SEQ ID NO: 99168 - DNA, 540 bp, Homo sapiens
  misc_feature: GYAE6OF01D0A8R.40.81.H04.1.454.CMB.1.raw
  modified_base (243)..(243): a, c, t, g, unknown or other
  misc_feature (243)..(243): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatcctcctgcaggtctagtcagagcctacctaaaanactaataggatactactctttgaattcggtacctgcagaagccagggcagtctcacagctctgatatagttgggttctagtccggccgtccggggtcctgactaggttcagtgcagtggatcagtcactagtatttacaactagaaaatcagcgtgggtggagcaagaagtattggttaggtatttatatgctatgctaacctctaacaactggtacgtagggaccggtacggacccgaaagggtacccgaagggtacggaaatcgaaagtccgaacgttggtacggcttggacccg

SEQ ID NO: 99169 - DNA, 397 bp, Homo sapiens
  misc_feature: GYAE6OF01DOA5W.40.81.H04.1.454.CMB.1.raw
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (394)..(397): a, c, t, g, unknown or other
  misc_feature (394)..(397): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttctggtggcagcagccgcaggagcccactcccaggtgcagctggtgcagtcgtggggctgaggtgaagaacgccgtggggccctcgggtagaacggttcctcctgacaaaggtatttcgtacggaaacacccctggaacgactaactactacaatacaactggactgcgcgacggcccctggacgtagggtttgaggtgagtggggagatccaacctacgagaggtggacaacaaagtntacgaanagtaaccnnnn

SEQ ID NO: 99170 - DNA, 643 bp, Homo sapiens
  misc_feature: GYAE6OF01C7YDV.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactcctccctgcccgtcactcctggagacgcccggcctccatcctcctgcaggtctagtcaggacgcctactaaacactaatggaacttactacttcttagtaagttcggtacctgacaaggaacgccgagggctaagtcctaccaacgacgtcttacttgtaattaagtttaggttcggggttacttacggtcgggtcccgttccgggtccctgaacgtcggttcaggtgacaggtggatacgagtacacgtagtaactttaacacgttaagaaactcgagtacgaggggtaggaggacgaaggtaagtagtggtttaagggttaattttacgttacgtagtaactagtacgtaacctaaccttaacgtaactaaacgttggtacggtacggggtaccggtaccggaacgggtaaacgggaccgtaaagggtaggaaacgttacgaaaggcgtaagtggtagcgtgaccgtaacg

SEQ ID NO: 99171 - DNA, 677 bp, Homo sapiens
  misc_feature: GYAE6OF01D5ZVX.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactcttgaattgtacctgcagaagccgaggcagtctccacagcttcttgattaataggtttggggttctttagtccgggcccgttccggggtcctgacgtaggttcaggtggacgagtggatcgagtcaacgagttaattttacgacttagaaaaactcgaagacggtaggggtagggaaggacgaaggtaaaggtagttacgggtttagggttaattttaacgttacgtagtactagttacgtaacctaaacccttacttaacctaaacgttggtaggttacgggacgggttaccgggaccgaaacggggtacccgtaaagggtacgggaaaactacggaaacggaccggtaaacggttggttacgggtaccgtacggaccgtaacccgtagtttaccttcggtttacccttaccgttaccgttccccgttacccccgg

SEQ ID NO: 99172 - DNA, 599 bp, Homo sapiens
  misc_feature: GYAE6OF01CS2LU.40.81.H04.1.454.CMB.1.raw
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (438)..(438): a, c, t, g, unknown or other
  misc_feature (438)..(438): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccaggtggggatattgtgatgactcagtctccactctccctgcccgtcactcctggagagcccggcctccatctcctgcaggtctagtcagacgcctactaaacactaatggatactactctttagaattggtacctgcagaagccgagggcagttcnccanagcttctgattagtagttgggttcttagtccgggcctccggggtcctgacgtaggttcagtgctaggtgatcgagtcaactagtactttacgatagaaatcgagcgagggtgaggcaagaagtagtggttggtatttatacngctaagtcgactaacctactaactaaacgtggtacggtaggaccgggttaccggaaccggtaaacgggtaacccggtaaagggtaacggaaaacgttaccggaaacggtaccggtaacggttcgggtacgggtaccgttacggaaccgtacccgttaaacg

SEQ ID NO: 99173 - DNA, 665 bp, Homo sapiens
  misc_feature: GYAE6OF01B110F.40.81.H04.1.454.CMB.1.raw
  modified_base (497)..(497): a, c, t, g, unknown or other
  misc_feature (497)..(497): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactcctccctgcccgtcactcctggagacgcccggcctccatcctcctgcaggtctagtcagacgcctacctaaacactaatgatactacttctttagaagtttcggtacctgacaagaacgccgagggctacggtcctccacacgtcttcttgattagttaggtttcgggttactacgtccggggtcccgtaccggggttcctagtacgtaggttcaggtgcgagtggactactagtacaacgtagttaactttacaactaagtaaacttcgaacgtggaagggtaggacggacgaagtaagtaggttaggtttaggtatttaagttacgngtactatacgtacctaaccgttactaaacgtaacgttggtacgggtacgggtaccgggtaccggaacccgggtaaagggtaaccggtaagggtaaacgggtaaactaccgggtaaacgtaccgggtaacgttcgggtacggaccctacggacccgtaaccgtttaacg

SEQ ID NO: 99174 - DNA, 754 bp, Homo sapiens
  misc_feature: GYAE6OF01BIVZW.40.81.H04.1.454.CMB.1.raw
  modified_base (248)..(248): a, c, t, g, unknown or other
  misc_feature (248)..(248): n is a, c, g, or t
tcagtctagcgactcacgaccggtgctcgatttagtagtgtagattcgcggggactgatcaggactcctcagttcaccttctcacaatgaggctccctgctcagctccgtggggctgctaatgctctgggtctctggactccagtgggatatgtgatgactcattcctccactctccctcgcccgtcacctccgtggacgacgccggcctcatctcgtgctaggtctagtcagacgcctaccgtaaanactaagtcggtacttactacttctttagaactttcggtacctgaccgaagacgaccgtagggctacgtcctaccagacgtccttcgttagattacgttaggttcgggtttcttaacggtccgggtacccgttccgggtacccttggacgtacggtttcgaggtcgtaccgaggtaggtactaccgacggtactaacgtacgtttaacgtttaacgaacgtaacgtaaaacttcggaaacggtacggtaaggggtcgaacgggtacgaaaggtaacgggttaagttacgggtttaaggtttacttttaagtacgttcggacgttacgtacggtaaccctaaccgttaacgtaaccgtaacggttcgggtacgggttaccgggtacccgggtacgtaacccggggtaaacggttaaccgggaaaggttaacccggtttaaacgaaccggtaaacgtaacccgggttaacggtaccggttaccggggttaccgtacccggttaacccgg

SEQ ID NO: 99175 - DNA, 779 bp, Homo sapiens
  misc_feature: GYAE6OF01EWQ33.40.81.H04.1.454.CMB.1.raw
  modified_base (727)..(727): a, c, t, g, unknown or other
  misc_feature (727)..(727): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggactccaggtgggatattgtgatgactcagtcctcccacttcctccctcgtcccgtcacctccgtaggacgcgcccggtcctccactcctcctgccgtaggtctagtacagacgtaccctaacctaaaactaactaagtaggtaacttaccttacttcgtttaagtaacgtttcggtacctacggactaaacggaacggaccggaacggctaacggtccctaccgactacggtccttcgttagagtttacgtttaggttttcgggttaccgtttaccgggtcccgggttacccggttccccgggggttacctacggtaacgttacgggtttaccgtaggtcgggttacgtagggtacggtactaccgtaagtacctaacgtttacgtttaatttaaaccgaacttaaaggtaaaccttcggacgggtaacgggtaggggtaacggaggtaacgaagggtaagtttagggtttagggtttaatttaacgttttaacgtcgtagtaacctacgtaccgttaaccaacctttacggtaactagggtttaggacggttaaccgggacgggtaccgtaaacgggacgggtaaaacgngggttaaacgaacgtggaaaccgtacggacgtaggtacggtccgtgtacccg

SEQ ID NO: 99176 - DNA, 692 bp, Homo sapiens
  misc_feature: GYAE6OF01EPISF.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcgaggacgcccactcccaggtgcagcgtggtgcagtcgtggggctggaggtgaagacgccgtggggcctcggtgaaggtcctccgtgacaagtatttcgaggaaaccaccgtgacgactaactactacatacactggatggcggcgacggtcccgtggacggtagggggtttcgaggttgggaggtgggggtacggacgtaccctaaacccgtaccgaggtacggtacggaccgaaacgtaaaacggtacgtaccgaaaccgtaacggtaaccgttttacggacggggtacgaacgggttaccaacctaacgtacggtaacccggttacggggaccggtacccgtacccgtaacgtacgaaccgacgtaacccgtacggttaccttaacctaggtacgggtacttacggtacggaacgggtccggtacgtaccggaccgtacgtacggaacgtacgacggctagtgtaatacgtagtacggagaggtacggtggacggtcgaccggtcgggactaggacctggcgggtaaccgg

SEQ ID NO: 99177 - DNA, 682 bp, Homo sapiens
  misc_feature: GYAE6OF01DB8RP.40.81.H04.1.454.CMB.1.raw
  modified_base (254)..(254): a, c, t, g, unknown or other
  misc_feature (254)..(254): n is a, c, g, or t
  modified_base (658)..(658): a, c, t, g, unknown or other
  misc_feature (658)..(658): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccgaggtgcagctggtgcagtcgtggggctggaggtagaagaacgccgtgggggcctcgggtgaaggtcctccgtgcaagtntttactacggaaccaccctgacgaccaactactacatacacgtggatcgcggcacggcccgtggacgtaggggtttgaggtgggagtggggtagactaccgaaccctacgaggtacggtgacaagaagtacgtacgaacgtaagtaacgttacgagggacgtacgggtaccaacgtagtacggtacccggtcggggaacccgtccggttacccagttaccgaacggacccgtaacgaccggttacctaacgtagtacgggtacgttcgtaagggacggtacgggtacgtacggaacccgttacggtaccggaaccgtacgaccggtactagttcgttacgttaccgtagggagggtaacggtaggttacggtttgggacggtcgttacggtcgggtaccgggtntaccggcccggtgggtacccgggg

SEQ ID NO: 99178 - DNA, 580 bp, Homo sapiens
  misc_feature: GYAE6OF01CGAYS.40.81.H04.1.454.CMB.1.raw
  modified_base (391)..(391): a, c, t, g, unknown or other
  misc_feature (391)..(391): n is a, c, g, or t
  modified_base (569)..(569): a, c, t, g, unknown or other
  misc_feature (569)..(569): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtggggcctcggtgaaggtctcctgcaagtatttcgtaggaaaaccacccgtgagacaactactacatacactggatgcggcgacggcccgtggacgtagggtttgaggtggtagtggggtaggacgtacaacccgtacgaggacggtggacaacgaaagtacacganagtaacttcgagggacgaggtcaccagtacggaccgtagggacgcgtccagtcagcacgtagtcctacagtacggacttcgtacggacggtaccggtacgtacggaccgtacgcggaacgacgtacggaccagtagtacgtacgtaggtacgagtagacggttggtaggcgtaccggngggtcgtacgg

SEQ ID NO: 99179 - DNA, 578 bp, Homo sapiens
  misc_feature: GYAE6OF01A9NR5.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagtatttctggaaaccaccctgagacaactactacatacactggatgcggcacggcccctggacgtaggggtttgaggtggagtgggggtggtactaccaacccgtaccgaggtagggtaggaccaacgaaagtatcggaacagtaaacgtttcgaagggcgaacggggtccaaccgagtacgaccgtcgggacgccggtaccagtacgagccacgtacgttactaacgagtcggacttcgtcgaggtccggactcggaccctcgacgtacgaacgacggactagtcgtaagttgtacgg

SEQ ID NO: 99180 - DNA, 577 bp, Homo sapiens
  misc_feature: GYAE6OF01BU0KK.40.81.H04.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagntttcnggaaacaccctgagcaactactacatacactggatgcgcaggccctggacgtaggggtttgaggtggagtggggtggatccgaaccctacgaggaggtggacaagaaagtatacgaacagtaactttacgagggctagggtacaccgatcggaccgtagggaccgtccgtcaagtcgacgacaacgacgtcactagtacggatcgtagagcggaactcggacctgtacgacgtacgacggcctagtcgtattacgtaggtaggaagtacgacggtttggacggtccgtaacgggtcggggactacggaccgtacgggtcgggtacccggg

SEQ ID NO: 99181 - DNA, 738 bp, Homo sapiens
  misc_feature: GYAE6OF01AJGOB.40.81.H04.1.454.CMB.1.raw
tcagtctagcgactcacgaccggtgctcgatttagtagtgtagattcgcgggcgtagactttgtgtttctcgtagtctccctgctcagctccgtggggctgctaatgctcgtgggtctcgtggactccaggtgggattattgtgatgactcagtctccactcctccctcgcccgtcacctccgtggacgacggcccggcctccactcctccgtcggccgtacggttcctacgtcgaacggtacgtacccttaacctaaaaccactaacgtacggtaacttaccttacttcgtttagtaacgttcggtacctgacgacgaacgcgaggctacgtccaccgacgacgtcttcgttagaacttacgttacggtttcgggtttaccttacggtccgggtccgttccgggtcctaggtacgtacggttacgacggtcggtacgtaggtacggtactacgacgtaccgaacgtacgttaactttacgaacgttaacgtaaactcgaacggtacggtagggtacggacggtacgaaggtaagtagttaggttaggttaactttagtacgtacgtacgtagtacgacctacttactaacgtaacgtcggtaggtacggtacggtacggacggtaaacgggtaacgtaagggtacgtaaacgtacggaacggtacgtaacggtcggtacggtacgtacgaccgtaacgtacgttacgttacgttacgttaccgttcgttccgtaccg

SEQ ID NO: 99182 - DNA, 536 bp, Homo sapiens
  misc_feature: GYAE6OF01EZ37M.40.81.H04.1.454.CMB.1.raw
  modified_base (518)..(518): a, c, t, g, unknown or other
  misc_feature (518)..(518): n is a, c, g, or t
  modified_base (522)..(524): a, c, t, g, unknown or other
  misc_feature (522)..(524): n is a, c, g, or t
  modified_base (526)..(536): a, c, t, g, unknown or other
  misc_feature (526)..(536): n is a, c, g, or t
tcagtctagcgactcacgaccggtgctcgatttagtagtgtagattcgcgggtgtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggtcctcctgcaagatttctaggaaacaccctgagacaactactacatacactggatgcggcgacggcccctagggacgtaggggtttgagtgggaggtggggtggatccaacccgtacgaggaggcggacaacgaaagtatacgacagaactttacgagggtcgaggtcaccagtcgacgtgggacgcgtaccgactacgagccacgacgttactacagtcggagtcgtggacgggtccgggtcgtacgggtacgaacgggtccgacgaagtaacggngagnnngnnnnnnnnnnn

SEQ ID NO: 99183 - DNA, 589 bp, Homo sapiens
  misc_feature: GYAE6OF01BOZX5.40.81.H04.1.454.CMB.1.raw
  modified_base (299)..(299): a, c, t, g, unknown or other
  misc_feature (299)..(299): n is a, c, g, or t
tcagtctagcgactcacgaccggtgctcgatttagtagtgtagattcgcggggacgtgatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgccaggtctagtcagagcctacctaaacactaatggatactactctttgaattggtacctgcagaagccagggcagtcctccanagctcttagattagttagttggggttcttagtcgggtccctccggggtccctgacaggtcagttggctagtggatcagtcacgtagtatttacactagaaatcaagtcgagggtaggaggacaagaacgagttggttaggttatttagtactgactagtcgtacctaacctctaacaacgttcggtaggtacgggtaccgggtacggaccggtaaacggggaacccgtaaagggttacggaaagtacggaaacggtaccgtaaacgttggtaccgggcgtcggtaacccg

SEQ ID NO: 99184 - DNA, 541 bp, Homo sapiens
  misc_feature: GYAE6OF01AGN1Y.40.81.H04.1.454.CMB.1.raw
  modified_base (246)..(246): a, c, t, g, unknown or other
  misc_feature (246)..(246): n is a, c, g, or t
  modified_base (350)..(350): a, c, t, g, unknown or other
  misc_feature (350)..(350): n is a, c, g, or t
  modified_base (476)..(476): a, c, t, g, unknown or other
  misc_feature (476)..(476): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtgggggcctcggtgaaggtctcctgcaagtntttctggaaacaccctgagcaactactacatacactggatgcggcaggcccctggacgaggggtttgagtggagtggggtggatcaaccctacagaggtggcanaaagtatcgacagaactttcagggcaggtcaccgatcgactgggacgcgtccatcagcacagtctacagtgactcgtagagcggactcggacctacgtacgacgacgacggccagtgtacttacgngtacggagagtacggttggacggtcgttaccggcgggtcgtaggcccgacggtgggtaacccggg

SEQ ID NO: 99185 - DNA, 591 bp, Homo sapiens
  misc_feature: GYAE6OF01D5BOR.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatatagttgggttcttagtcgggcctccggggtccctgacgtaggttcagtggcaggtggatcagtcacagtattttacactagaaatcaagcgaaggggtggaggacaaggaagagttggttagggtaattttagttactggtactagtacgacctaaccttactaaactaacgttggtggttacgggacgggtccggaccgaaacggggaaccgaagggtaggaaagtacgaacggaccgtaagttcggtggccgtcgacctaccgagttcgttacgttcctttctcgttcccgttaccccg

SEQ ID NO: 99186 - DNA, 637 bp, Homo sapiens
  misc_feature: GYAE6OF01AM2KJ.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagtatttctggaaacaccctgagcaactactacatacactggatgcggcacggcccctggacgtaggggtttgaggtggagtggggtggactccgaacccgtaccgaggacggtcggacaacgtaaagtatacggaactaaggtaacctttcgagggaccaggggtacaccgagtcggaccgtcggggaccgtcgtaccatacgacgacaacgtacgtacctaacgagtacggaacttcgtaggacggaccggtactacggacccgttcgtacggaccgaaccgaccggtaccctagttagttacgtttacgtgggtacgggtaaggagggttacggttgggtacgggtccgttaccgggcggggtacgtacggacccgtacgggtcggggtacccgg

SEQ ID NO: 99187 - DNA, 631 bp, Homo sapiens
  misc_feature: GYAE6OF01BY575.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgcaggtctagtcagacgcctacctaaacactaatggactactactctttgaattggtacctgcaagacgccgagggcagtctaccacacgtctctgatatagtttgggttcttagtccggggcccgtccggggtcctgacgtaggttcaggtcggctaggtggatcacggtcacgtagtacttttacgactagaaatcgagcgagggtggaggacgaaggtaagtagttggttaggtattttagttacgtgactacgtacggtacctaacccttacgtaaccgtaaacgttggtacggttagggtacccgggtaccgggtaaccggaaacgggggtaaccgtaaaggggtaacggaaaacgttaccggaaaacggtaccggaaacgttacgggtacgggtcccgtacggtaaccccg

SEQ ID NO: 99188 - DNA, 576 bp, Homo sapiens
  misc_feature: GYAE6OF01C0ICV.40.81.H04.1.454.CMB.1.raw
  modified_base (567)..(567): a, c, t, g, unknown or other
  misc_feature (567)..(567): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggacgcccactcccaggtcgcagctggtgctagtcgtggggctggaggtgaagacgccgtggggcctcggtagaacggtctccgtgactaaggtattttcgaggaaacctacccgtgacgacaactactacatacactggatggcggcacggccctagggacgtggggttgagtggacggtgggtgactaccaacctacgaggaggtcggactaacgaagtatccgaacgtaacgttaacgttacgaagggcgacgggtccaacctagtacgaccgtgggaccgcgtaccactacgacgtcgactacgttctaagtagtcggtactcgtaggaggtccggacgtggaccgcggacagacgtcgacagngtctgtacg

SEQ ID NO: 99189 - DNA, 739 bp, Homo sapiens
  misc_feature: GYAE6OF01ES65M.40.81.H04.1.454.CMB.1.raw
  modified_base (733)..(739): a, c, t, g, unknown or other
  misc_feature (733)..(739): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtagaagaagccgtggggcctcggtgaaggtctcctgcaagtactttcgtacggaaacctacccgtgacgactaaactactaacactaacacgtaggatcggccggacgacggccccgtgggtaccgtaggggtttgaggtggtaggtggggtagactaccgaacccgtacgaggtacggtcgacaacgtaaagtacgtacggaactaacggtaacgtttacggacgggtaccgtaacggggtacccaaacccgtagttaccgggtaacccgggttacggggaaccccggtaccggttaccccgtaaacggttacccgaacgggtacccgtaaaccgtacgggttaacccgttaaacggttaacgggtttaacggggttaaaccggtttaacccgggggttttaaaacccggggggggtaaaccccggggggttaacccccgggggggggggtttaaaccccggggttttaaaccccggggggggggtaaaaaccccccggggggtttaaaaaaccccgnnnnnnn

SEQ ID NO: 99190 - DNA, 773 bp, Homo sapiens
  misc_feature: GYAE6OF01DHHUI.40.81.H04.1.454.CMB.1.raw
  modified_base (134)..(134): a, c, t, g, unknown or other
  misc_feature (134)..(134): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggntcctcttcttggtggcagcagccgcaggacgccccacctccccgagggtcgcaggccgtggtcgcgaggttccgtgggggcctaggagggtagaaaggaacggcccgtcgggggcctcgggtagacgggttcctccgtgacctaaggtactttcgtacggaaaccctaccgtggacactaactactacactacacgtggatcggcggaccgaccggtccccgtagggaccggttagggggtttcgaggtagggaggtagggggtcgtaacctacccgaaccccgtaaggacgggacggtacggaacctaaacgtaaaggttaccgtaaccggaacgtaaacggttaaccgtttacgggaccgggtacggtaaccgggtaccaaccgtacggtaccggtaacccgggtacgggtacccggtccgtaacctaacgtaccgacgtacctaacgtaccgtactaacgtacggtacggtactacggtaggacggaccgggtaaccgcggtaaccggtaccggacgtaccggtaacgaccgacgtacgtagttacgtacgtaggaacggtacgtagggttacggtggacggttccggtaccggggtcggtaaccgtccggacgtcgggtccgggtaaaccccggg

SEQ ID NO: 99191 - DNA, 642 bp, Homo sapiens
  misc_feature: GYAE6OF01ESRF0.40.81.H04.1.454.CMB.1.raw
tcagtctagcgactcacgaccggtgctcgatttagtagtgtagattcgcggggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagagccgtggggcctcggagaaggtctccgtgacaagtatttcgaggaaaccacccgtgacgacaactactacatacactgatcgcggcgacggcccgtggacgtaggggttgaggtggtagtggggtagtactaccgaacccgtacgaggacggtcggacaacgtaaagtagtacgaacgtaacgtaacgtttacggacgggtacgacgggtaccaacgtagtcgaccggtacgggaccgtccggtacctacgacgacgaccaacgtacgttacctacgacgtgtacttcgaggacgcggcgtacggtacctcggtacaccggacaccggtactagtacgtacgttacgtaggtaggaacggtaggttacggttcggacggtccggtaccggggtcgggtacgtacggaccggtcgggccggggtaacccgg

SEQ ID NO: 99192 - DNA, 576 bp, Homo sapiens
  misc_feature: GYAE6OF01CL3QW.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaaacactaaatggatactactctttgaattggtacctgcagaagccagggcagtctccacagctcttgatatagttgggttcttagtcgggcctccggggtccctgactaggttcaggtgcagtggatcgagtcacagtattttacactagaaaatcagcgtgggtggaggacaaggaagagttggttacgggtattttaagttactgactagtacgtacctaaccttacgtaaacaacgttggtcggtacggtacgggtaccggaaccgaaacgggtaccgaaagggtacggaaaacgtacgaaacggtacgtaaacgtggtacggcgttggaaccc

SEQ ID NO: 99193 - DNA, 589 bp, Homo sapiens
  misc_feature: GYAE6OF01C0UIT.40.81.H04.1.454.CMB.1.raw
  modified_base (353)..(353): a, c, t, g, unknown or other
  misc_feature (353)..(353): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctccaaacactaatggatactactctttgaattgtacctgcagaagccagggcagtctccacagtctctgatatagttgggttctagtccggccgtccggggtcctgacaggttcagtcggcnggtgatcagtcacagtactttacactagaaatcagtcgtagggtggaggcaaggaagagttggttagggtattttacttacgttgacgtatgacctaaccttacgtaacctaacgttgttacggtcgggaccgggttacgggacccggtaaacggggtacccggaaaggggttacgggaaaacgttaccggaaaacggtaccgggtaaacgttgggtacgggtcgtccgtaacccg

SEQ ID NO: 99194 - DNA, 550 bp, Homo sapiens
  misc_feature: GYAE6OF01CAATZ.40.81.H04.1.454.CMB.1.raw
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagcccggcctccatctcctgcaggtctagtcagagcctacctaaacactaatggatactactctttgaattggtacctgcagaagccgagggcagtctccacagctctgattatagttgggttcttacgtcgggccgtccgggtccctgacgaggttcagtggcgagtggatcagtcagagtatttacactagaaatcagcgagggtggagngaagagatggtaggtatttagtactgacagtcgacacttanaactaagtgtaggtcggacggtaccggacgaacgggacgtaggagaaagtacgaagtacgaacgtggtagctggaccctacgtacttcttacgttacttcctacgttcccgtaccccg

SEQ ID NO: 99195 - DNA, 609 bp, Homo sapiens
  misc_feature: GYAE6OF01AK5Z3.40.81.H04.1.454.CMB.1.raw
  modified_base (264)..(264): a, c, t, g, unknown or other
  misc_feature (264)..(264): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagagccgtggggcctcggtgaaggtcctcctgacaagtacttttcgtaggaaaccncccgtgacgacaactactacataacactggatggcggcacggcccctggacgtagggggtttgaggtgggagtggggtgtatccgaaacccgtacgaggtacggtcggacaacgaaacggtctacgaacgaagttaaacgtttccgaaggggtcgaacgggttcaaccgtagtcggacccgtggggacgtccgtccatcgacgcacgacgtcacagtgactcgagagcggtactcggacctgtacgaccgacgacgtccattcgtacttacgtggtaggagtacggtaggttcggacgggtccgtacggggccgggtctaccggaccgccgggtggggaacccgg

SEQ ID NO: 99196 - DNA, 620 bp, Homo sapiens
  misc_feature: GYAE6OF01AVLCX.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggctcggtgaagtctctgcagattctggaaaccaccctgagcaactactacatacactggatgcggcgacggcccctggacgtaggggtttgaggtggagtggggtggactaccaaccctacgaggaggtcggacgtaacaaaggtataccggaactaacggtaactttacgaggggtacgaggggttcaaccgacgtcgaccggtagggaccgcggtaccatcgacgtaccaactagtccttaacgacgttaggacttcgaggaccggtcgggactacggacccgtgtaccggtacgacggtaccgacacgtacgtacgttactaggtcggaaagtaggtacgggttggcggcccggttaaccggcggggtacctagggaacccgtggtcggggaacccggg

SEQ ID NO: 99197 - DNA, 617 bp, Homo sapiens
  misc_feature: GYAE6OF01EPB12.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaacggtctcctgcaagtatttctaggaaacacctgagcaactactacatacactggatggcggcgaggccccgtgggacgtaggggtttggaggtggtagtggggtggactaccgaaccctaccgaggacggtggacaacgaaagtatacgaacaagtaactttcgacgggcgagggtacaccgagtcgaccggtcgggacgcgtaccactacgacgcaacagtactacgagtggacttcgcggacgcgggtacgtcggacctacggtacgacgaacgtaccggactagtagtacgttacgtaggtacgggtaggtaccgtagggttcgggtacggtccggtacccgggtacggggtcctacggaccgtacgggtcggggaaccccggg

SEQ ID NO: 99198 - DNA, 639 bp, Homo sapiens
  misc_feature: GYAE6OF01BI9IB.40.81.H04.1.454.CMB.1.raw
  modified_base (243)..(243): a, c, t, g, unknown or other
  misc_feature (243)..(243): n is a, c, g, or t
tcagtctagcgactcacgaccggtgctcgatttagtagtgtagattcgcgggggtgccctgagagcatcacccagcaaccacatctgtcctctagagaactcccctgagagcctccgttcctcaccatggactggacctggaggatcctcttcttggtggcagcagccgcaggacgcccactcccaggtgcagctggtgcagtcgtgggctgaggtgaagacgcgtgggcctcggtgaggtcnctgacaagtattcgtagaacctacctgacgacaactactactatacagtggatcggcggacgacggcccgtagggaccgtaggggttagaggtgggtagtggggtcgactaccgaaccgtacgaggaggtacgacgaacaaggtacgtacgaactaagtaacgttcggaacgggtacgacgggtaccacgtagtacggacggtcgggaccgtcgtaccactacgacgtccgaacgtacgttacctaagtacgtacggacttcgacggtacggaccggtactcgaccgtcgacgtaccgaacgccgtactattacggttacttacgggcggtaaggaacggtcgggttaacggttcgggtacgggtaccgtaccgggggtaccggtcggtaaaccgg

SEQ ID NO: 99199 - DNA, 628 bp, Homo sapiens
  misc_feature: GYAE6OF01ESENX.40.81.H04.1.454.CMB.1.raw
  modified_base (311)..(311): a, c, t, g, unknown or other
  misc_feature (311)..(311): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatcctcctgcaggtctagtccagacgccctacctaaaacactaatggatactacttctttgaattcggtactgcagaacgccagggcagtctcacagctcttanattattagttggggtttcttagtccgggtccgttccgggtcctggacgtacggttcgagtcggctaggtggtactctaggtacaacgtagttaacttttaacacgtaagaaaacttcgaaggtacggtagggtagggagggacgtaagtaagtagttggttagggttatttaagtttacgtagtactagtacgtacctaacgtactaactaacgttgtggtaccgggtaccgggtaccgggaaccggaacggtaacgaagggtacggaaaacgtacgaaacggtaccggtaaggttcgggtacggtcgtacgtaccg

SEQ ID NO: 99200 - DNA, 651 bp, Homo sapiens
  misc_feature: GYAE6OF01CHF3X.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggtctccgtgcaagtatttcgtaggaaaccaccctgacgacaactactacatacacgtggatggcggcgacggtccccgtggacgtaggggtttgaggtggagtggggtgactaccgaaccctaccgaggacggtggacaacgaaagtactacgaacgaacgtaactttcggaacgggtccgaggggtaccaccgtagtcggaaccgtcggggacgtccggtacccagtccgaagaccaacgtacggttactaactagttacggtactcgtaggacgggtcccggaccgttacggaacccgtaggtccggaacgtaaccggtaccgtaccgaagttacgtattacggtaggacggtaagtaggtaccgggttggtacggcgtaaccgggcgggtaccgtacggccgacgggtaccgggg

SEQ ID NO: 99201 - DNA, 624 bp, Homo sapiens
  misc_feature: GYAE6OF01ADO0M.40.81.H04.1.454.CMB.1.raw
  modified_base (249)..(249): a, c, t, g, unknown or other
  misc_feature (249)..(249): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccaggtgcagcgtggtgcaggtcgtggggctggaggtagaagagccgtgggcctggagacggtctctgacaagtnttcgtacgaaccacctgacgactaactactacataccacgtggagtcggcggaccgacggccctgggacgtaggggttgaggtgggaggtgggtagacgtaccaacccgtacgaggaggtcgacaacgaagtacgacgactaagtaacgttcgaggcgacggtaccacgtagtccggacggtacgggacctacgacaacgtcgaacgacaacgtagtaccacgagtagtctagacggacgccgtacgtcgtaccgttgacgaaccgacgaccgtcgtagtacgtacgttaggtaggacggtaggttacggtacggggttcgcgggtacccggtacccgggtcgggaccctaccgggtaccgtgggtacccggggg

SEQ ID NO: 99202 - DNA, 668 bp, Homo sapiens
  misc_feature: GYAE6OF01B4MMU.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtcctccactcctccctgcccgtcactcctggagacgcccggcctccatcctcctgcgtaggtctagtcagacgcctacctaaacactaatggattactacttcttagtaattcggtacctgacagaacgccgagggcagtcctaccacacgtcttacttagaattacgtagttttggggttcttacggtccgggtcccgtccgggtcctgacgtggttacaggtgcgaggtgatcgagtccaagtagttactttacaacgtaagaaactcgaaggtacggtaggggtaggacggacgaaggtaagtaggtttagggttagggtttaacttttacgttacgtcgtacgtaagtacgaccttaacccgttattaaaccgtaagttcgggttacgggtacgggtaaccgggtaccgggaaccggtaaaccggggtaaaccgtaaaggggtaacggtaaacgtaccgtaaacggaccgtaacggttggtacggtcgtcggaaccgtaccg

SEQ ID NO: 99203 - DNA, 779 bp, Homo sapiens
  misc_feature: GYAE6OF01AT8FQ.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtgggatattgtgatgactcagtcctccactctccctgcccgtcactccgtggacgacgcccggcctccatctcctgcaggtctagtcagacgcctacctaaacactaagtggactacctacttcttagaatttcggtacctgacaagaacgccgtagggctacgtcctaccacgagtccttagtacgtattagttaggtttcggggtttacttaacggtccgggtcccgttccgggggtaccctaggtaacgtagggttcaacgggttcggacgtaaggtacgggtactccggtaacgttaccgaacgttagttaacctttttaacgaacgttaaacggaaaactttcgaaggtaaccgggtaaggggttacgggaacggtaaccgaaagggttaacggttaacggttagggttttagggttaaacgtttttaacgttacgtaccgtaacgtacgttaaccggtaaccctaaacccgttaaccttaaacgtaaacggttggtacgggttaacggggacccggttaccggggaaaccgtaaaccgggggtaaaccgtaaacgggttaaggaaaacgttaaccgaaacgggtacccggtaaagttacgggtaccggtacgttaacgacccgtaaccgttaacg

SEQ ID NO: 99204 - DNA, 562 bp, Homo sapiens
  misc_feature: GYAE6OF01BXVBQ.40.81.H04.1.454.CMB.1.raw
  modified_base (169)..(169): a, c, t, g, unknown or other
  misc_feature (169)..(169): n is a, c, g, or t
  modified_base (334)..(334): a, c, t, g, unknown or other
  misc_feature (334)..(334): n is a, c, g, or t
  modified_base (416)..(416): a, c, t, g, unknown or other
  misc_feature (416)..(416): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtnactcctggagagccggcctccatctcctgcaggtctagtcagacgcctacctaaaacactaaatggaatactactctttgaattggtacctgcagaacgccgagggcagtctccacagctcttgatatagttggggttcttagtcgggcctccgggtccctgacnggttcagtgcagtgatcagtcacagtatttacactagaaaatcagcgagggtgagcaagaagatggttaggtatttatatgnagtagacctaaccgtactaacgaacgtgtaggtaggacgggtcggaccgaagggaaccaagggtacgaaagtacgaagacgtaacgtggttacggcgtcgaccaactagttacctaggttaccttactaccgttccttacccccgg

SEQ ID NO: 99205 - DNA, 525 bp, Homo sapiens
  misc_feature: GYAE6OF01B06SM.40.81.H04.1.454.CMB.1.raw
  modified_base (407)..(407): a, c, t, g, unknown or other
  misc_feature (407)..(407): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatagtagttggggttcttagtccgggccgtccggggtccctgacaggttcagtggctagtgatcagtcacagtatttacactagaaatcagcgaggtggagcagaagntgttaggatttatatgcatcgactaacctactaacaaacgtgtagtcggacggtacgaccgaaacgggacgaaaggtagaaatcgaaaggccgtaacgtggtcggatcgacgtctacg

SEQ ID NO: 99206 - DNA, 546 bp, Homo sapiens
  misc_feature: GYAE6OF01EJS47.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctccgtgcaagtatttctaggaaacaccctgagcaactactacatacactggatgcggcacggcccctggacgtaggggtttgaggtggagtggggtgatcaacccgtaccaggaggtggcaacaaagtatcgacagaactttcagggcgagggtcaccgagtcgaccgtgggaccgcgtcactcgagacacagtctaacagtggatcgtggagcggtactggaccctagtcgacgtacgacggcatgattatgtggaagtagtcggtcggtgaccggtacggtccgggcacggaccgaggtcgggaacccggg

SEQ ID NO: 99207 - DNA, 676 bp, Homo sapiens
  misc_feature: GYAE6OF01C9F74.40.81.H04.1.454.CMB.1.raw
  modified_base (194)..(194): a, c, t, g, unknown or other
  misc_feature (194)..(194): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatcncctgcaggtctagtcagagccctacctaaacactaatggatactacttctttgaattggtacctgcagaacgccgagggcagtcctccacagctctgattagttagttgggttacttggtccgggccgttcccggggtccctagacgtacggttcgaggtcggctaggtgatcagtcactagttatttacactagtaaatcgagcggaggggtagagggacaaggtaagtagtttagggtttagggttaacttttattacgtggtactaagtcgaacccttaaccttaaccgtaacttaaacgtgggttacggtaccggggtaaccggggtcccggaaccggaaacgggggtaaccgtaaaggggtaacggtaaaactacggaaacggtaccggtaaacggttgggtaaggtcccgtaacggacccctaacttacgtttccggttactttacctttaccgtacgtttcccccgttaccccgg

SEQ ID NO: 99208 - DNA, 700 bp, Homo sapiens
  misc_feature: GYAE6OF01DJ6JE.40.81.H04.1.454.CMB.1.raw
  modified_base (688)..(688): a, c, t, g, unknown or other
  misc_feature (688)..(688): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccgagtggggatattgtgatgactcagtctccactcctcctgcccgtcacgtccgtggagacgccgacctccactctcctgctagtctagtcagacgacctacctaaaacacttaagtggtaacttacttacttacgtttagaagtttcgtacctgacgaacggtacgcgagggactacggtcctaccgaactcgtctacgttgtaattagttaggtttcgggtttacttacgggccgggttccggtacccgggtctaacggtcgtaggtttcgaaggtcggacgtaggttacgtactacgtacggtaactaacgttaacgtttaacctttaccgtaaactaacggtaaaacgttccggtaaagggttccggttaggggtacgggtaacgggacgtaaagggaacggttaggtttagggtttaggtttaactttaagttacgttagtaccttaagtaccgtaacctaactacttaaacgtagtacgggtagtcggggacgaccggtaacgggaacgtacggtaaggtaacgaagacaaggtaccaggtancgtcgtacgacg

SEQ ID NO: 99209 - DNA, 770 bp, Homo sapiens
  misc_feature: GYAE6OF01DBO4O.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactcctccctcgcccgtcactccgtggagacgccggcctccatcctcctgcaggtctagtcagacgacctacctaaacactaatggaatacttactctttgaattcggtacctagacaaggaacgccgaagggcacgtcctaccacgacgtcttacgtagtaattagttagtttggggtttacttacggtccggggtcccgttcccggggtccctaggacgtaggttcaggttggactaggtagatcgaagtacacgtaagttaacttttaacaacgttaagaaacttcgaggacggtaaggggtaggaaggacgaaggtaaagtagtttagggtttaagggtaattttaacgttacgtaggtactaagttaccggaacccttaaacccgttacgtaaaccgtaaaccggttagggttaccgggtaccggggtaacccggggttaccgggaaaccgggtaaacgggtaaccgggttaaagggtaaaccgggtaaaaacttaccgggaaaacgggtaaccgtaaaggttaccggggtacggtaaccggtccggaacccgttaactacggtttcccgttaacgtttacctttacccgttacgttcccccgttaaccccg

SEQ ID NO: 99210 - DNA, 897 bp, Homo sapiens
  misc_feature: GYAE6OF01DMXP8.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctctgggtctctggatccaggtgggattattgtgatgactcagtcctccactcctccctgacccgtcacctccgtgggagacgcccggtcctccattcctcctgacaggtctagtcagacgcctaacctaaacactaagtaggtattacctacttctttagaacgtttcgtactgacgaaggaacgccggagggactacgttacctaccgacgacgtccttacgttagtaattaggtttacggtttaggggttttaccttacggtccggggtaccccgtttccggggtacccttacggaacgtacgggtttccgaagggtccgtaacgtaggttacgggtaacttacggtaacgtacccgtaacgtacgtttaacttttaaaccgtaacgtaaacgtaaaacgtcgtaacgggtacggttaggggtaacggacgggtaacgtaagggttaaacggttacgggtttaagggttttaaggtttaacggttttttaaacgttaacccggtttaggtaaccctttaacggtttacccggaaaccccgtttaaacccgtttaaaccggttaaaccggttaaaccgggtttcgggtttaacgggtaccgggggttaaaccccggggttaaaccggggtaaacccgggtaaaaccgggggttaaacccgggttaaaagggggtttaaaccgggtaaaaaccgttaaccgggttaaaaacgggaccgggtttaaaacgggttacggggttaccgggtaacccgttaaccgggtaaaccccgg

SEQ ID NO: 99211 - DNA, 626 bp, Homo sapiens
  misc_feature: GYAE6OF01BJCDQ.40.81.H04.1.454.CMB.1.raw
  modified_base (616)..(616): a, c, t, g, unknown or other
  misc_feature (616)..(616): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcgggtgaaggtctccgtgacaagtatttcgtaggaaaccacccgtgacgaccaaactactaacatacacgtggatcggcggacgacggcccgtgggacgtaggggttgaggtggagtggggtcgactaccgaacccgtacgaggtaggtagacgaacgtaagtagtacgaagtacgtaacgttcggagggacgtaacgggtaccaaccgtagtaccggtaaccggtgggaccgtaccgtaccgactaccgacgcctaacgtacgtaccgtaacgtagtacggtacgtcggtaggacgggtccggtacgttacggacctacggtacgaccgacgtacgctacgtcgtacgtagtggaggacgtagtacggtggacgacgtcggnggtcgtacgg

SEQ ID NO: 99212 - DNA, 644 bp, Homo sapiens
  misc_feature: GYAE6OF01EQ2NP.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtggggcctcggtgaacggtctccgtgcaagtatttctaggaaaccacccgtagacgacaaactactacatacacgtaggatggcggcgacggccccgtggacggaggggtttgaggtggagtggggtgacgtaccaaccctacgaggaggtcggacaacgaaagtactacgactaagtaacgtttacgagggacgtacgggtacaacgtacgtcgaccggtagggaccgtcggtacccagtaccacgaccacgtacgtactacgtagtacgatcgtagggacggacggtacgtacggtaccgtacggtacggacacggtaccgacgtatcggttactacggtaggtacggtaggtacggtaggtttacgggtcgggacccggttacggggccggggttaccgacggtccggtaacgggtacccggggg

SEQ ID NO: 99213 - DNA, 653 bp, Homo sapiens
  misc_feature: GYAE6OF01C2WC4.40.81.H04.1.454.CMB.1.raw
  modified_base (190)..(190): a, c, t, g, unknown or other
  misc_feature (190)..(190): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (312)..(312): a, c, t, g, unknown or other
  misc_feature (312)..(312): n is a, c, g, or t
  modified_base (629)..(629): a, c, t, g, unknown or other
  misc_feature (629)..(629): n is a, c, g, or t
  modified_base (635)..(635): a, c, t, g, unknown or other
  misc_feature (635)..(635): n is a, c, g, or t
tcagtctagcgactcacgaccggtgctcgatttagtagtgtagattcgcggggatcaggactcctcagttcaccttctcacaatgaggctccctgctcagctccgtggggctgctaatgctcgtgggtctcgtggactccgaggtggggattattgtgatgactcagtctccactcctccctgcccgtanacctccgtggagcgccggcctccatcctcctgctaggtctagtcagacncctaccaaaanactaagtggaatactatctttagaattggtacctgacagacgccgaggtcagtcctccaacngtcctagttagaattagttaggtttcggggttacttaacgggtcccggggtcccgttccccgggggtcctagtaaacgtcggtttacagggttacggcgaaggttaggaactcgaaacggttcaaacgtaggtttaactttacgaacgttaaagaaactcgaaaggacggtaagggaggaacggaacgaagtaaagtgtaggttacggttaatttaatcgagacatacgaccctaactactaaacaacgtgtagggacgacggtccggaacgtaaacgggaccgtaaaggtagaaagttacaaacggcgttaaacgngggtanaccgtgacccaaccgttg

SEQ ID NO: 99214 - DNA, 512 bp, Homo sapiens
  misc_feature: GYAE6OF01A1HA4.40.81.H04.1.454.CMB.1.raw
  modified_base (375)..(375): a, c, t, g, unknown or other
  misc_feature (375)..(375): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (504)..(505): a, c, t, g, unknown or other
  misc_feature (504)..(505): n is a, c, g, or t
  modified_base (509)..(509): a, c, t, g, unknown or other
  misc_feature (509)..(509): n is a, c, g, or t
tcagtctagcgactcacgaccggtgctcgattttagtagtgtagattcgcgggggagagcatcacccagcaaccacatctgtcctctagagaatcccctgagagctccgttcctcaccatggactggacctggaggatcctcttcttggtggcagcagccgcaggagccccactcccaggtgcagctggtgcagtcgtggggctgaggtgaagaagccgtggggcctcggtgaacggtctccgtgccaaagtactttcgtaggaaaccaccctgacgacaaactactacatacactgatgcggcacggcccctggacgtaggggtttgagtggagtggggtgataccaacccgtacgagacggtggcacaaagtntacgacagtaactttgaggctagggtacacatgacgtgggacgcgtcagtcaagcacagtcacangatcgagngcgcgtgaccgtgacgacagtacgcagtnagtgagngtangngtgngcgtacgcgnngcgngcg

SEQ ID NO: 99215 - DNA, 846 bp, Homo sapiens
  misc_feature: GYAE6OF01DIIKB.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtgggatattgtgatgactcagtctccactcctccctgcccgtcacctccgtggagacgccggcctccattcctcctgcaggttctagtcagacaccctactaaacacttaagtaggaacttactacttgtttagtaagtttcggtacctgacgaacgtaaacggcccgaaggggtcctacggttccctacccgaacgtacggtcctttacgtttacgaagtttaacgtttacggtttttcgggggttttacttttaaccgggttcccgggggttccccggtttccccggggggttaccccgttacggggaacccgtttaacgggtttttcgaacggggttcggtaccgtaagggtacggttacgttacccgtaacggttaccaaccgttaagtttaaccttttaaacccgaaacgttaacggtaaaaacgtcggtacggttacgggttagggggtagggtaacggacgtaaagggtaaggtagtttagggtttaaggtttaacttttaagttacgtacgtacgtaacgttaccgtaccgtaaacccgttaccgttaacgtaaacgtttcgggttaacgggttaccggggtaacccgggttaccgggaaaccgggtaaacggggaaacccgttaaaggggtaaacggtaaacgtaacggaaaccggtaacggtaaacggttcgggaccgttggtccggtaaacccg

SEQ ID NO: 99216 - DNA, 735 bp, Homo sapiens
  misc_feature: GYAE6OF01BTV3J.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactccgtggagacgccgcctcatcctcctgcaggtctagtcagacgcctactaaacactaatggtaactactacttctttagtaatttcggtacctgacaggaacgccgagggcaagtcctaccacgtacgtccttacttaggtaatttagtttacggtttgggtttaccgttacggtcccggggtcccgttcccggggtccctaggtaccgtcggtttcgaaggtcggccgtaaggtacggtacttacgacgttcaaacgtagttaactttaacaacgttaacgtaaaactcggaacggtacggtaaggggttacggaacgggtaacgtaaggtaacgttaaggttagggtttaacgggtttaattttaacgttaagttcgaacttacgttacgtaacccttaaaccgttaccgttaaacgttaaccggttcggttaagggtaccggggtaccggggttaaccggaaccgggtaaacgggtaaccgtaaggggtaaacgtaaacgtaaccgaaggtaccgttaacggtggtacgtacgtcggtaacccg

SEQ ID NO: 99217 - DNA, 756 bp, Homo sapiens
  misc_feature: GYAE6OF01CFG9R.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtgggggatattgtgatgactcagtctccactcctccctcgcccgtcactccgtggagacgcccggcctccatcctcctgacgtaggtctagtcagacgcctacctaaacaactaatggatacctacttctttagaacgtttcggtacctgacaagacgaccgagggcacgtcctaccacgtagtctacgttgtaagttagttaggtttcggggtttcctttacgggtcccgggtccccggttccccggggttacccgttacggtaacgttacgggtttaccgtagggtcggtaccgtaggttacgggtactacgtacgtacaaccgttaaggtttaacttttaacctaaacgttaaacgtaaaattccggtaaggtaccggggtaagggggtacgggaagggtaacggaaggtaaggtaggtttaggttaacgggtttaaatttacgttacgtgtacctagtaccgtaacccttaaccgattaaccgtaagtggtacgggtaccgggtaccggggtaccgaaccgggtaaacgggtaacgaagggttaacgaacgttacgaacggtaggtacgtcgggagtctaacggctacgtactcgtacgttaccttacgtccgttaccccgtaccg

SEQ ID NO: 99218 - DNA, 579 bp, Homo sapiens
  misc_feature: GYAE6OF01EQZE9.40.81.H04.1.454.CMB.1.raw
  modified_base (383)..(383): a, c, t, g, unknown or other
  misc_feature (383)..(383): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctccctgcaggtctagtcagagcctacctaaacactaatggatactactcttgaattggtacctgcagaagccagggcagtctccacagctctgatagtattgggttcttagtccggccgtccggggtcctggactggttcagtggcagtgactcgagtcactagtactttacacttanaaatcagcgtagggtggagggacaaggtaagagttggttagggtattttaattacgtgactaagtacgacctaccgttactaacgttaaactgggttcggtacgggtaccgggtccggacccgtaacgggaaccgtaaagggtacggaaactcgaaaggaccggtaacgtggtacggacttacggctaccgtaacg

SEQ ID NO: 99219 - DNA, 596 bp, Homo sapiens
  misc_feature: GYAE6OF01AUPN6.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgcaggtctagtcagacgcctacctaaacactaatggatactacttctttgaattggtacctgacagaagccgagggcagtcctccacagcttcttgattagttagtttggggtttcttagtccgggtcccgttccgggggtccctggacgtacgggttcaggtcggctaggtggatcgacgtacacgtagtactttacactagaaactcgagcgagggtggagacgagtaagtagttggttaggtatttagttacgtgctatacggtacctaaccttactaacgtaacgttggtggtacgggtaccgggtaccggacggaaacgggaccgaagggtaaggtaaagtacgaacgtacggtaacgtggtacggactcgtcgacgtacg

SEQ ID NO: 99220 - DNA, 594 bp, Homo sapiens
  misc_feature: GYAE6OF01AZTWG.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtgggggcctcgggtagaacgggtctcctgctaagtatttcgtggaaaccaccctgagcaactactacactacacctggatgcggcacggcccctggaccgtaggggtttagaggtggagtgggggtcgagtccaacccgttaccgaggaggtcggacaacgaaacgtacgtcgaactaggtaaccttttcgacggggcaagggtcaaccgactcggacctacggggacgccgttccgatccagccacagtctacagtcggatctggacgcggactcggacctcgacgaccggacacgccgtatcgttattacgtggtggtaagagtacggttggtcgtaccgtccggaccgggtacctcgcccgtggtacccggggg

SEQ ID NO: 99221 - DNA, 606 bp, Homo sapiens
  misc_feature: GYAE6OF01CJACG.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctgggcctggtgaggtctcctgcaagtattctggaaacaccctgagcaactactacatacactggatgcggcgacggcccctggacgtaggggtttcggaggtgggaagtgggggtacggacgtaccgaaaccccgtaaccgaaggacggtaggacctaacgaaacgtacgtacgaacgaagtaacgtttcgaacgggtcgacgggtaccaccgagtcggaccgtgggaccgccgtccgatccgaacgcacgacgtactacgagtggatcgtaggagcggtcgtacgtactcgtcgaccgacgaccggactagtagttacgttacgtggtacggaaggtacggtacgttgggtcggcgtacgggcgggtcgacggaccgcggtcggggaacccgg

SEQ ID NO: 99222 - DNA, 788 bp, Homo sapiens
  misc_feature: GYAE6OF01B8JJA.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccgaggtgcagctggtggcaggtcgtggggctggaggtgaagaagccgtggggcctcgggtagaacggtctaccgtgacgaagtactttcgtacggaaaccaccctgaacgacctaaactactaacataacactaggagtcggacggccgacggcccgtggacgtaggggttgaggtgggtagtggggtaggtactaccgaaacccgtacgaaggacggtaggaacctaaacgtaaaaggtactaaccgacgtaaacgtaacgtttacgaacgggtacgtaacggtaccgaactacggtacggaacccggtacgggaaccggtaccgtaccgtaacgtaccgaacgaacgaaccgtacgttaaccctaacgtaggttacggtaacgttacccggttaaggacgggtaccgggtaaccgttaaccgggtaacccgtaacggtacccgggaaacgtaaccggaacccggggtaacctaagttaaccgttaacgtttaccggtaagggttaacggggaaaccggtaagggtttaccgggtttcggacgggtacccggtaaccggggtcccggggtaacgttacccgggaacccgtacggggtaccggggtaaaccccggg

SEQ ID NO: 99223 - DNA, 755 bp, Homo sapiens
  misc_feature: GYAE6OF01BCCVD.40.81.H04.1.454.CMB.1.raw
  modified_base (188)..(188): a, c, t, g, unknown or other
  misc_feature (188)..(188): n is a, c, g, or t
  modified_base (269)..(269): a, c, t, g, unknown or other
  misc_feature (269)..(269): n is a, c, g, or t
tcagtctagcgactcacgaccggtgctcgatttagtagtgtagattcgcgggggagcatcacccagcaacctacatctgtcctctagagaatcccctgagagctccgtcctcaccatggactggacctggaggatcctcttcttggtggccagcagccgcaggagccccatcccaggtgcagctggtncagtctggggctgaggtgaagagccgtaggggcctcggtgaacggtctccgtgcagacttttcgaggaaacaccctggacncgaacctactactactacacgtggaatgacggcgaacggtcccgtgggacgtacggggtttagacgggtggtacgttaggggttaggacctaccgtaaccccgtacgacggtacgggtcggtaccgaacgtaaaacggtccgtacggtaacacggtaaacgttttcggaacgggtaccacgggggttccaaccgtagtcggacccgttcggggaaccgccggttaccgtagtaccgtacgtaccgtaaccgacggttaccgtaagtacggttcggtaagttcccggtagacgggtaccggttaacgtccggtacccgtacggtaccggtaacggtaacccgttaacgggtccgtaacgttacggttaacgttaccgtaacggttacggaaccggtacggttaaacccgggttcgggtttaccggaacggttcccgggacggttacccggtacggtaacccgtcccgggtttcggggaaaccccggg

SEQ ID NO: 99224 - DNA, 629 bp, Homo sapiens
  misc_feature: GYAE6OF01AY3QG.40.81.H04.1.454.CMB.1.raw
  modified_base (238)..(238): a, c, t, g, unknown or other
  misc_feature (238)..(238): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccgaggtgcagctggtgcagtcgtggggctgaggtgaagagcgtggggcctcggtgaggtctccngcaagtattcgtaggaacaccgtgacgactaactactacatacactggtatggcggcgacggccccgtgggacgtagggggtttgaggtggtaggtggggtagactacaacccgtacgagagggtagacaacgaagtatacgacgtaagtactttacggacggacgtacgggtacaacgtagtcgaccgtaggggaccgaccgtaccacgtacgacgacacgacgtctacagtagtactcgtaggacggtaccgacgtacgaccgttacgtacggacggaccgaccggcctagttcgttacgttacgttagggtaaggaacggaggttaccgggttgggtcgtcccggtaccggggcgggtacgtaccggtacccggtgggtacccggggg

SEQ ID NO: 99225 - DNA, 669 bp, Homo sapiens
  misc_feature: GYAE6OF01BFMUB.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtgggctgaggtgaagaagccgtgggcctcggtgaagtctccgtgctaagtattctaggaaaccacctgagacaactactacatacagtggatcggcggacaccggcccctggacgtaggggttcgaggtggaggtggggtagacgtaccgtaacccgtacgaggagggtacgacgaacgaaagtacgtacgaccgtaacgtaacgtttaccggagggtacgacggtaccaaccgtacgtacggtaacccggtgggacgtacccggtacgtaacgtccgaacggtaccgtaaccgtacgttacccgtaactaacggttacggtaccgtacggtggaacccgggtaccgggttaccgtacggttaacccggtcgtaaccgggaaccgtaaccgggtaacccggtacgtaagtttacggtttaaccgtgggttaacgggg

SEQ ID NO: 99226 - DNA, 963 bp, Homo sapiens
  misc_feature: GYAE6OF01AJSKW.40.81.H04.1.454.CMB.1.raw
  modified_base (932)..(932): a, c, t, g, unknown or other
  misc_feature (932)..(932): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttgggtcggccgacgcgacccggccgacggacgggacccgacccctacccctaccggtacgggtccaccgtcgtccggttcggacgtacggtaccggtttcggggcgggttacggtaggggtaggggtaagaacggtacccggtcgggtccgggttccggtaggtacggtacggtcctacgagtaacgtaacgttcgttacggtaaccgaacccgttacgaggaacctaactaacgtaactagtaactacgtacggtagtcgtacgggaccgacgtacccggtacccggttaggggtaaccggggttttagggggtaacgggttacggggtaagggttacggggggttacgggggtaacctacccggttaaaaccccggtaaaccccccggttaaaggggtaccggggtttaacggggaaccggtaaacccggttaaaaaccggtaaaggttaccccgtaaaccgaaaccgggtttaaacggttttaaaccccgggttaagggggaacccgggtaacgggtaacccgggttaaacccgtaaacggtacccggggtaaccggttacccggggttaacgggaacccggtccccgttaaacggacccgtaagggtaaaccccgtaccgggttaaacgttcccgttaaacgtaaccgtacggttaaacggttaccgtccgggttaaaccggacggggtttaccggacccgttaccgggtaccgtaaccgggtaccgaaccgggtaacgtacccgngttaaacggttcttaacgggtccgtaagggg

SEQ ID NO: 99227 - DNA, 688 bp, Homo sapiens
  misc_feature: GYAE6OF01APRO3.40.81.H04.1.454.CMB.1.raw
  modified_base (279)..(279): a, c, t, g, unknown or other
  misc_feature (279)..(279): n is a, c, g, or t
  modified_base (333)..(333): a, c, t, g, unknown or other
  misc_feature (333)..(333): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggactccaggtggggatattgtgatgactcagtctccactctccctgcccgtcacctccgtggacgacggcccggtcctccactcctccgtgcgtacggtctagtcagacgtcctacctaaaacactaagtgtaacttacttacttntttagtaacgttcggtacctgacgaaggaacgccgagggctacgtcctaccacncgtcttcttagtacttaagttcggtttcgggttactttacggtccgggtccccggttcccgggttcctaggtaacgtcggttacgacggtcggactagggtacgtactcgacgtacctaacgttagttaactttaccaagtaataaaacgtgaacggtaggtaggggtacggaacggacgtaaggtaacgttagtttagggttaagtttaactttaacgttacgtagtacgtacgtacgtaacctaacgttacgtaaccgttaagttcggtacggtacgggtaccggtacggaaccgggtaacggtaacggtaaggtacgtaactacgaagtacgtacgtgacggctcgcgtacg

SEQ ID NO: 99228 - DNA, 732 bp, Homo sapiens
  misc_feature: GYAE6OF01CS1RS.40.81.H04.1.454.CMB.1.raw
tcagtctagcgactcacgaccggtgctcgatttagtagtgtagattcgcggggactgatcaggactcctcagttcaccttctcacaatgaggcctccctgctcagctcctggggctgctaatgctctgggtctctggatccgaggtggggattagttgtgatgactcagtctccactcctccctcgcccgtcactccgtaggagacgccggcctcatctcctgcagtctagtcagacgcctaccaaacactaagtgaactactacttcgtttagaacgttcggacctgacgaagaacgccgaggctacgtccaccacgtacgtctcgtagtaattagttaggttcgggtttactacggtccggtccgttccgggtacctaggacgtagtcgaggtcgacgtaggtagactacgtaacgtacctaagtaacgtttaactttaacgaacgtaaagtaaaaccgcggtaacggtacggggaaggggttaacgggacggtaaggtaaaacgggtaagttagggtttacgggtttaagggtttaaatttttaacgggtacgttacgacgttacgtacccgtaaacccttaaccgttaacgtaaaccttagggtttacgggtacgggttaaccggggaaccgggtacccggaaaccgggtaaaacggggtaaccgtaaagggtaacgtaaaacgtaacgaacggtaacgtaacgtgggtacggtcctcgggtaaaccc

SEQ ID NO: 99229 - DNA, 909 bp, Homo sapiens
  misc_feature: GYAE6OF01EVIYJ.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctcgtgggtctcgtggactccaggtggggattagttgtgatgactcagtcctcccactcctcccgtcgtccccgtctaccgtccgtagggacggaccgccccggtccctacctacttccccttccgtcggaccgtacggttccgtaacggtccgaacggtaaccgtaccccttaaacctaaaactacttaaggtacggtaacttaaccttactttcgtttaagtaacgttttcggtaaccctaggaccgaaaggtaaccggcccggaaggggtacccttaaccggtcctacccgaacggtaccgttcctttagttagtaacgtttacggtttacgggtttcgggtttacgtttaccggccccggggttaccccggttccccgggggtacctagggtaccggttaggttaccggtacgggtcggtacgtacgggtacggtaactaggtaccgttaacgtaacgttaacgtttaacctttaacgaaccgttaaagtaaacctcggtaaagggtccgggttagggggaacggtacggaacggtaaaggtaaggttagtttacggggttaagtttaacttttacgtaacgtacgtacgttaacgtaccgtaacccttaactttaacccgtaaacggttaggtccgggttacggggtaaccgggttacccgggaaccgttaaaacccggggaaacgggttaaacgggtaacggggttaaaaccgaaaccgggtaaccgtaaaaccgggtacggttacggttaaggtcccgtaaccggacccttaaacccgg

SEQ ID NO: 99230 - DNA, 704 bp, Homo sapiens
  misc_feature: GYAE6OF01EAPXH.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagtctccgttcctcaccatggactggacctggaggactcctcttcgttggtgcagcagccgcaggacgcccactccaggtgcctagctggtgactaggtcggtgggctaggaggtagaagacggccggtcgggtccgtcggtagacgtcctaccgtagacgtaagttctttacgacggaacctaccgtagaccactaacgtacgtactacgtacgacgtaggtactcggccgaccggtaccggtacccgtagggtacggttacggggttagacggtacgggtaggttacgggtaacgtacctaacccgtaacccgtaacggacggtacgggtacgaaccgtaagtaaacgtacgtacgtaacgtaacgttaaccgtacggacggtaccggtacggtacctaccgtacgtaccgtaccggtacggtaccgtaccgtaccgtaacgtacgtaccgacgtacgtaccgtactacgtaggtaccgtacgtaccgtacggacggtacgtaccgtacgtaccggtacgaccggaacgtacgtaccggtacgtagttacgttcgtacggtagg

SEQ ID NO: 99231 - DNA, 679 bp, Homo sapiens
  misc_feature: GYAE6OF01ATNA9.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctggaggtgaagaagccgtggggcctcgggtgaaggtctcctgcaagatttcacggaaacaccctgacgacaactactacatacacgtggatggcggcacggcccgtaggacggtaggggtttgaggtgggaggtgggggtagactccgaaacccgtacgaaggtacgggtaggaccaacgtaaacggtacgtaccgaacgtaaacggttaaccgtttacggaacggggtcgaacggggtaccaaccgtacgtaccggacccggtaggggacccgtaccggtacccaacgtaccgaccggaccgtaaccgtacggttaccgtaacgtacgtacggtacgttccgtaggtaacgggccgggtaaccgttacggaacccgttcggaccggaacccggaccgtaaccgggaccttaagtcggttaaccgttacgttaacggggg

SEQ ID NO: 99232 - DNA, 704 bp, Homo sapiens
  misc_feature: GYAE6OF01EC6QH.40.81.H04.1.454.CMB.1.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (412)..(412): a, c, t, g, unknown or other
  misc_feature (412)..(412): n is a, c, g, or t
  modified_base (532)..(532): a, c, t, g, unknown or other
  misc_feature (532)..(532): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccaggtgggatattgtgatgactcagtctccactcctcctcgccctcactccgnggacgcgccgcctcatcctcngcgngttctagtcagcgtacctaacctaaacactaagtgtactacttacttgtttagaactttcggtacctgacaagtacgccgagggctacgtccacacagtcttctagacgttattaggtttcgggtttactacggtcccgggtcccgttccggggtcctaggtaacgtcgggtttacagggtcgtacgtaggtgaccgtnaacgttccaaattacgtttactttaacgaacttaaaggtaaactcgtaagtcgggtaacgggtaggaacggagtaacggtagtttaaggtgggtttaggtttaactttagtttaacggtnaacgtacgtaccgtaacctaaaccgttaactaacgttaaacgttggttacgggttacggaccggggttacccggaaaaccgggtaaacgggaaaccggttaaaggggtaaacgtaaacggttaaccgaacggtacgaaacgtttcgggaacgtagttaccaccgtacgtacg

SEQ ID NO: 99233 - DNA, 634 bp, Homo sapiens
  misc_feature: GYAE6OF01CW6LD.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccaggtggggatattgtgatgactcagtctccactctccctgcccgtcactcctggagacgcccggcctccatctcctgcgaggtctagtcagacgtcctacctaaacacttaagtggacttactacttctttagaatttcggtacctgacaagacgccgagggcacgtcctccactacgcttcgttagattattacggtttggggttccttacggtcccgggtacccggttcccggggttccctaggtaaccgtagggttccgaggtcggacgtaggttcggacttcgaacggtccacgtagttactttacacgtagaaatcgagcggtagggtggaaggtacaaggagtagttggttaggttatttagtctagtctaagtcgacctaaccgttactaaccgtagttggtcggtacgggtaccggtacggaccgaagggtaaccgtaagggtaagtaaacgtcgaaggtaccgtacgtgggtcgcgtacgccgtactcg

SEQ ID NO: 99234 - DNA, 570 bp, Homo sapiens
  misc_feature: GYAE6OF01AW3DC.40.81.H04.1.454.CMB.1.raw
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
  modified_base (557)..(557): a, c, t, g, unknown or other
  misc_feature (557)..(557): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctgaggtgaagagccgtgggcctcggtgaggtctcctgcaagtattctaggaaaccacctgagcaactacacatacactggatgcggcacggcccctggacgtaggggtttgaggtggaggtggggtgactaccgaacccgtacgaggtaggtggacaacgaaagtatacggaacaagtaacgtttacgacgggacgacgggtccaaccgagtacggaccgtggggaaccgtcgtacccagtcacgacactagtacctaacgagtggaacttcgacggaggccggacgtacggaccgtacggtcgaaccgacgacgcngtntagtagcgtggaacgngtcgtgnggacgcgacggnacgcgtaggcggg

SEQ ID NO: 99235 - DNA, 514 bp, Homo sapiens
  misc_feature: GYAE6OF01EPHRG.40.81.H04.1.454.CMB.1.raw
  modified_base (216)..(216): a, c, t, g, unknown or other
  misc_feature (216)..(216): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (458)..(460): a, c, t, g, unknown or other
  misc_feature (458)..(460): n is a, c, g, or t
  modified_base (462)..(462): a, c, t, g, unknown or other
  misc_feature (462)..(462): n is a, c, g, or t
  modified_base (465)..(470): a, c, t, g, unknown or other
  misc_feature (465)..(470): n is a, c, g, or t
  modified_base (472)..(472): a, c, t, g, unknown or other
  misc_feature (472)..(472): n is a, c, g, or t
  modified_base (476)..(477): a, c, t, g, unknown or other
  misc_feature (476)..(477): n is a, c, g, or t
  modified_base (479)..(483): a, c, t, g, unknown or other
  misc_feature (479)..(483): n is a, c, g, or t
  modified_base (485)..(487): a, c, t, g, unknown or other
  misc_feature (485)..(487): n is a, c, g, or t
  modified_base (490)..(494): a, c, t, g, unknown or other
  misc_feature (490)..(494): n is a, c, g, or t
  modified_base (497)..(500): a, c, t, g, unknown or other
  misc_feature (497)..(500): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (507)..(509): a, c, t, g, unknown or other
  misc_feature (507)..(509): n is a, c, g, or t
  modified_base (511)..(513): a, c, t, g, unknown or other
  misc_feature (511)..(513): n is a, c, g, or t
tcagtctagcgactcacgaccggtgctcgattttagtagtgtagattcgcgggggatactactctttgaattggtacctgcagaagccagggcagtctccacagctcttgatatattggggtccttatcgggcctccggggtccctgacaggttcagtggcagtggatcagtcacagtatttttacactgaaaatcagcagggtggaggcagaagntgttgggatttattactgacagtcgacaacctactacagactgtggtggacggtcggaccgaagggacctaagggtagaaactacgaagacgtaactggtggccttaggaccaccatcgtggttaccttccgtaacttccgttccccggactatccgtacgtaacggttccgacttacggacgtggaacgggcgggtcgtagggtaccaagggtccgactaggtagctanagtnacgctgcnnngngannnnnntngcannannnnngnnngcnnnnngcnnnngngcncnnncnnnc

SEQ ID NO: 99236 - DNA, 552 bp, Homo sapiens
  misc_feature: GYAE6OF01BIAPK.40.81.H04.1.454.CMB.1.raw
  modified_base (194)..(194): a, c, t, g, unknown or other
  misc_feature (194)..(194): n is a, c, g, or t
  modified_base (343)..(343): a, c, t, g, unknown or other
  misc_feature (343)..(343): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcattctccactctccctgcccgtcactcctgganagccggcctccatctcctgcaggtctagtcagagcctcctaaaacactaatggatactactctttgaattggtacctgcagaagccagggcagtctcacagctcttgatatagttgggttcttagtcggccgtccggggtccctgacgnggttcaggtgcagtggatcagtcactagtatttacactagaaaatcagcgagggtagaggcagaagattgttagggtatttagttactgatagtagtactaaccttactaactaaacgtgtaggtacgggtacggtaccggaccggtaaagggacccgtaaagggtacggaaactacgaaacgtacggtaactaggtggcgtggtaccc

SEQ ID NO: 99237 - DNA, 650 bp, Homo sapiens
  misc_feature: GYAE6OF01EIUOG.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactcctccctgcccgtcactcctggagacgcccggcctccatcctcctgcaggtctagtcagacgcctacctaaacactaatggatactacttcttagaattcggtacctgacagaacgccgagggcagtcctccacagtctcttagtatattagtttgggttctaggtccgggtccgttcccgggtcctgacgtaggttcaggtggctaggtggactcgagtcaacgtagttactttacacgtaagaatcgagtcgagggtggaggacgaagaagtagttaggttaggttaattttacgttacgtgacgtagtacggacctaaacccgttacctaacgtaaacgttggttacgggtacgggtaccgggttaccgggaaccggtaaacggggtaacccggtaaaggggttaacggtaaacgttaaccggtaaagggtaccggttaaaccggttgggttaccgggcgtaccgtccgtaaacccg

SEQ ID NO: 99238 - DNA, 625 bp, Homo sapiens
  misc_feature: GYAE6OF01BHQ55.40.81.H04.1.454.CMB.1.raw
  modified_base (246)..(246): a, c, t, g, unknown or other
  misc_feature (246)..(246): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcttggtggcagcagccgcaggacgcccactcccgaggtgcagctggtgcagtctggggctgaggtgaagagccgtggggcctggtgaaggtctcctgcaaagtntttctaggaaacaccctgacgacaactaactacaatacacgtgagtgcgcgacggccctggacgtgggttagagtggaggtgggtagactacaaccgtaccgaggaggtgactaagaaagtactacgataagtaacttgacgggtacacgggtactacgagtcggtaaccgtcgggaaccgcgtaccgatacgacgacacgtacgactaacgagtacggacttcgtaggacgggtacgggtacctggtaccctcgtaacggaccgacgtaccggactacgtaggtacttacggtcggtaaggaggtaaggtcggttaggggaccgacccgggtaccggtccggggactagggacccctaacgggtcggggacccccggg

SEQ ID NO: 99239 - DNA, 718 bp, Homo sapiens
  misc_feature: GYAE6OF01CYX9M.40.81.H04.1.454.CMB.1.raw
  modified_base (430)..(430): a, c, t, g, unknown or other
  misc_feature (430)..(430): n is a, c, g, or t
tcagtctagcgactcacgaccggtgctcgatttagtagtgtagattcgcggggactgatcaggactcctcagttcaccttctcaacaatgaggctccctgctcagctcctggggctgctaatgctctgggtctctggatccgaggtgggatattgtgatgactcagtctcccactcctcccgtcgcccgtcacctccgtgggacgacgcccggcctcctacttcctccgtgcgtaacggtctacgtcacggcgtacctacctaaaactactaagtgtactacttacttacgtttagtaacgttcggtacctgacaagaacgccgaggctacgtcctaccacgtacgtcttacgttagtacttagtttaggttcgggtttactaccggtccgggttcccggtcccggggttcctcggtacgtggttaccgngggtcggacggtaggtacggtactacgtacgtactaacgtagtttaaactttaactacgtaaagtaaacgtcgtaacggtcgggtaggggtaggaacggtagaaggtaagtagtttagggttaaggtttaactttagtacgtcgtacgtagtaccgtaaccctaaccgttaactaacgtagggttcgttcgggtaacggccgggttaccgaaacgggtaaaggtacggtaaagggtaagtaaaccgaggtaaccgaacgtaacggttggcccggttaagcgtaacccg

SEQ ID NO: 99240 - DNA, 909 bp, Homo sapiens
  misc_feature: GYAE6OF01CSGM1.40.81.H04.1.454.CMB.1.raw
  modified_base (333)..(333): a, c, t, g, unknown or other
  misc_feature (333)..(333): n is a, c, g, or t
tcagtctagcgactcacgaccggtgctcgatttagtagtgtagattcgcgggggagagcatcacccagcaaccacatctgtcctctagagaactccccctgagacgcctccgttcctccaccagtcggactggaccgtgggaggactcccttcttcgttgggtggcagcgacgccggcgaacgggacgccccaacctccccgaggtcgaccagtcgtgggtcgcgtaggtcggtgggggctagggaggaggaaacggagtccggtaggggtccgttacgggaggtaacgggttctaccgtaggagtaaagttcgtttaccgaaggaaaacccnccgtagtaacgaactaaacctaactaacctaataaccgtacggtggaacgtcgggaccggaccgtaacccgggcccgtttagggaaccgggtttagggggtttagacggggtagtagggggtgggtaacggtaactacccgaaccgtacggaaggtcggacgtaacaaacgtaaagtacgtaacggaatacgttaacgtacggacggtaacgtaacggtacccaggtacgtaccggtacgggtaaccggggacctaaccccggtgtaacccgaacggtacgaacccgtaacggtacgggttacccttaaaaggaagtcccggggtaattcgggaacgggtaacccgggtaccgggtttaaaccgcccggttaaacccggtttacggaaccggaaacccgggacccggtaccggtttaaacgtaacgttaccgggttaaaagtttaacgggaacggggtaaacggaaacggggttttaacggtccgggggtttaaccgggaccccggggttacgttcccccgggggaaacggttaccccgtaacgggtacccccggaaagggggggttaacccccgg

SEQ ID NO: 99241 - DNA, 916 bp, Homo sapiens
  misc_feature: GYAE6OF01C2SJE.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccaggtggggatattgtgatgactcagtctccactctccctgcccgtcactcctggagacgcccgcctccatctcctgcaggtctagtcagacgccctactaaacactaatggacttacttacttctttagaatttcggtacctgacaagaacgccgaagggcctaggttcctaccaacgacgtccttcgtttagaatttaacgtttaggtttcgggggttttacctttaacgggttccccgggggtccccgtttaccccggggggttcccccgttaggtaaaccccggtttaaggggttttcccggtaaagggtttcggggtacccgtaagggggtttaccggggtaaactttacccggaacggtttaaaccctaaccggttaaacgggtttttaaacctttttaaaacccgtaacgttaaacgtaaaaaacgtttaccgaaacgggtaccggggtaaagggggtttagggggaaacgggtacggtaaagggtaaaagggttaggttttacggggtttttaaagggggtttaactttttttaacgggtttaaccttacgggtaaccgtttaacggttaaccggttaaaccctaaaccccgtttaaccgttaaaacccgttaaaacggttttcgggttacggtaaccgggggtaacccggggttcccgggaaaacccgggtaaaccggggaaacggttaaaccgggtaaagggttaaaacctaacggtaaacggaaccgttaacgggttcggtacggtaccgtacggaccctaaccgttacg

SEQ ID NO: 99242 - DNA, 630 bp, Homo sapiens
  misc_feature: GYAE6OF01DX58W.40.81.H04.1.454.CMB.1.raw
  modified_base (250)..(250): a, c, t, g, unknown or other
  misc_feature (250)..(250): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctggaggtgaagaagccgtgggcctggtagaaggtctccgtgacaagtntttcgaggaaaccaccgtgacgacaactactacatacacgtggatggcggcgacggccccgtaggacggtaggggtttgaggtggtaggtggggtacgactacccgaaccgtacgaggtacgggtagacaaacgtaaagtacgtacgaactaacggtaacctttacggaacggtcgtaacgggtaccaaccgtagtacggaccgttcgggaaccgtccgtacacgtacgagaccacgtagtacctagacgtagatacgtagacggccggtacgtcggaccgtagtaccgacgtacggtacgactgtagtactagtacggtaggagtaggtcgttgggtacgtacgtaccgggcggtacgtacggtaccgcggtaccgggg

SEQ ID NO: 99243 - DNA, 638 bp, Homo sapiens
  misc_feature: GYAE6OF01C1J9G.40.81.H04.1.454.CMB.1.raw
  modified_base (308)..(308): a, c, t, g, unknown or other
  misc_feature (308)..(308): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggtctccgtgcaagtattttctggaaacacctgagacaactaactacataacacgtggatgcggcgacggccccgnggacgtggggtttgaggtggagtggggtgactaccaaccctacgagaggtggacaacgaaagtagtacgaactagtaactttacggagggtacgagggttaccaaccgtagtacggaccggttaggggaaccgtcccgtaccgtactacgaagccgtaactacggtaccttaacgtacgtaggaacgttcgtagtacggaccggaccttacggtaccctacggtacgaaccggtacgaccggtacaacgttgtacttagttcggtaggaagtacggtaggttcggtagtacggtacggtacgggtacctaccgtaggtcgggtaacccgg

SEQ ID NO: 99244 - DNA, 808 bp, Homo sapiens
  misc_feature: GYAE6OF01A1CAU.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtctcctgcaagtattcgaggaaacaccctgagcaactacacatacactggatgcgcgacggccctggacgtaggggttgaggtggaggtggggtaggactaccgaacccgtacgaggacgggtcggacgtaacgaaaggtactacggaacgtaacggtaacgttttacggaaggggtaccgtaacggggtacctaaacccgtacggtacgggtaacccgggttacgggggaacccgggttacccggttacccgtaaacggttaacccgaacgggtaacccgtaaaccggtaaccgggtttaaccctaaaccggtaacgggtttaacggggtaaccgttaaccgggttacgggaaaccggggtacccggggtaaccggttaaccggggtaacccggttaaccggggttaacccgggaaaccgtaaaccggtaacccgggtaccgtaacggttacggttaacgttacccggttagggtaaccggtaaagggttaacggtccgggtttagggccggtaaccgggttaaccgggccggggtactaccggtaaaccggtccgggttaggggaaccccggg

SEQ ID NO: 99245 - DNA, 781 bp, Homo sapiens
  misc_feature: GYAE6OF01DMBJU.40.81.H04.1.454.CMB.1.raw
  modified_base (627)..(627): a, c, t, g, unknown or other
  misc_feature (627)..(627): n is a, c, g, or t
tcagtctagcgactcacgaccggtgctcgatttagtagtgtagattcgcgggggagcatcacccagcaaccacatctgtcctctagagaactcccctgagagcctccgttcctcaccatggactggacctggaggactcctcttcttggtggcagcagccgcgaggacgcccactcccgaggtgcagtcgtggtgcgagtcggtggggctaggtaggaggaaaggacggccggtcggggtcctcgggtaggaacggtcctccgtagaccgtaagttagtttaccgtaaacggaaacctacccgtagacgtaacctaaacctacctaactactactaacgtggagtcggccggacgacccgggtcccgtagggtaacggttagggggtttaggagggtagggtagggtcggggtacgaactaacccgtaaccgtaacggaggtacgggtacgtaaccaaacggtaaaaggttacgtaaccggtaacggtaaacgttaccgggtttaacggacggggtaaccggtaacgggtacctaacggtaacggtacccggacgggttacgggacccggtccgtaacctacgtacgaaccgtacaacgttacgtaacctagagtcgtacttacggnggtacggacgtcgtaccgtaccgaggtacgaaccgtacgtaaccggctaagttaccggttatacgggtagtaagaccggttagggtacccggtggacccgttaggacccgggtcgggtacgtaaccggtcccggtaaccgggtggggaccccgg

SEQ ID NO: 99246 - DNA, 774 bp, Homo sapiens
  misc_feature: GYAE6OF01DWQ1U.40.81.H04.1.454.CMB.1.raw
  modified_base (160)..(160): a, c, t, g, unknown or other
  misc_feature (160)..(160): n is a, c, g, or t
  modified_base (373)..(373): a, c, t, g, unknown or other
  misc_feature (373)..(373): n is a, c, g, or t
  modified_base (387)..(387): a, c, t, g, unknown or other
  misc_feature (387)..(387): n is a, c, g, or t
tcagtctagcgactcacgaccggtgctcgatttagtagtgtagattcgcggggactgatcaggactcctcagttcaccttctcacaatgaggctccctgctcagctccgtggggctgactaatgctcgtggtctcgtggactcgaggtgggattagttgngatgactcagtcctcccactcctccctcgacccgtctaccgttccgaggacgccggcccgtccctactacttccctcgtcggtacgtacggtactaacggtccaacggtacctacccttaaacctaactaactaggtacgttaacttaacttacgtttacgttaaggtaacgttaccggtacagaacgtaacggaaccgcggtacgacttacncctacagtccgttntcgtaatagtttagttacgggttacgttccgtacggtcccgggtcccggttccggtacgtgtaacgttacgggtcgaacgggttgaagtacggtagtctacgtaacgtacgtaattaccggtttaacttaactaaccggtaaagacccggttaggaaggtacggggaggtagggtaacggtagtaagtaacggttaggtttcggtttacttaacgttacgacgtagtaacctacgtaccgttaacgtaacgttacggtaaactcggggtagtacccggggttcggaaaccggtaaccggaacgggtaaacggtacggtaaaaccggtaagtaacccggaagttaaccggtaacggttaagccgggtttaacgagtaacccgtaaccg

SEQ ID NO: 99247 - DNA, 606 bp, Homo sapiens
  misc_feature: GYAE6OF01ANEZP.40.81.H04.1.454.CMB.1.raw
  modified_base (510)..(510): a, c, t, g, unknown or other
  misc_feature (510)..(510): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatcctcctgcagtctagtcagacgcctactaaacactaatgatactacttcttagtacttcgtacctgacagaacgccgagggcacgtcctaccacagtcttcttagtaattattaggtttcgggtttactttacggtccgggtcccgttcccggggtccctaggtacgtagggttccgtaggtcggcgtagtgggtatcgagtacacgtaacgttactttacacgtaagaaatcgagacgagggtaggagagaagagtagtggttaggtatttacgtctgactatacgtacctactacgtaanacgttcgtaggtcggaccggtccggaacgaacgggtacgtaaagggtacgtaaagtacgaaacgggtaccgtaacgtggtacgtcgtcgtaacccg

SEQ ID NO: 99248 - DNA, 746 bp, Homo sapiens
  misc_feature: GYAE6OF01DHZYH.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctgggaggactcctcttcgttggtggcagcacgccgcaggacgcccactcccaggtgcagctgggtgctagtcgtggggctgaggtgaagaacgcgtgggctggtgacggtctcgtgactaagtactttcgtacggaaaccacccgtgaacgactaaactacctactaactaacacgtggtagtcggaccggacgtaccgggcccgtagggtacggttacggggttggagggttagggtacgggtgggggtaggtaacctaaccggtaaaaccccgtaacggtaacgggtacgggtacgggtaaacaaacgtaaaacgtacgtaacggaaacgtaacggttaaacgtttaccggacggggtaccgtaacgggtaccaaccgtacggtaccggtaccggtacggggaaccggccgttaccgacgtaccggacgaccgtaaccgtacgtaaccgtaacgtaagtcggtacgtacggtacgggccggaccggtaccggtaccgtaaccggtaccgtacggaacctaaccggaggacctgttacgtagtacgaggtaggacgaggttacggtcggtacgtccggacgggtacggtacgacggacggtcgggacccgggtaccgg

SEQ ID NO: 99249 - DNA, 730 bp, Homo sapiens
  misc_feature: GYAE6OF01B9ODH.40.81.H04.1.454.CMB.1.raw
tcagtctagcgactcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgacccactcccaggttcagctggtacagtcgtggagctgagatgacgagccgtgggcctcgagtagaggtcctcgtgacgaggtcttcgtacgttacctaccttacatagtagtatcgtaggttggcgacgacgaccggccgtaggacgaggtcgtaggaggtaggtaggtaggtagtggtactacgacgtaccgtacttaacgtagttacggaacctaacaaacgtaactagtacgaacaacgtaaccgtaccgtacggacggtacacgtacgtaccaactacgtaccaaccgaacaacgacactaaccaccgacgacgtaccgacccgtactacgaacggtcgacgtaggacgactccgtagacgtacttacgaacggaaccgacggtacccggtagttacgttacgtagtacgggacgaagggtagttaacggggtaacggttaaacgggttaatttttacggtaccggttaaccggtttcccggtttaaccttttacgggttaaccggtccgggttaaccggggtacccggggtaaacccgttaccgggggttacccgttaccccggg

SEQ ID NO: 99250 - DNA, 619 bp, Homo sapiens
  misc_feature: GYAE6OF01EIQ0Z.40.81.H04.1.454.CMB.1.raw
  modified_base (243)..(243): a, c, t, g, unknown or other
  misc_feature (243)..(243): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctggaggtgaagagccgtgggcctggtgagtctcctgacaagtnttcgtaggaaccacctgacgacaactactacatacacgtggatgcggcgacggcccgtaggacggtagggttagaggtggaggtggggtgactaccgaaccctacgaggacggtggacaacgtaaagtactacgaacgacgtaacgtttcggacgggtcgacggtcactagtcgacgtacgggacgtccgtacagtcacgacacgtacgtacgtacagtaggactcgtagacgtcggactccgtaccgtgtacggaacgacgaccgactacgtagttacgttacgtaggtaaggaacgtaggttacggttgggacggtaccggtaccggggtacgggtaccgaccggtaccggtacgggtccggggtaaccccggg

SEQ ID NO: 99251 - DNA, 695 bp, Homo sapiens
  misc_feature: GYAE6OF01CDF3A.40.81.H04.1.454.CMB.1.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (422)..(422): a, c, t, g, unknown or other
  misc_feature (422)..(422): n is a, c, g, or t
  modified_base (475)..(475): a, c, t, g, unknown or other
  misc_feature (475)..(475): n is a, c, g, or t
tcagtctagcgactcacgaccggtgctcgatttagtagtgtagattcgcggggatcaggactcctcagttcaccttctcacaatgaggctccctgctcagctccgtgggctgctaatgctctgggtctcgtggatccgaggtgggtatagttgtgatgactcagtctccacgtcctcccgtgacccgtcactccgtggacgcgccggacctccatcctcgngcgngtcagtcagctaccctaacaaaactacttaagtgtaacttacttacttcgtttagaacgtttcggtacctgacgaacggaacgccgagggacctacgtccacccgatacgcttagtgtacttagtttacggtttcgggtttactacgggttcccgggccgttacccggggtcctagaacgttggttcaggtcggacnggtaggctcgtagtaccaaaggttattaacgtttaacgaacgtaagttaaacncgaacggtggaagggtaggaacgtagaaggtaacgtaggttaggttagtttatttacgttacgagtactcgtacgacccgtaacttacgaaacctaagttcggtacgggtaccgggtaacgggtaccgaagggtaaacccggaaggtaagggttaaacggaaattaccggaaacgcccgggttaaagtcgggtaccggaccacgtaaccgtcgttaaccg

SEQ ID NO: 99252 - DNA, 672 bp, Homo sapiens
  misc_feature: GYAE6OF01D8VAU.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggacgcccactcccaggtgcagctgggtgcgagtcgtggggctgaggtgaagagccgtggggcctggtgaggtctcctgcaagatttctaggaaacacctgagccaactactacatacacgtgatgcgcgacggccctggacgtgggttcgaggtggagtggggtgtacgtaccaacccgttaccgaggtaggtcgacgaacgaaagtacgtaccggaacaaggtaaccgtttacggacgggtaccgaagggttaccaaccgtagtacgggtaacccgtacggggaccgtaccggtacccacgttaccgacgacgaccgtacgttacctaacgtagttacggactcggtacggacggaccgggtaacgttccggtacccgtccgtaggacccggaacggtaccggacccgtagtacggttacgtttacgtcggtagggtaaccgtaggtaccgggtttacggtacggtaccggttaacccgggtcggggtacccgtaaccggg

SEQ ID NO: 99253 - DNA, 666 bp, Homo sapiens
  misc_feature: GYAE6OF01DD2GJ.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctggtctctggatccagtgggatattgtgatgactcagtctccactctccctgcccgtcactccgtggagacgccggcctccatcctcctgcaggtctagtcagacgcctactaaacactaagtggacttactacttctttagaacttcggtacctgacaagaacgccgagggcacgtcctccacagtctcgttgattagttagtttgggttcttacggtccgggtccgttcccgggtacctaggtacgtacggttcgaggtggcgtaggtggtactcgtacgtacaacgtagttaactttacacgtaaagaaaactcgaaggtacggtaggggtagacggacgtaagtaagtagttaggttagggttaatttagtacgtgactacgtacgtaaccgtaacctaagtaacgtaacgtggtacgggtacggtaccgggtaccggaacggaaacggtaacgtaagggtaggtaaacgtacgaaacggtacgtaaacgtggtacggacgttcgacccgtacgtacttccgttacgttcttaccgtaccttcccgttacccg

SEQ ID NO: 99254 - DNA, 692 bp, Homo sapiens
  misc_feature: GYAE6OF01E1FDO.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctctttcttggtggcagcagccgcaggagcccactcccaggtgcagcgtggtgcagtcgtggggctggaggtgaagagccgtggggcctcgggtagaacggtctccgtgactaagtactttcgtaggaaacccacccgtagacgtaccaactactaacataacacgtggatcggcggcgacggcccgtggaacggtaggggtttgaggtggtagtggggtcgacgtaccaacccgtacgaggtacggtacggacaaacgtaaagtactacggaactaacggttaaccgtttacgggaacgggtacgtaacggggtaccgaaccgtaacggtacggaacccggttacggggacccgtccggtaaccctacgttaccgaacggtccaaccgtacgtaccgtacgtacgtcgggtactcgtaggacgggtcgtacgtacgacgtcgtacgaccgacgtacgactagtcgttagtacgaggtaaggacgtaggtacgggttcggacgggtacccgttacgggacggggtcctaacggaccggtcggtcgggggtacccgg

SEQ ID NO: 99255 - DNA, 749 bp, Homo sapiens
  misc_feature: GYAE6OF01BWSBA.40.81.H04.1.454.CMB.1.raw
tcagtctagcgactcacgaccggtgctcgatttagtagtgtagattcgcgggggagagcatcacccagcaaccacatctgtcctctagagaatccccctgagagctccgttcctcaccatggactggacctggaggatcctcttcttggtggcagcagccgacaggacgcccactcccgaggtgcagctggtgcagtcgtggggctggaggtgaagagccgtggggccgtcggtagaaggtcctccgtgacgaagtactttacgtacggaaacctaccccgtagacgaccgtaactactacactactacgtaggacgtcggccggacgaccggcccccgtagggaccggtaggggtttggtagggtagggtaggtgggggtacggtaacgtacccgaaccccgtaccggaacggtacgggtacggacgtaaacgtaaacggtacgtaaccggaacgtaacggttaaccgtttacgggacggggtaccgtacgggtacccgtaccgtaacgtaccgggtacccggtacggggacccggtccgtacccaacgtccgaacggacctacgtaccgttaccgtagtacgtacggtacgtacgtacggacggtaccggtacgtaccgtaccgtacgtacgaccgtaccgaccgtacctagttacgtacttacgtaggtacggtaaggtacggttcgggtacgggtacggtacccggtaccgggtcggtaccgtcgacccgggtgggtaccccggg

SEQ ID NO: 99256 - DNA, 709 bp, Homo sapiens
  misc_feature: GYAE6OF01ANMQO.40.81.H04.1.454.CMB.1.raw
  modified_base (185)..(185): a, c, t, g, unknown or other
  misc_feature (185)..(185): n is a, c, g, or t
  modified_base (232)..(232): a, c, t, g, unknown or other
  misc_feature (232)..(232): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtnactcctggagcgccggcctcatcctacctgcaggtctagtcaggacnccctacctaaacactaagtggaactactactctttgtaattcgtactgacagaacgtccagggccacggtcctccacgagtccttcgttagactagttacgttcggggtttacttacgggtccggggcccgttacccggggttccctaggtacctacgggtttcgaagggttcggacggtagtcgggactcgtaacggtcaacgtagttactttaacgtacgtaagtaaaactcgaggtcgtaggggttacggaggtacgtaaaggtacgttacggttagggtttacggttaacgttttactaccgggtgttaaccgcggttaccgtaaccttaacccggtaacttaaccgtaaacggtttcggacggttacgggtacccgggttaaccgtacccggaaacgggtacccggtagggtaacggtaaacgtacgtaaccgggtacgttaacggtaggtaacccggtggtaacgtacccg

SEQ ID NO: 99257 - DNA, 676 bp, Homo sapiens
  misc_feature: GYAE6OF01C5XKB.40.81.H04.1.454.CMB.1.raw
  modified_base (637)..(637): a, c, t, g, unknown or other
  misc_feature (637)..(637): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtggggcctcggtgaaggtctcgtgacaagtattttcgcggaaaccacccgtgacgacaactactacactacacgtggagtggcggacgacggtccccgtaggacggtaggggtttagaggtagggaggtggggtacgactaccgaacctacgaggtaggtcgacgaacgtaagtatacgactaagtacgttacggaggtacgtaggtcacgatcgacgtcgggaccgtcgacgactacgacgccgaacgtacgttactaacgtagtcggtaatccgtaggacggaccggtacgtacccgttaccgtacgtaccgggaaccgaaccggtccgtaaccgttaagttacggttaaccgttacggttagggtacgggtaaaggtacgggttcgggttacgggttaccggccgggttaacccgggnggggtacccttacgggacccggtacgggtacccgggggg

SEQ ID NO: 99258 - DNA, 828 bp, Homo sapiens
  misc_feature: GYAE6OF01AFSYM.40.81.H04.1.454.CMB.1.raw
tcagtctagcgactcacgaccggtgctcgatttagtagtgtagattcgcgggcacgaccggtgctcgatttagtagtgtagattcgcgggggagagcatcacccagcaaccacatctgtcctctagagaatcccctgagagctccgttcctcaccatggactggacctggaggatcctcttcgtggtggcaggcacgcccgcgaggacgcccctacgtccccagggtcgccgacgctgggtcgcgtaggtccgtggggctaggacggtagaaaggaacggtccgtcggggtcctcgggtaggtaacggttcctcgtggactaagtgtttaccgaacggaaacctacccgtgaacgactaacgtactaacaatacctacggtaggtacgtacgggccgggtaccgtaccggggtacccccggtagggtaaccggtttaagggggggttttacgaaggggttagggtaacggggtttacggggggtaacgtaaacccgtttaaccccgtaaaacccccggtaaccgggtaagggtaaccgggggtaaccgggtaaccggtaaaccggtaaaacgggttaccgtaaccggtaaaaccgtaaccggttaaaccggtttaccgggaacggggtaccggttaacgggtacccgtaacccgtacggtaccggaacccgggtacggggacccgttacccggtaacctaaccgtacgacggtacctaacgacggttaccacggtacgtaaggtacgtcgtaacgggacgacgggtactaccggtacgtaccgggtacgtaccggacgtaccgcttagtaacgttcgtacggtacggg

SEQ ID NO: 99259 - DNA, 803 bp, Homo sapiens
  misc_feature: GYAE6OF01B315K.40.81.H04.1.454.CMB.1.raw
  modified_base (161)..(161): a, c, t, g, unknown or other
  misc_feature (161)..(161): n is a, c, g, or t
  modified_base (166)..(166): a, c, t, g, unknown or other
  misc_feature (166)..(166): n is a, c, g, or t
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggagactcctcttcgttggtggcagcacgccgnaggcncccactccgaggtcncagcgtggngacgngtcgtggggctggaggtagaacgacggtccggtggggtccgttacgggtacggtaacggttccttaccggtggaacgtaacggttacgttttacgaaccggtaaaacctccggttagacgtaactaaaccttactaactactacgtacggtaggacgtccggacgggaccgtaccgggtacccggtagggtaacggtttagggggttagacgggtagggtacgggttacggggtacgtaaccgtaacccgtaaccggtacgacggggttacgggaaccgaacgtaaacggttaaacggtccgtaacggtaacgtaaacggttacgttaccgggaaggggtccgtaaacggtacgtaaccgtaggtacccggtacgggtacgggttaaccccgcgtacctacgacggaacgtacgtaacgtagtaccgtagtacggtacgacgttcggaggtaccggtccggaatttaccggccgtacggtacgaacacccggtaacggtcttagtacgttaagttccgtaaggggacgtacggtaggtacgggttcggacccggttaacgtccgggacggtcgttaaccggacccggtggggtcccgggtaaaccggg

SEQ ID NO: 99260 - DNA, 661 bp, Homo sapiens
  misc_feature: GYAE6OF01BEJIM.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctgggtgcagtcgtggggctggaggtagaagaagccgtgggggccttcgggtaggaaggtcctcctgacaagtatttacaggaaacaccctagagacaactactaacataacactggatggcggcacggcccgtggacgaggggtttgaggtggaggtggggtaggactaccgtaacccacgaggaggtgacaacgtaaagtactacgaacaagtaacgtttacgaagggcgacgggtacaaccgagtacggaccgtacgggacgtcgtacactacgaacggacaacgacggtacttacagtaggtatctaggacggtacggtacgtacgacccgtacgtacggaaccgtaacgaaccgggtacacgttagtaacgtttacgtaggtaacgggtaagtaggtacgggtttcgggacggtacccggacccggggtaccgggtacgttaacggacccggtaaccggtcggggggaacccggg

SEQ ID NO: 99261 - DNA, 586 bp, Homo sapiens
  misc_feature: GYAE6OF01ECVHO.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtctcctgcaagtatttctaggaaacaccctgagacaactactacatacactggatgcggcacggccctggacgtaggggtttaggaggtggagtggggtggataccaaccctacgaggaggtggacaacaaagtatacggaacagtaactttcgagggcgaggtaccacgatcggaccgtgggaccgtcgtaccatcgacgaccacgtacgttcctacgagtgggacttacgtggacggccggtactacggtacctcggtagaccgacgacggctagtgtacttgtaggtaggagtagtacggttggtcggaccgccgggtcgggacttaggacgtcgggtcgggtaacccgg

SEQ ID NO: 99262 - DNA, 570 bp, Homo sapiens
  misc_feature: GYAE6OF01CM8DT.40.81.H04.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (353)..(354): a, c, t, g, unknown or other
  misc_feature (353)..(354): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagtctagcgactcacgaccggtgctcgatttagtagtgtagattcgcggggtgatcaggactcctcagttcaccttctcacaatgaggctccctgctcagctcctgggctgctaatgctctgggtctctggatccagtggggatattgtgatgactcagtcctccactctccctgccccgtcactcctggagagcccggcctccatcctcctgcacggtctagtcagacgcctacctaaaacactaatggaatactactctttgaattggtacctgacagagccgagggcagtcctcacagctctnatatagttgggttctagtcgggcctccggtcctgcngtcagtcgnngtggatgagtcanatatttactactanaaatnagcgagggaggacggacaaggaagtagttggttagggttaattttaagttacgtgtctaagtacgacctaacctacttaacgtaacgtggtacggtgggtaccggacggaaccggaacgggaacccgtaagggtacggaaaagtaccgaaagaccggtaacgtggtaggccgtgaccgtaaccg

SEQ ID NO: 99263 - DNA, 903 bp, Homo sapiens
  misc_feature: GYAE6OF01EN2G3.40.81.H04.1.454.CMB.1.raw
tcagtctagcgactcacgaccggtgctcgatttagtagtgtagattcgcggggatcaggactcctcagttcaccttctcacaatgaggctccctgctcagctccgtggggctgctaatgctctgggtctctggatccagtgggatattgtgatgactcagtcctccactcctccctgcccgtcactccgtggacgacgcccggcctccatctcctgcagtctagtcagacgcctactaaacactagtgtactactacttcttagtaattcggtactgacaaggaacgccgtagggactacggttcctaccgacgtacgtccttacgtttagtaagtttaagttttacgggttttcggggttttacctttaacggggttccccggggttccccggttcccgggggttacccgttaacggtacgttaaccggggtttcgtaacggggtttcgggtaccggtaaggggttacggtaacgtaccggttaaacggtaccgtaaaacgttaacgggtttaacctttttaaccgtaaaccggttaaacgtaaaaacgttaccggtaaacggggtaacgggtaacggggggtaacgggtaacgggtaacggtaaaacgggttaagggtttaaggttttagggggttttaagggttttaactttttaacggtttaacgtcggttaacgtaacgttaaccgtaacccgttaaacccgttaacgttaaaaccggttaaacccggtttggggttaccggggttaacggggttaaccccggggtaaccggggtaaacccggtaaaacggggtaaacccgggttaaaaggggttaacggttaaaaccggtaccggtaaaacgggaaccggttaacggtagggttaccgtaccggtaacgaacccgttacgtaaccgg

SEQ ID NO: 99264 - DNA, 783 bp, Homo sapiens
  misc_feature: GYAE6OF01BE01R.40.81.H04.1.454.CMB.1.raw
tcagtctagcgactcacgaccggtgctcgatttagtagtgtagattcgcgggggagagcatcacccagcaaccacatctgtcctctagagaatcccctgagagcttccgttcctcaccatggactggaccgtggaggatccttcttcgttggtggcagcacgccgcgaggacgcccactcccgaggtcgcagcgtggtcgcgaggtcgtggggctggaggtagaaggacgtccggtcggggtccttacgggtagtacggtctaccgtagacgtaagttacgtttcgtaacggaaaccctaccgtaggaacctaacgaacctaactactaactaacgacgtagacgtcggacggcgtaccggtcccgtaggtacggttaggggttaggacgggtagggtacggtggggtacgtaacgtacccgtaaaccgtaccggaaggtacggtaacgacgaaacgtaagtacgtacggaacgttaacgtaacgtttacggagggtacgtacggtacgaacgtacgtacgggaccggtacgggacccgtacgggtaccctaggtaccgaacggacaacgggtacgttactaccgtagttacgaacgttggtaacggacgtcgaccgtacgttaccgtacgtaccgggaacgaccgtaaccggtaccttaggttaccgttaacgttagggtacggtaaacgggtaacgtacggttacgggttacgggaccgggttcccggtacccgggtacggttaccgaaccgggttaccgggtaccggggtaaccccgggg

SEQ ID NO: 99265 - DNA, 674 bp, Homo sapiens
  misc_feature: GYAE6OF01B9DBA.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaaagaacgccgtggggcctcggtaggaacggtcctcccggacaagtatttacgacggaaaccacctgacgaccaactactacatacactggatgcggcacggccctaggacgtagggtttcgagtggagtggggtacgactaccgaacccgtacgaggtacggtacggacaaacgtaaacgtagtaccgaacgtaacggttaaccgtttcggagggtacgtaacgggtacaaccgtagttaccggaccgttagggaaccgtcgtaccagtaccgagacctaacgacgtcctaacgacgtacggtactcgttaggacggtaccgggtactacggaccgttggaccggtaacctaacgtacggactagttacgtaacgtttcggagttacgggaacgtagggttacggttcgggtacggtaccgttaccgggcggtactaccgggacgtacggtccggggtaacccgg

SEQ ID NO: 99266 - DNA, 569 bp, Homo sapiens
  misc_feature: GYAE6OF01A8X71.40.81.H04.1.454.CMB.1.raw
  modified_base (443)..(443): a, c, t, g, unknown or other
  misc_feature (443)..(443): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagtatttctaggaaacacctgagcaactactacatacactggatgcggcacggcccgtggacgtaggggtttgagtggagtggggtgatacgaacccgtaccgaggaggtgacaacgaaagtactacgaacagtaactttacgagggtcgaacggtcacagtcgaccgtgggaccgcgtccagtcgacgcacgacgtctaacngtaggatcgtaggacgtacggacgtcggacctcgtacgacgacgacggcacgtgtacttacgtagtaggacgtaggtggtgggtacgccgtacgggtcggcgtacgccgtcggtcggggtacccgg

SEQ ID NO: 99267 - DNA, 866 bp, Homo sapiens
  misc_feature: GYAE6OF01ANTNW.40.81.H04.1.454.CMB.1.raw
tcagtctagcgactcacgaccggtgctcgatttagtagtgtagattcgcgggcggtagactttgttgtttcttcgtagtctccctgctcagctccgtggggctgctaatgctcgttgggtctcgtggactccgaggtggggattagttgtgatgactcacgtcctccactcctccctcgcccgtcactccgtggacgacggcccggccctaccacttcctccgtgcgtacggtctagtcgacgaccgtaccctaacctaaaacacttaagtcgtaacttaccttactttacgtttaagtaacgtttacggtacctgacgaaggaacgccggaaggctacgtaccaccgacgtacgtccttacgttacgtaactttaggtttacggttttcgggggtttaccttaccggggttcccgggggttcccgggttaccccggggttacccttagggtaaccggttagggttcgtacggtcggacgtagggtacgactacgtaacgtacgaacgttaagtttaactttacgaaacgttaagaaacgttcgaacgggtacgggtaggggtacgggacggaacgtaagggtaaaggttaggtttagggtttaagggtttaacgttttaacgttacgttacggtagttaaccggtaccgtaacccttaaccgttaacgttaaaccgtaacgggtttcggttaacgggttaccggggtaaccgggttaccgggaaaccgggtaaacgggtaaccggtaagggtaaacggtaacgtacggtaaacggtaaccggttaacggtcgggtacgtaccggtacgtaaccctaccgttacgttccgttaccttaaccgttccgttacccgtcccgtaccccg

SEQ ID NO: 99268 - DNA, 832 bp, Homo sapiens
  misc_feature: GYAE6OF01C42U7.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggagatcctcttcttggtggcagcagccgcaggacgcccactcccaggtgcagctggtgcagtcgtggggctgaggtgaagaagcgtggggcctcggtagacggtctcctgacaagtatttcgtacggaaaccaccctaggacacaaacttactaacataacacgtagatcggcggccgacggccccgtagggacgtacgggggtttgtacggtagggaggttgggggtacgtactaacccgtaaaccccgttacgaagggtaggttacggactaaacgaaagttacgtacggaacaacgtaaccgtttcggaacggggtacgaacgggttaccaaccgtaagtaccgggtaaccggtacggggtaccgtaccgtaaccctacgttaccgaaggacctaaccgtacgttaccgtacgaacggtttacggactttaccggaggtacggtaccggggtacctaccggtaacccgttaccgttacgggaacccggtaaccggtaaccgggtacccgttaaggttaccgtttaaccggtttacggtttacgggtaacgggtaaacggggtaagggtttacccgggttttacgggggtacccggggttaccccggtttaaaccccggggggtcccgggggttaacccgtaaaccgggggttacccccgggtaaaccggggggtttcccggggggtaaaaccccccgggg

SEQ ID NO: 99269 - DNA, 548 bp, Homo sapiens
  misc_feature: GYAE6OF01E3D4U.40.81.H04.1.454.CMB.1.raw
  modified_base (408)..(408): a, c, t, g, unknown or other
  misc_feature (408)..(408): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagattttctggaaaccaccctgagcaactactacatacactggatggcggcaggcccctggacgtaggggtttgaggtgggagtggggtggatccaaccctaccgaggaggtgacaacaaagtatcgacaagtaactttcgagggcagggtcacatcgaccgtgggacncgtcatcgagcacagtctacatggatcgtgagcggactggacctagtacgaccgagacgactagtntacgttacgngtaggagtagacggttaggtcggacgtaccggcggggtactaggaccctcggtcggggtacccg

SEQ ID NO: 99270 - DNA, 735 bp, Homo sapiens
  misc_feature: GYAE6OF01A73FB.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggactactacttctttgaattggtacctgcagaagccgagggcagtctccacagtcctctgattagtagttcggggttacttacggtccgggcccgttacccgggggttccctaggtacgtacgggtttccaaggttcggctagggttaggtacgtcgtacggttacaacgtaaggttaactttttaccaaccgttaaaggtaaaaacttcgaagggtaccggtaaggggttagggaggacgtaaggaaaggttagttagggttagggttaattttacgttacgtacgtactacgtacgtacctaaaccgttactaaaccgtaaagttcggttagggtaccgggtaaccgggttaccgggaaccgtaaacggggtaaccgaaggggttaaacggtaaacgtaccggtaaacggtaaccggtaaccggttcggtacggtacgttacgacccgtaactaccgttacgttacgttaccttaccgttaaccgttccccgttacccccgg

SEQ ID NO: 99271 - DNA, 646 bp, Homo sapiens
  misc_feature: GYAE6OF01D9OVP.40.81.H04.1.454.CMB.1.raw
  modified_base (269)..(269): a, c, t, g, unknown or other
  misc_feature (269)..(269): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtagaagaagccgtggggcctggtagaggtctctgcaagtattttcgaggaaaccncctgagacaactactacattatacgtggatggccggcgacggccctgggacgtaggggtttgaggtggagtggggtagataccgaaacccgtacgaggtaggtgacaaacgtaaagtacgtacgaactaagtaaaccgtttagacgggtacgacgggtacccaaccgtaacgtacggaccggttaggggaccgtacgttaccaacgtacgacgaccaactacgtactaacgagttggaactcggtagaaggccgtacgtacgaccttacgcggaaccgacgacggtacaagtttacgaactttacggagggtaaggaaacggtacgtacggggttcggtacgggaccgttaacccggggcgggtaccgtaaccgggg

SEQ ID NO: 99272 - DNA, 750 bp, Homo sapiens
  misc_feature: GYAE6OF01DEHFG.40.81.H04.1.454.CMB.1.raw
  modified_base (236)..(236): a, c, t, g, unknown or other
  misc_feature (236)..(236): n is a, c, g, or t
tcagtctagcgactcacgaccggtgctcgatttagtagtgtagattcgcggggatcaggactcctcagttcaccttctcacaatgaggctccctgctcagctccgtggggctgctaatgctctgggtctctggatccaggtggggatattgtgatgactcagtcctccactcctccctcgcccgtcactccgtggagacggcccggcctccactctcctgcaggtctagtcagacncctacctaaacactaagtgatactacttgtttagtaagttcggtacctgacgagagcgagggcagtcctaccacgagtccttcttagaattagttaggtttcgggtttacttacggtcccgggtcccgttccggggtccctagacgtacggttcgaggtcgacgtaggtggaactcgaagtaccaacgtagttaaccttttaaccgaacgtttaaacggaaaacttcgaaacggacgggtaaggggtaacggaaggtaaaccgtaaggtaaaggttaaggtttaggggtttaaggttaagtttttaaccgtttaacgtacgtacgtaagttacccgaaccctttaaacccctaaccgttaaaaccgttaaacggttgggtacgggttaaccgggtaccgggtacccgggaaacccggtaaacggggtaaaccggtaaaaggggtaacgaaaacgtaccggaaacggaacgttaaaccgtggtaccgggtaccttacggaaccctacccgttaag

SEQ ID NO: 99273 - DNA, 701 bp, Homo sapiens
  misc_feature: GYAE6OF01B3L06.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatccctgagagctccgttcctcaccatggactggactggagatcctcttcgttggtgcagcagccgcgaggacgcccaccgtcccgaggtgcgagtccgtggtgcgtaggtcgtggggctggagggtagaaggacgccggtacggggccgtcggtagtacgttcctccgtgactaagttagtttaccgaacggaaacctacccgtagaacgactaaacctaacctaacaactaaccgacgtaggagtcggaccggcgaacccgggtcccgtagggtaaccgggttagggggtttagaggggtaggtaaggggtcggggtacggtaacctaccgtaaacccgtaccggagggtacggtaccggaactaaaggtaagttacgaccgaactaacggtacgttacgggaacgggtacgtaacgggtaccaacgtagtaccgtacggtacggacgtaccgtactacgacacgaccgtacgaccgttactacgagtcggaacttcggaggaccggtacggtactccgggaaccttcggaacgacccgtacggccgtactagttacgaagttcggaaggg

SEQ ID NO: 99274 - DNA, 648 bp, Homo sapiens
  misc_feature: GYAE6OF01CD893.40.81.H04.1.454.CMB.1.raw
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (640)..(641): a, c, t, g, unknown or other
  misc_feature (640)..(641): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggagatcctcttcttggtggcagcagccgcaggacgccccactcccgaggtcgcagctggtgcagtcgtggggctggaggtagaagaacgccgtggggcctcgggtagtaacggtctcctgactaagtntttcgaggaaaccncctgacgacaactactacactacacgtggatcgcggcgacggcccgtaggacggtaggggttcgaggtcggaggtggggtagacctaccgaacccgtacgaggtacggtacggactaacgtaaagtacgtacgaacgtaacggttaaccgtttacggaagggtaccgaacgggtaaccaaccgtaaggtacggacccggttacggggacccgtaccgtaccgaacgttacgacgtaccgtaacgacgttaccgacgtacggttacggacgttcgggtacggacgggtccgggtcggtacgggaccggaacgggaccgacgacggtagcgnngngngng

SEQ ID NO: 99275 - DNA, 685 bp, Homo sapiens
  misc_feature: GYAE6OF01B22BH.40.81.H04.1.454.CMB.1.raw
  modified_base (534)..(534): a, c, t, g, unknown or other
  misc_feature (534)..(534): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggactcctcttcttggtggcagcagccgcaggagcccactcccaggtgcagctggtgcagtcgtgggctgaggtagaagaagccgtggggccgtcggtagaaggtctccgtgactaagtatttcgtacggaaaccacccgtagacgacaaactactaacactacacgtggagtcggccggcgacggccccgtagggtacggtaggggtttaggtaggtgggtaggtgggggtaggtactaccgaacccgtaccgaaggacggtacggacaacgtaaacgtatacgaacgaacgtaacgttacgacgggacgtacgggtaccaccgtaacgtacggacccggtacgggggaccggtccgtaccacgtaccgaagacccaacgtacgttcctaacgtgtacggtntccgtaggacggtacggtacctacggtaccgtcgtacggaccgaacgaccgggctagttacgttattcgtaggtacggaagtacggtaacggttcggtacgggaccgtccgggtacgggcttaccggaccgttacgggcggggtaacccgg

SEQ ID NO: 99276 - DNA, 718 bp, Homo sapiens
  misc_feature: GYAE6OF01CWR5Q.40.81.H04.1.454.CMB.1.raw
  modified_base (138)..(138): a, c, t, g, unknown or other
  misc_feature (138)..(138): n is a, c, g, or t
  modified_base (209)..(209): a, c, t, g, unknown or other
  misc_feature (209)..(209): n is a, c, g, or t
tcagtctagcgactcacgaccggtgctcgatttagtagtgtagattcgcgggcacgaccggtgctcgatttagtagtgtagattcgcggggagagcatccaccagcaaccacatctgtcctctagagaatccctgagngctccgttctcaccagtcggactcggacctggagactcctcttcgttggcggcacgcacgccgcgaggacncccactcccgaggtcgcagtctaggtcgactaggtcgttcgggggctaggtgggtaggaacgacggtccggtcgggtccgtacggtacgtacgtccgtacgtacgtacgtaacgttacgttacgaacggtaacctccgtacgactacctaacctactactacgtacgtgtaggtacgtcggtacggtacgtaccggtccggtagggtacggttagggtacggtggtagggtacggtacgggtactaccgtaacccgtaaccggtacggacggtacggtacgaacgtaacggtaacgtacgtaacgtacgtaacgttacggttacggacggtacgtacgtaccgtacgtaacggtcggtaacggtaccggaccgtccgtacgacgtaccgacggtaccgtacggtacgtacgtagtacggtacgtacgtacgtacggaccggtacggtccgtaccgtaccggtacgtaccgaccgtacgtaccggtatacggttacgtacgtacgtacgg

SEQ ID NO: 99277 - DNA, 558 bp, Homo sapiens
  misc_feature: GYAE6OF01E32QK.40.81.H04.1.454.CMB.1.raw
  modified_base (549)..(549): a, c, t, g, unknown or other
  misc_feature (549)..(549): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagaagccgtggggccctcggtgaacggtctcctgacaagtatttcgtaggaaaccaccctgacacaactactacatacactggatcggcgcacggcccctggacgtaggggttgagtggagtggggtgactccgaaacccgtacgaggaggtacgaccaacgaaagtctacgacgagtaacgttcgagggcgagggtcaccgtagtcggaccgtgggaccgccgtaccagtacagccaacgtacgtacctaagtagtggtactcgtagacggccggtacgtgaccgtgacgacacgcggacagtntagtcgtgg

SEQ ID NO: 99278 - DNA, 757 bp, Homo sapiens
  misc_feature: GYAE6OF01E3F4K.40.81.H04.1.454.CMB.1.raw
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
tcagtctagcgactcacgaccggtgctcgatttagtagtgtagattcgcggggatcaggactcctcagttcaccttctcacaatgaggctccctgctcagctccgtggggctgctaatgctctggtctctggatccaggtgggattattgtgatgactcagtcctccacttcctccctgcccgtcactccgtggacgcgccgcctcatctctgctgtctagcagcgcctacaaacataagngactactacttcgttagtagttcgtacgtgacgaggacgaccgnggactacgtcctacacgcgtcttacgttagtactttagtttacggtttcgggtttaccgttaccgggtcccggggttccccggtcccggggttcccctaggtaaccgtacgggttaccgtgggtcgggtacgtagggtacggtactaccgtagtaccgtaagttaacgtttaacttttaaccgaacgtttaaacgtaaacgtaacgtagggtaacgggttaacggggtaagggaacgggtaacggtaagggtaaagttcgggtttaagggttaggtttaactttttaacgtagtacgtacgtacgtaaccgaccttaaacgtaccgttaaacgttaacggttcgggttacggaccggggttaaccgggtaccgggtaaaccggaaacggggtaaaccggtaagggttaaaccgaaacggtaaccggtaacggacggttaaacgtcggtacgtacgtacgaccgtacttacgg

SEQ ID NO: 99279 - DNA, 733 bp, Homo sapiens
  misc_feature: GYAE6OF01EAQ9K.40.81.H04.1.454.CMB.1.raw
  modified_base (158)..(158): a, c, t, g, unknown or other
  misc_feature (158)..(158): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccgagtgggatattgtgatgactnagtctccactctccctgcccgtcactcctggacgacgcccgcctccatcctcctgctaggtctagtaccagacgtcccttaacctaaaacaccttaagtcggtaattaccttaaccttcgtttagaagttttcggtaacctggacaaggaacggccgaaggggctacggttcctacccanacgtccttagttnactttagtagtttcggggttacttaggtccgggtcccgtccggggtcctggacctggttcaggttggctaggtcgacttccgagtaccacgtagttactttacgatagaaactcgaaggtacgaggggtagacgtacgaaggtaggttacgttagggtttacggttatttaacgtttacgacggtaacttacgtacggaaccctaaccggttactaaaacccggttagtttacgggtacgggttaccggggacccgggttaccggaaaccgggaaaccgggtaacccgggtaaagggttagggtaaaaacccttcggaaaacgggtacccgtaaaccggtttggggaaccttaccgggaccgtaacccgtaaccgtttacgg

SEQ ID NO: 99280 - DNA, 601 bp, Homo sapiens
  misc_feature: GYAE6OF01B606L.40.81.H04.1.454.CMB.1.raw
  modified_base (333)..(333): a, c, t, g, unknown or other
  misc_feature (333)..(333): n is a, c, g, or t
  modified_base (369)..(369): a, c, t, g, unknown or other
  misc_feature (369)..(369): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtctcctggacaagtatttcgtaggaaaccacctgacgacaactactacatacacgtgatggcggcacggccctggacgtagggtttgagtggagtggggngactaccaacctacgaggaggtgacaacgaaagtanacgaacaagtaactttacgacgggacgagggtcaccgagtacgacgtgggaccgtccgtaccgataccgagaccgaacgtacgtacctaacgagtaggactaccggtaggacggtaccggtacgtaccggtaccgtacgtacgacccgtaacgacggaccagtgtaaccttgtagtaggagtacggtacggtcggtagccgtacggcggtacacgaccgtggtcggacccgg

SEQ ID NO: 99281 - DNA, 758 bp, Homo sapiens
  misc_feature: GYAE6OF01D6UU2.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctggtgaaggtctctgcaagtatttcgtaggaaccaccgtgagcaactactaacatacactggatcggcggcgacggccccgtaggtaaccggtaggggtttaggaggttgggtaggttaggggggtcggtaacttacccgtaaccccgtaaccggagggtaacgggtacggaacgaaacgtaaaaggttaacgtaaccggaaccgtaacggtaaaccgttttacggaacggggtaccggacgggttacccgaaccgtaagtaccgggtaaccggttcggggacccggtccggttacccgaacgtaccgaacgtaccgaaccgtacgttaccgtaacgtacgttacggtaactcggttagggaccgggtacgggaccgttaccgaccgtaccgtacggaacgtaccggaccgacccgtaagttacgtacgtttacgtaggtagggtaacggtaggttaccgggttggggtacggtacccggtacccgggtaccgggtacgtacccggaccgggttcgggaccggggtaaccccggg

SEQ ID NO: 99282 - DNA, 844 bp, Homo sapiens
  misc_feature: GYAE6OF01B0CXW.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttctggtggcagcagccgcgaggacgcccactcccgaggtcgcacgcgtgggtcgacacggtcgtggggctaggaggtagaaaggaacgccgggtcgggggtccgtcgggtaggaacggttcctccgtacggacgtaaagtacgttttccgaacggaaacccacccgtagacgaccaaaccttactaacaactacacgtggtatcggcggaccgaccggtccccggtaggtaccggtaggggtttagagggttagggtagggtcggggggttacgaacgtacccgaaacccgttaccggaaggtacggggtaaccggaccgtaaacggtaaacggtaacgtaccggtaaacgtaaacggtttaaccgtttaccgggaacggggttaccggaaaccgggttacccgaacccggttaaggtacccgggttaacccggtacggggggtaaccccgtacccgttaacggtaacctaccggaaacccggacttaacccggtaacggttaccgtaacgtacgggtacggtaacttacggaaccgggcggggtaacccgtacggtacggtacccttagggtaccggacggaaccgtacgggtaccctaagttacggttaccgttaagggcggtaaagggtaacgaggggttacggtcgggtaccggtaacggcccgggtacggtaccacgggaggtaccgggacccgggg

SEQ ID NO: 99283 - DNA, 911 bp, Homo sapiens
  misc_feature: GYAE6OF01ECDLW.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactcggaccgtggaggactccgttctttcgttgggtggcaagcacgccgacgaggacgcccacctcccgaggtcgcgagtcgtggtgacctaggtcggtcggggtacgtgggtagggttaggaaacggaacggtcccggtcgggggtcccgttacgggtacgggtaacgggtttcctaccgttacggaaccggtaagttacgtttttacccggaaccgggtaaaaccctacccggttaggaaccgtaacctaaaaccgtaaccttaacgaaactttaaccggacgttagggaacgttaccgggccgggaccgtacccgggtaccccgtaggggaccgggtttaggggtttacgagggtacgggtagggtggggttacgacctaacccgtaaccgtaacggaggagggtacgaacgtaaacgtaacggtacgtaaccggaattaaccggttaacgttacgggaaccggggtacgtaaaccgggtaccaacggttacggtaaccggtacgggtaccggaccggtaccgttactacggaccggtaaactccggtaactacccggtaattaccggttagaacgggttctaacgggtacggacggtaccggggtaacctaccgggtccgttaaacggtaccggaaaccgtaccggtaacgtttccgggtaatttaaccgggtttaagtaacccgttaggggaaaccgtttgggaaaccgggttcggggttacgaacggggtacccggtcccggggaacggggtcccgtaggtaccccggggtaggtcccgggggg

SEQ ID NO: 99284 - DNA, 882 bp, Homo sapiens
  misc_feature: GYAE6OF01CVOAO.40.81.H04.1.454.CMB.1.raw
  modified_base (180)..(180): a, c, t, g, unknown or other
  misc_feature (180)..(180): n is a, c, g, or t
tcagtctagcgactcacgaccggtgctcgatttagtagtgtagattcgcgggcgtagactttgtgtttctcgtagtctccctgctcagctccgtgggggctgctaatgctcgtgggtctctggatccaggtggggatattgtgatgactcagtctccactctccctgcccgtcactccgnggagacgcccggcctcatctcctggcagtctagtcagcgcctactaaacactaagtggatactacttctttagaattggtacctgacgaagaacgccgagggacacgtacctaccacgacgtcttcgtttagtaactttagttaggttttcggggtttacgtttacgggtccggggtcccggtttcccggggtcccctaggaccgtaagggttcgacggttcggtcgtagggtcggtaactcgtaacgttaccgtaaagtaacgtttaacgtttttaaaccgaaaacggtttaaaagtaaaaaccgttcggtaaacgggtacggggtaacgggggggttaacggggtaaacggggaaccggttaaagggtaaaacgggttaaaggttttaagggggttttaacggggttttaaaacgttttaacggttttaaccgtaggttaaccgtacgttaaccggtaaccctaaccccgttttaaaccgtaaaacgtaaaccggttttgggaacggggttaaccgggggtaaaccgggggttacccgggtaaacccggggttaaaacggggtaaaacccgggtaaagggtaaacgggtaaaaagttaaccgaaaacgggttacgtaaacggttcgggtacggtacggttaacgaccgttaactacgttaccgttacgttacctttaccgtcgtttacccccgtacccgg

SEQ ID NO: 99285 - DNA, 658 bp, Homo sapiens
  misc_feature: GYAE6OF01DJ5M1.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggagtgaagagccgtgggcctcggtgaaggtctcctgcaagtatttcgtggaaacctaccctagacgactaactactacatacactggatacggcgcgacggtccctaggacgtaggggtttagagtggtagtggggtgactaccaacccgtacgaggagggtcgacaacgtaaagtactacgaactaacgtacgtttcgagggacgacgggtacacgtagtacgaccggtcgggaccgtacgtaccacgtaccgagaccaacgtcgtacctaacgtagtacggtatcgtagggacggaccggaccgtacgaaccgttccgacgaaccgtaaccgaccgtaaccgtagttacgttacgttacgtagggtacggtaaacggtaggttacgggtacgggttacggacccggtttaccggggacgggtacgtaccggtacccggtacggtacccggggg

SEQ ID NO: 99286 - DNA, 813 bp, Homo sapiens
  misc_feature: GYAE6OF01DB6F0.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccgaggtggggattattgtgatgactcagtcctccactcctccctcgcccgtcactccgtaggacgacgcccggcctccacgttcctccgtgaccgtaggtacttacgtcgacgaccgtacccttaacctaaaactaacttaagtacggtaacttaccttaccttacgttttagtaacgtttcggtacccgtgacgaacggaacgaccggtacggcctacgtaccaccgtacgacgttacttcgttataattaaggttacggtttacggggtttaccttacgggttcccggggtccccggtttccccgggggttaccttacgggtaaccggtttacggggtttaccgtaagggtcggtacgtaggggttacggtacgttaccgtacggtaacccgttacgtaaacgtttaacgttttacccgaaacgtttaaaaggaaacttacccgtaaggtacgggtaaggggtacggaacgggaaaggtaacggtaaagtagggtttacggtttaaggttaacttttaacgttacgtaagtcgttaaagtaccggtacctaaaccgttactaacgtacggtggtacgtaccggggacggtaccgggacgtaaaacgggtacggtaagggtacgtaaacgttacggaaacgttacggaacgttgggccgtagtaccgaacccg

SEQ ID NO: 99287 - DNA, 1007 bp, Homo sapiens
  misc_feature: GYAE6OF01CV959.40.81.H04.1.454.CMB.1.raw
tcagtctagcgactcacgaccggtgctcgatttagtagtgtagattcgcggggtgatcaggactcctcagttcaccttctcacaaatgaggcctccctgctcagctccgtggggctgctaatgctcgtgggtctcgtggactccgaggtaggggattattggtaggatacgactcgtactcctccctaccttccttccccgtccgtcccccggtacctacccgttccgtacggggaacggaccggccccggtccccttacccgtacttcccttcccgtcggtacccggttaacgggttccttaacggttaccggaacggtaacccggttaccccttaaaccccgttaaaaacctaaaccttaaaggttacggtaactttaaccgttaaccttttaccgtttaagttaacggtttaccggtaaccgtacggaacgtaacggaaaccggccggaacggggtaccttaccgttaccctacccgtaacgtacgttacctttacgttacggtaattttacggtttaacgggtttttcggggtttaccggttacccggttcccgggggttcccccggttaccccggggttcccgtaaggtaccgggttacgggttctacgggtcgacggtagggttacacgtaacgtacgtacgtaacttaacgttaacgtttaacgtaacgtaaacgtaaaacgtcggtaacggtacgggtaacggggaacgggtaggaacgggtaaagggtaaagtttacgggtttaagggtttaacggtttacttttaacgtttacgaggtaaccttaagtaacccgtaaccgttacccttaactaaacccgggtttaacgtcggggttaacccggggttaacgggttacccggggtaaaccgggtaaaacccggggtaaaccgggggtaaaaccggttaaacgggggtaaacttaaaaccggtaaccggggtaacggtaaacccgggtaggttaccggggttacgtacccgtcggaaccgtttaacccg

SEQ ID NO: 99288 - DNA, 717 bp, Homo sapiens
  misc_feature: GYAE6OF01EHITP.40.81.H04.1.454.CMB.1.raw
  modified_base (240)..(240): a, c, t, g, unknown or other
  misc_feature (240)..(240): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagagccgtgggcctcggtgaaggtctcctgcaagntttctggaacaccctgacgacaactactacatacactggatggcggtcacggtccccgtggacgtaggggtttagaggtgggagtggggtgacgtaccgaacccgtaccgaggtaggtcggacaacgaaaggtactaccgaacgtacggttaactttcgagggacgtagggtaccaacccgtagtaccggtaccggttacggggaccggtacccgtacccgtaagtccgacgaccgtaaaccgtacggttaccgtaaccgtaggttacgggacgtttaccggtaggtaaccggacgggttacccgtacggtaccccgttacggtaaccgggaaccgtaaccgggtaccggtaccgtagttacggttaactttaacggtaccgggtaaagggaacggttacggaacgggtttgggtacggtacccggtacccgggtcgggtaacttccgggaaccgtaccggttcggggaaccccggg

SEQ ID NO: 99289 - DNA, 677 bp, Homo sapiens
  misc_feature: GYAE6OF01ALC65.40.81.H04.1.454.CMB.1.raw
  modified_base (191)..(191): a, c, t, g, unknown or other
  misc_feature (191)..(191): n is a, c, g, or t
  modified_base (344)..(344): a, c, t, g, unknown or other
  misc_feature (344)..(344): n is a, c, g, or t
  modified_base (670)..(670): a, c, t, g, unknown or other
  misc_feature (670)..(670): n is a, c, g, or t
tcagtctagcgactcacgaccggtgctcgatttagtagtgtagattcgcgggactgatcaggactcctcagttcaccttctcacaatgaggctccctgctcagctcctggggctgctaatgctctgggtctctggatccaggtggggatattggtgatgactcgagtctcctactcctccctcgcccgtcnctccgtggagcgccggtcctcactcctcctgcgtagtctagtcgagcgtcctactaaacacttaagtgaacttaaccttacgttactttagtaacttcggtacctcgacgaaggacgccggtacggactacgtacctaccgactagtccgttntacgtaagttagttacggtttcgggttaccttacggtcccgggtccgttccgggtacctcggtacgtcgtcggtagtcggtactacggtcgacgtagccgtacgtacgtcgttaactacgtaagtaacgtaacttacgaaccggtggtaacggtacggacgtaagtacgtaaggtaggttggttaacgtttatttaacgtgtcgtaactacgtactaacgttaccttacgtaacgtaacgttgtacgggtacgggtccgaacggtaacgtaacgggtaaacgtaggtacgaaacgtacgtaacggtacgaacgttcggagtcccgntaaccgg

SEQ ID NO: 99290 - DNA, 547 bp, Homo sapiens
  misc_feature: GYAE6OF01B3QV3.40.81.H04.1.454.CMB.1.raw
  modified_base (169)..(169): a, c, t, g, unknown or other
  misc_feature (169)..(169): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (376)..(377): a, c, t, g, unknown or other
  misc_feature (376)..(377): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (431)..(432): a, c, t, g, unknown or other
  misc_feature (431)..(432): n is a, c, g, or t
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
tcagtctagcgactcacgaccggtgctcgatttagtagtgtagattcgcggggggagagcatcacccagcaaccacatctgtcctctagagaatcccctgagagctccgttcctcaccatggactggacctgggaggattcctctttcttggtggcagcagccgcaggngcccactcccaggtgcagctggtgcagtcgtaggggctggaggtagaagaacgtccgtagggcctcggtagaaggtctcctaggacaaagtagtttctacggtaaaccaaccgtcgagacaaccttaacacaactaacaacgtcggtatacggaccggtacgaccggtacccccgtacgggaaccgggttagggggttttacnanannagaganacnacacganacgngacgagagacgagananacgananacgagtanannaganagagagagatnanananacnacananacatacganacaganaganacgatacganacgtagacgtacgtacgtacgacgacaactaccgacgaacacacgtactacagtag

SEQ ID NO: 99291 - DNA, 532 bp, Homo sapiens
  misc_feature: GYAE6OF01DQBAD.40.81.H04.1.454.CMB.1.raw
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (430)..(430): a, c, t, g, unknown or other
  misc_feature (430)..(430): n is a, c, g, or t
  modified_base (462)..(462): a, c, t, g, unknown or other
  misc_feature (462)..(462): n is a, c, g, or t
  modified_base (505)..(505): a, c, t, g, unknown or other
  misc_feature (505)..(505): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaggtctctgcaagattctaggaacaccctgagcaactactacataccactggatgcggcacggcccctggacgtaggggtttgaggtggagtggggtgatacaacctacagnggtgcaanaagtatcgacagacttgagggcaggtcacntcgacgnggacncgtacatcagcacgagtctacngtggattcgnggagcggtacngtaccctgcgacgacgacgctagtgtatacgngtaggaagtaggtaggttcggacggtccgtaccgggcgggtanccggaaccgccggtcggggaacccggg

SEQ ID NO: 99292 - DNA, 877 bp, Homo sapiens
  misc_feature: GYAE6OF01DI9WX.40.81.H04.1.454.CMB.1.raw
tcagtctagcgactcacgaccggtgctcgatttagtagtgtagattcgcgggggagagcatcacccagcaaccacatctgtcctctagagaactcccctgagagcttccgttcctcaccatggactggaccgtggaggactcctcttcttggtggcagcagccgcaggacgccccactcccgaggtgcagtcgtgggtgacgagtccgtggggctggaggtagaagaagccgtggggcccttgggtgaacggtcctcctgactaagtattttcgacggaaaacctcccgtagacgactaaaccttacctaacaactaccaacgttggactcgggaccggaccgaccgggtccccgtaggggtaaccggtaggggggtttttaggaagggttaggggtaaggttgggggggttacggaaccgttaccccgtaaaccccgtaccggtaagggtaacgggttacgggaacctaaaacgtaaaaaggttaaccgtaaccggtaaaccggtaaacggttaaaccgttttacgggaacgggggtaccgttaaacgggggtacccttaaccggaacgttaccgggaaacccggttacgggggaacccgtacccggttacccaaacgttaccggaaacggtacccctaacgtaaccggtttacctaacgaacgttacgggtaacttaccggtaggaacgggacgggttaccgtaccgggaccgtacggtccgggaaacaccggtaccgggacttacgtttacggtaacgtttacggtaacggttacgggaaagttaccgggttacggtaccgggggttaccgtaacccggggttaacccggggcggggttacccaaaccgggttccgaaccgggggtaccggggg

SEQ ID NO: 99293 - DNA, 860 bp, Homo sapiens
  misc_feature: GYAE6OF01EIVY6.40.81.H04.1.454.CMB.1.raw
tcagtctagcgactcacgaccggtgctcgatttagtagtgtagattcgcgggggagagcatcacccagcaaccacatctgtcctctagagaactcccctgagagctccgttcctccaccagtggactcggaccgtgggaggacttcctctttcgttgggtggcagcacgcccgcgacggacgccccacctcccgagggtcgacgagtccgtggtcgcgtacggtcggtcggggtcgtaggtaggtaggaaaggaaccggtccgggtcgggggtacccgtcggggtaggtaacggttccgttaccggtacggtaacgtaaagttacgttttaccggtaaccggaaaccctacccggttagaaccgtaacctaaaaccttacctaactacgttaaccgtacggtacggtacgtccgggaccggtaccggtacccggtaccccggtagggtacgggttaggggttaggtacgggttagggtagggttaggggtaccgtaaccgtaaccccgtaacccggtacggtacggtacggtaacgaacgtaaacgtaaacgtacgtacggataacgtacgtacggacgtacggtaggaccctagtaccgtcggtaccggtacggaccgtaccgtaccgtacgacgtaacgtaccgacgttacgtactacggtagtcggtactacggtacggaacggtcccggtaacttacccgggtacctaccggtaacggaaccgtacccggaaccgtgttaaccgtaagttaccggttaggtacggtaacgggttaaaggcgggtttaaccgggtggtcccggaaccggtcggggtacggtacccgtacgggaacccggttcccgggtaaaccgggg

SEQ ID NO: 99294 - DNA, 613 bp, Homo sapiens
  misc_feature: GYAE6OF01CHLQR.40.81.H04.1.454.CMB.1.raw
  modified_base (454)..(454): a, c, t, g, unknown or other
  misc_feature (454)..(454): n is a, c, g, or t
tcagtctagcgactcacgaccggtgctcgatttagtagtgtagattcgcgggggagagcatcacccagcaaccacatctgtcctctagagaatcccctgagagctcccgttcctcaccatggactggacctggaggatcctcttcgttggtggcagcagccgcaggacgcccactcccgaggtgcagctggtgcagtcgtggggcctggaggtagaaagagccgtgggcctcggtgaaggtctcctgcaagtatttcgtacggaaacacccgtgacgacaactactacactacactggactcgcggcacggtccccgtggacgtaggggttgaggtggagtggggtagacaccgaaccctaccgaggaggtcgaacaagaagtgtacgaacgagtacgttcgaggcgaggcacgatacgccgtggacgtacgacagtcacgacacgtactacanacgttacgatcgtagacgcgtactcgaccttcgacgacgaccgacgacctagtcgttacgttacgtaggtacggtaagtaacggttcggtagggtacccgtaccggggtccgggaaccggggtccgtaaccgggtaacccggacgggtacccccggggg

SEQ ID NO: 99295 - DNA, 654 bp, Homo sapiens
  misc_feature: GYAE6OF01BCHYC.40.81.H04.1.454.CMB.1.raw
  modified_base (181)..(181): a, c, t, g, unknown or other
  misc_feature (181)..(181): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccgagtgggatatgtcgatgactcagtctcactctcctgcccgtnactccgtggagacgccggcctccgatcctccgtgcaggtctagtcagcgtcctactaaaacactaatggaacttactaacttctttagaactttggtaacctggacaagaacgccgagggcctagtcctaccgaccgagtcctaccgttagacttaagttacggtttgggttacctttagtcgtcggtccgttaccggggtcctagacgtgtacagtcggcagtcgatcagttacacgtatagtttacacgtagtaaactgacgtcgtaaggtggaggaacgtaggaagtaagttggtacggttaactttaagttaccgtgtattaacgcgtaacaacccttaactaacgtaaacgttagggttcgttaaccgggtacgggtacccggtaaaccgggaaacgggtaaaccggtaacggtaaagggaaccttaaggaaacgtaaccgaaacgttgggacgtacgttcgaaaccg

SEQ ID NO: 99296 - DNA, 745 bp, Homo sapiens
  misc_feature: GYAE6OF01EQ1O2.40.81.H04.1.454.CMB.1.raw
  modified_base (330)..(330): a, c, t, g, unknown or other
  misc_feature (330)..(330): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcgttggtggcagcacgcccgcgaggacgccccactccccgaggtcgcaggtccgtggtcgcgtaggtccgtggggctggaggtagaagaacgccggtggggtcctcgggtagaacggtcctccgtgacaagtactttcgaacggaaaccncccgtgaacgacctaactacctacgtactacacgtggacgtcggaccggacaccggtccccgtagggtacggttagggggttacgagggtacggtaggttcgggggacgtaaccgtacccgaaacccgttacggaagggtcgggtacgaacctaacggtaaagttaccgacggaaactaaggttaaccgttacggacgggtacggtaaccgggtacctaaccgtacgtaccggtaccggtacggggtaccgtaccgtaccgaacgttacggaacccgtacgtaaccgtacggttaactaacgaggttacggtactaccgggttggaaccggtcgggtaccgtacgtacccggttacggaacccgtaccggaaccggtaccgtaccgtaagttacgttacggttacggtaacgggg

SEQ ID NO: 99297 - DNA, 711 bp, Homo sapiens
  misc_feature: GYAE6OF01C6RDW.40.81.H04.1.454.CMB.1.raw
  modified_base (538)..(538): a, c, t, g, unknown or other
  misc_feature (538)..(538): n is a, c, g, or t
tcagtctagcgactcacgaccggtgctcgatttagtagtgtagattcgcggggactgatcaggactcctcagttcaccttctcacaatgaggctccctgctcagctccgtgggctgctaatgctctgggtctcgtggatccaggtgggatattgtgatgactcagtctccactcctccctgcccgtcactccgtggacgacggcccggtcctccattcctcccgtgcgtaacggttccgtaagtaccgaggaccgtccccttaaacctaaaaacgaccttaaagtacggaattaaccttaacgttcgtttagtaactttcgggtaaccctggaccaaggaacgcccggaagggccaaggtccctacaacctgcttcttagtattagttaggttcggggttactacgtccggggtcccgttaccggggtccctaggtacgtagggtttaccagggtacggacgtaggttaggactaccgtatacccgtaatagttaactttaacgacttaagaaatcgaggacggtaaggggagaacgngtaaaggagttagttaggttagggtatttaacgtaccgtagactagtacgaacctaaaccgtactaacgtaaccgtggttcggtagggaaccggttacggaaaccggttaaacgggaacgtaagggtaagtaaaccaggaaaccgtcggtaaacgtggtacgtgtacgtaacc

SEQ ID NO: 99298 - DNA, 854 bp, Homo sapiens
  misc_feature: GYAE6OF01DMNQV.40.81.H04.1.454.CMB.1.raw
  modified_base (386)..(386): a, c, t, g, unknown or other
  misc_feature (386)..(386): n is a, c, g, or t
tcagtctagcgactcacgaccggtgctcgatttagtagtgtagattcgcgggcgtagactttgtgtttctcgtagtctccctgctcagctccgtggggctgctaatgctcgtgggtctcgtggatccgaggtggggtattagttgtgatgacctcgacgtcctcctacctcctccctcggtccctacaccgttccgtagggacggaccggcccggtcccttacctacgttcctccgtcggacgtacggtacctaggtccgaaggtccgtaccctaaacctaaaacgtaacgttaagtcggttaaccttaccttacgtttacgttaagttaacgttcgtaccgtgaacgtaacggaacggccgaagggtcctagtcccacctaacgngttccttagtaacgtagtttagtttacggggtttcggtttacctttacggggcccgggttaccccgggttccccggggttccctaagggttacccggtaggttacggtagggttaccggagtaacgggtacccttaagtacctaaccgggttactaaccgtagtttaaacttttacgaacgtaaaggtaaactccggaggttacggggtacgggaacggtaacggaaggtaacggtaaggttaggttttaagggttagtttaagtttacgttacgtacgtacgttacggtacctaacccgtaacttaacgtaacgtacgttacgggacggttacgggtaccggaacgggaaccggtaacgggtaaacggtacgtacggtaaactacggtaaacgtaccggtaaggtcgggtactaccggctaaccgtacttacgttacttccgtaacttccgttaccgtcccgtaccg

SEQ ID NO: 99299 - DNA, 769 bp, Homo sapiens
  misc_feature: GYAE6OF01D71Z0.40.81.H04.1.454.CMB.1.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (334)..(334): a, c, t, g, unknown or other
  misc_feature (334)..(334): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccgaggtcgcagcgtggtgctagtcgtggggctggagtgagagcgtggcctggtgagtctcngacaagtnttctacggaaacctccgtagacgtaccaactaacgtacaacgtacacgtggtatacggcggacgacggcccgtaggacgttaggggttagnggttagggtaggtaggggtacgaccgtaccgtaaccccgtagacggtacgggtacgaacgtaacgtaaagttacgtacgacgtaacgtaaccgtttcggaacgggtcgtaacgggtactaaccgtagttacggacccggtacgggaccgttaccgtacccgtaagtacccgtaaggtaacccgtaactaccgggttaacctaacggaacgttaccgggtaaccgtttaccggttaggggaacccggtaaccggggtttaaccggaccgggttaaccccgtttaacggggaacccgtaaccgggttaacgtaaaccgggtccgtagtttaaccgggttactttacgggaccggtacggtaaggttaacgtcgggttaaggtcggtaaccggtaccggttcggtacccgttaaacgggtccggttaacgggtaccgg

SEQ ID NO: 99300 - DNA, 613 bp, Homo sapiens
  misc_feature: GYAE6OF01D5HAT.40.81.H04.1.454.CMB.1.raw
  modified_base (381)..(381): a, c, t, g, unknown or other
  misc_feature (381)..(381): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtggggcctggtgaacggtctcctgcaagtatttcgaggaaaccaccctgacgacctaactactacactacacgtggatggcggcgacggcccgtagggacgtaggggtttgagggtaggaggtggggtagactaccgaaccctacgaggaggtggacaagaaagtntacgacaagtacttcgacgggtacgacggtacacgagtacgaccggtgggaccgccgtccgaatcgacgacacgtagtactcagtggacttcgtaggacggtcggtacgtcgacccgtcgtacgaccgacgtaacggactagtattacgtagtcggtaaggtaggagttaacggttgggtccggacccgtacggggtcggtcgtaccggaccgtggggtccgggaacccggg

SEQ ID NO: 99301 - DNA, 801 bp, Homo sapiens
  misc_feature: GYAE6OF01DRJJ8.40.81.H04.1.454.CMB.1.raw
tcagtctagcgactcacgaccggtgctcgatttagtagtgtagattcgcgggggagcatcacccagcaaccacatctgtcctctagagaactcccctgagagctccgttcctcaccatggactggacctggaggatcctcttcttgggtggcagcacgccgcgaggacgcccactcccgaggtcgcagtcgtgggtgcgtaggtcgtggggctggagggtagaacggaacgccggtgggggtccgtcgggtaggtaacggtcctcgtagactaaggttctttacgtaacggaaaccctacccgtaggaacgtacctaaaccttaacctaacctaactacccgtacgttagggtacgtcggaccggaccgaccgggtccccggtagggtaacgggttagggggtttaggtagggttagggtacgggttcgggggtaacggtaacctaaccccgaaacccgtacggagggtacgggtaccgaactaaacggtaaaccgttacgtaaccggaacgtaaaccggttaacgttacgggaaccgggtcggtaacgggtacccaacgtacgtacggaccgggtacgggaccgtaccttaacgacgtaccggaacgtaccgtaacgtaccgttactaacggttagtacgtaacgttcggaaggtccggtaccgtaacgtccgtaaccgccggtacgaccgacgtacgtaccgttagtacgttagtcgtaggacggtaagtcggtacgggttggaccggaccggttaccggggacggcgtaccggtaccggtccggcgggggtaaacccg

SEQ ID NO: 99302 - DNA, 598 bp, Homo sapiens
  misc_feature: GYAE6OF01B1AUW.40.81.H04.1.454.CMB.1.raw
  modified_base (461)..(461): a, c, t, g, unknown or other
  misc_feature (461)..(461): n is a, c, g, or t
  modified_base (572)..(572): a, c, t, g, unknown or other
  misc_feature (572)..(572): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtgggcctcggtgaacggtctcctgcaagtatttctaggaaaccaccgtgacgcaactactacatacactggatgcggcacggcccctggacgtggggtttgaggtgggtagtgggggtggactaccgtaaccctaccgaggtacggtcgacaagaaagtacgtacgaactagtaacgtttcgagggtcagggccacgtagtcggtaccgtgggaccgtcgtccaagtccgagcactagtcctacngtgactcgtagacgcgtactacgcctcgtacgaaccgcgacgcagttcgttacgttacgtggtacgggaagtacggtacggttgggtacggtccggtaccgggaccgggtntaccgggacccgtgggtacccggggg

SEQ ID NO: 99303 - DNA, 820 bp, Homo sapiens
  misc_feature: GYAE6OF01B5S1D.40.81.H04.1.454.CMB.1.raw
  modified_base (744)..(744): a, c, t, g, unknown or other
  misc_feature (744)..(744): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcgttggtggcagcagccgcaggacgcccactcccgaggtcgcagcgtggtgccagtcgtggggcgtggaggaggaaagacggccggtggggccgttcggtaggaaggttcctccgtggacgaaggttactttacgtacggaaacctacccgtggaacaaccaaccttacaacaactaccacgtaggagtcggacggaccgcggccccgtagggtacggtaggggtttagaggtgggtagggtcgggggtaacgtaccgtaaccgtaaccccgtaaggtacggggtaacggttagggaacccgtaaaacggtaaaacggtaccggttaaaccggaaaccggttaaacggtttaaacccggtttacccgggaaaggggtaccgggtaaaccggggtacctaaacccgggtaagtttacccgggaacccggttaccgggggtaaccgtaccccgggtttaacccgaacggttaccggaacgaacccgtaacgtaccggtacgttaacgacggttacgtacgtacggtaggtaccgggtacggtaccgtacggtaaccggtcgtaccgaaccgtacggaccgtacgacgttggttaacgttacggnggttaacggaaacgtcggttacgggtggacgggtacgtaccggggcgtagtacggccgtaacggcgggtaacccgg

SEQ ID NO: 99304 - DNA, 726 bp, Homo sapiens
  misc_feature: GYAE6OF01BBS24.40.81.H04.1.454.CMB.1.raw
  modified_base (348)..(348): a, c, t, g, unknown or other
  misc_feature (348)..(348): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatccccctgagagctccgttcctcaccagtgactggacctggaggatcctcttcgttggtggcagcacggccgcaggacgtccccacctcccgaggtcgcagtccgtgggtcgcgtacggtcggttggggccgtaggacggtaggaacggacggtccggtaggggtcccgtggtaggtaacggttcctccgtggaacaaggtactttcgaacgggaaccncccgtaggacgactaactaccaactaacactacgtaggtagtcggccggccgaccggcccgtagggtaccggttaggggttacgacgggttagggaacggtggggttacgaaccgtaccgaaaccccgtacggaacgggtagggtcggaccgtaacggtaaatacggtaccgaagtaacggtaacgttacgggacggtacgacgggtacaaccgtgtaccgacggtacggaccgaccgtaccgataccgacgtaaccgaccgtacgttacgtacgtacgtgtactcgggtacgaccggtcggtccgtaaggtcccgtaacggacccgtaaccggtaccgaaccggtcgttaaggttacgttcggtaacggttacgggg

SEQ ID NO: 99305 - DNA, 716 bp, Homo sapiens
  misc_feature: GYAE6OF01EC1FQ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactcctccctgcccgtcacctccgtggagacgcccggccctccatcctcctgcaggtctagtcagacgccctacctaaacactaatgaactactacttctttagtaattcggtacctgacaagaacgccgagggcacgtcctaccacgtacgtcttcttagaattagttaggtttcgggttctttacggtccgggtcccggttccccggggttccctaggaccgttagggttcgaggtcggcgtaggtggactcgtagtcctaacgtagttaactttaacaacgttaagtaaaactcgaaggacgggtaaggggtacggaacgggacgaaggtaaggtagttagggtttagggtttattttagttacgtgtactaacgtacgtaaccctaaaccttacgtaaacgtaacggttgggtacggtaccgggtaccggggtaccgggtaaccgggtaaaaccggggtaacggtaaacggggtaaacggtaaacgtaaccggtaaaacgggtaccggtaaacggttgggtaacggtccgtcggtaaaccccg

SEQ ID NO: 99306 - DNA, 677 bp, Homo sapiens
  misc_feature: GYAE6OF01AXG5H.40.81.H04.1.454.CMB.1.raw
  modified_base (151)..(151): a, c, t, g, unknown or other
  misc_feature (151)..(151): n is a, c, g, or t
  modified_base (167)..(167): a, c, t, g, unknown or other
  misc_feature (167)..(167): n is a, c, g, or t
tcagtctagcgactcacgaccggtgctcgatttagtagtgtagattcgcgggggtggccctgagagcatcacccagcaaccacatctgtcctctagagaatcccctgagagctccgttcctcacatggactggacctggaggatcctcttnttggtgcagcagccgnaggacgccccacgtcccgaggtgccacgcgtggtgcgagtcgtggggctaggaggtgaaggagccgtggggacctcggtaggtaacggtctccgtgacgaagtacgtttacgtacggaaacctaccgtgaacgacacctaactacataactcgtagagtcgccggcgacggtcccgtcggtacggtaggggttagaggtcggtaggttggggtagtactaaccgtaaccctaccggaggtacggagtaccgaaacgtaaggtaacgacgacgaagtacgttacggacggtacgacgggtaccaaccgtagtccgggaaccgtacgggaccggtccgtacctacgtacgaacgtaccgtaacgacgttacgaacgtcgtagactacgtgtacgcgacgttcgacctggtaccgacgtacgtaccgacgtacgttaagtcgttaggaacggtttaggaacgtaggttaggttacccggtaggaacccggtccggggtaagggtccgtacggg

SEQ ID NO: 99307 - DNA, 797 bp, Homo sapiens
  misc_feature: GYAE6OF01C1RM0.40.81.H04.1.454.CMB.1.raw
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
tcagtctagcgactcacgaccggtgctcgatttagtagtgtagattcgcggggactgatcaggactcctcagttcaccttctcaacaatgaggctccctgctcagctccgtgggctgctaatgctcgtgggtctcgtggatccgaggtgggattagttgtagatgactcagtcctaccnctcctccncgccgtcacgtccgtaggagccgcccgtcctccacttcctcgtcgacgtaaggttcctagtacaaggtacctaccttaaaccgaaaactaacgttaaagtacggtaacttaaacgttaacgtttcgtttaacgtaaacgtttaccggtaaccgtaggactaagggaaaccgcgggtaaacggaccttaccggttaccacgtacggaacgttccttaagttagtaattaggtttacgggtttacgggtttaccttacgggcccggggttcccgtaccggggttacagggtaacgtttccggagttacgggtacgcggtagtacggactacgacggtaactagtagttaactttaagaacttaagtaacctggtaacgtggtaggggaagtacggaacgtaagggagtaagtttcgggttaagtttattaacgttaacgcgtaactacggtaacaccgtttaaacctacgttaaacgtacggtacggtaccggtaacgggtaccggtaaacggtaaaccgggttaaaggaaacccgggttaaggaaaccgtaaaagtacccgggtaaaaggtcccggttaagtaccgggttcggaaccctaggttaaacccc

SEQ ID NO: 99308 - DNA, 781 bp, Homo sapiens
  misc_feature: GYAE6OF01ACEQC.40.81.H04.1.454.CMB.1.raw
  modified_base (340)..(340): a, c, t, g, unknown or other
  misc_feature (340)..(340): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctctggatccgagtgggatattgtgatgactcagtcctccacgtcctccctacgcccgtacacctccgtggaagcgcccggcctccatcctctagcaggtctagtcaagtcgcctacctaaacacttaagtcggtactaccttacttctttaacgaagtttcggtaaccctgaccgaagtaaaccggccgtaaggggcctaacggtttccnccctaaacgtcgtacccttcttagaaagtttacgtttacgggtttacgggggttttacccttaaccgggttccgggggtcccccgttttacccccggggggtacttaccggtaaaccggttcgggttttaaccgaacggggtttgacccgtaacgggttaggtaaactccgtaaggtccaaccgtagttactttaaaccgtacgtaaagtaaacgtacgtaagtaccggtaaggggttacgaacgggtaccgtaaaggtaaggtaagtttacgggtttaagggttaactttaacgtttaacgtcggtaactacggttacgtaccttaaccgttacgtaacgtaaacgtcggttacgtacgggtaacgttccggaaccggtacggaaccgtaagggtacgaaaccgtacgaacggtcgaaacgtagtcgttacgacggtacc

SEQ ID NO: 99309 - DNA, 818 bp, Homo sapiens
  misc_feature: GYAE6OF01AUYCO.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctcgtgggtctcgtggatccgaggtggggtattagttggtgatgacctcgtagtcctcctactcctcccgtcgcccgtctacctcgtaggacgacgcccgtcctccactcctccgtgcgtagtctagtcagactacctacctaactactaagtagtacttactacttacgttagtacgttcgtacctgacgaagtacgccggaggtctacgtcctactacgtcgtacttacgtagtattagttaggttcggttactacgggtccgggtcccggtacccgggttccacggtacgtaggtcgtagggtcggtagtacgggtagtacgtacgtacgtaccgtaacgttaacgtttaacgtttaaccgaacgtaaacgttaaacgttcggtaacgggtagggttaacgggggtacggtaaacggtaacgggtaaggtaaagttttacgggtttcggggtttaaagttttacggttttactaaccggttgtaaccgttacggtaccgtaacccgtaaaccgtttaaccgtaaacgttacggttcggggttaacggaccggggttaaccgggtacccgggtaaaccgggaaaccgggttaaaccgggttaaagggggtaaccgttaaaaccggtaaccggtaaacggggttaaccccggttaagggttagggttaaccccggtcgtacccggttaaaccgg

SEQ ID NO: 99310 - DNA, 687 bp, Homo sapiens
  misc_feature: GYAE6OF01AVS9U.40.81.H04.1.454.CMB.1.raw
  modified_base (215)..(215): a, c, t, g, unknown or other
  misc_feature (215)..(215): n is a, c, g, or t
tcagtctagcgactcacgaccggtgctcgatttagtagtgtagattcgcggggatcaggactcctcagttcaccttctcacaatgaggctccctgctcagctcctggggctgctaatgctcgtgggtctctggatccgaggtgggatattgtgatgactcagtctccactcctccctcgcccgtcactccgtggagagcccgcctccatcctccngcaggtctagtcagacgcctacctaaacaactatggtactacctacttcttagtaagttcggtacctgacacgacgaccgaggctacgttcctaccgaactacgtcctttactacgtaattagtggtttacgggtttcttacggtccgggtcccggttcccggggtcctcgtaacgtaggtcgtagtcggacgtaggtacgtactacgactacgtaactagttactttaactacttaagtaaactcgaggacggaagggtagggaacgaggaacgtaaaggtagtttaggtttacggttaagttttaacttacggttcgtactaagttaccgtaacctaaccttaacgttaaacgtaaacgttcggtacggtaccggggaacggttaccggaaccgaaacgggtaacggtaaacgggtagtaaacgacgtaacggtaacgtacgtacgggtacgacgtcgaccgtacctacg

SEQ ID NO: 99311 - DNA, 888 bp, Homo sapiens
  misc_feature: GYAE6OF01AYVU6.40.81.H04.1.454.CMB.1.raw
  modified_base (168)..(168): a, c, t, g, unknown or other
  misc_feature (168)..(168): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgnaggacgcccactcccaggtgcagcgtggtgcagtcgtggggtctggtaggtaggaagaacggccggtcggggccgtcgggtaggtaaacgggttcctccgtggtacgaaaggttaacgttttacgtaacgggaaaacctacccgttaggaacgtaacctaaaccttaacctaaccgtaacttaacctaacgtcgggtaacgtcgggaccgggtaccggaaccgggtcccccggtaaggggtaaccgggttaaggggggtttggtaaagggtcggggttaaggggttcgggggggttaacggtaaccgttaaacccgtaaacccccgtttaaaccggggtaaaggggtaaccggggtaacgggtaaacccgtaaaaacgtaaaacggttaacccggtaaaccggtaaaccggtttaaacgggtttaaaaccggttttaccgggaaacgggggtacccgggttaaccgggttaacccgtaacccgtaacggtaccgggtaaccggggttaacggggacccgtaccgggttaccaaccgttacgaacgtacgtaaccgtacgtacgtaacgtagtagggtactcggtacggaccggtccgtaccgtccgtacgtaccggacgtacccggacgtactacgttagtaagttcgtaaggtcggaaaggttaccggtacggttacgggttgggacccgttacgggcccgggtggtacccgtacgggg

SEQ ID NO: 99312 - DNA, 525 bp, Homo sapiens
  misc_feature: GYAE6OF01A3U54.40.81.H04.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (290)..(290): a, c, t, g, unknown or other
  misc_feature (290)..(290): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagngccggcctccatctcctgctaggtctagtcagacgcctacctaaacnctaatgactactactctttgaattggtactgcagagccgaggcagtctcangctcttgatatagttgggtctagtcgggtaccctccggggtccctgacgtggttcagtggactagtggactcgagtcactagtactttacactagaattagagtgagggtgagacagagatgtaggtatttntacngtacngtacgtcaacctactaacgtacttagtggcggtacggtcggaccgaaggaaccgaggtgaaatcgaagacgacgttggcggatcgccaccgtag

SEQ ID NO: 99313 - DNA, 770 bp, Homo sapiens
  misc_feature: GYAE6OF01AH4C1.40.81.H04.1.454.CMB.1.raw
tcagtctagcgactcacgaccggtgctcgatttagtagtgtagattcgcggggacgtgatcaggactcctcagttcaccttctcacaatgaggctccctgctcagctcctggggctgctaatgctcgtgggtctcgtggactccgaggtggggattattgtgatgactctagtcctccactccttccctcgcccgtaccaccttccgtggacgacgcccggccctcctattccctcgtcgacgaggtcctagtcgagactccctacgtaaacactaagtggtaacttacctacttcgtttagaagtttacggtactagacaacggtaacgtccggacgggactacgtccctaccgaacgtacgtccttacgttagaactttaagtttcgggttttaggggtttaccttacgggtcccggggttacccggttcccggggttaccctaggaccggttacgggtttcagggtccggacgttaggtaggctacgtaacggccttaagacgtttattaccgaacgttagtaaacgtcgacggtagtacggggtaaggacgagtaaggacgttagttagggttaggttaactttagttaacgtgaacgtacgtacgtaaccttacccgttaagtaaccgtaacgttgggttaccgggttacgggaacccggtaacggtaaccccgggtaagggtaacccgtaaaggggttaacaaacggttacgaaaccggggttaactaaacgggttggaccggtttaaccgaccgggtaaaccc

SEQ ID NO: 99314 - DNA, 617 bp, Homo sapiens
  misc_feature: GYAE6OF01B6UZC.40.81.H04.1.454.CMB.1.raw
  modified_base (316)..(316): a, c, t, g, unknown or other
  misc_feature (316)..(316): n is a, c, g, or t
  modified_base (456)..(456): a, c, t, g, unknown or other
  misc_feature (456)..(456): n is a, c, g, or t
  modified_base (610)..(610): a, c, t, g, unknown or other
  misc_feature (610)..(610): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggagatcctcttcgttggtggcagcacgccgcgaggacgcccactcccaggtgcgacgcgtggcgcgaggtcgtggggctggaggtagaaggtaagccgtggggcctcggtagtaaggtcctccgtgacaagtatttcgaggtaaaccncccgtgagacaactactacgataccacgtaggagtgccgggcacgggccccgtaggtacgtagggggtttagagggttggaggtgggggtagacacgaaccctacgagtagggtacgaccgaataaaggtcaccggtaanaacgtacgtttacggaacgggtagacgggtacaaccgagtcgaaccggtcgggacgtaccgtacacgtccaccggactaccgaacgttacgacaggtacgtagttacgaggtacggcggcgtaggaccgtacggccgaacgacgtacgcagttncgtatcg

SEQ ID NO: 99315 - DNA, 768 bp, Homo sapiens
  misc_feature: GYAE6OF01DHCH3.40.81.H04.1.454.CMB.1.raw
  modified_base (192)..(192): a, c, t, g, unknown or other
  misc_feature (192)..(192): n is a, c, g, or t
  modified_base (336)..(336): a, c, t, g, unknown or other
  misc_feature (336)..(336): n is a, c, g, or t
tcagtctagcgactcacgaccggtgctcgatttagtagtgtagattcgcggggtgatcaggactcctcagttcaccttctcacaatgaggctccctgctcagctccgtgggctgctaatgctctgggtctctgatccagtggggatattgtgatgactcagtcctcctactctccctgcccgtcacgtccgnggagacgccgacctcatctctgcagtctatacagactccctactaaacactaagtacggattactacgttctttagtaactttcggtacctgtacaagaaccgccgagggtctaaggtcctccgacgacggtcctttacgttanaagtttacgttaggtttcgggtttaccttaggtcccggggtcccgtttccggggtaccttacgggaactacgggttctcggtacggtacgtaagtcgggtaactcgtaagttaccgaaccgttagttaacgttttaaccgtaacgttaaacggtaaactaacggtacggtaacggttaacgggtacgggtaacggtaaaccggtaaggtaaagtaacggtttaggtttaaggttaattttaacgttaccgttataccgtactaccggtactaaaccctacgttaacctaacgttcggttaacggtaccggtacccgggtaaccgggtaccggtaaacggggtaaccggtaagggttaacggaaaacgttaaccggtaacgaacccggttaaccggtaacggtttccggacgttaccggtcgttaaaccccgg

SEQ ID NO: 99316 - DNA, 856 bp, Homo sapiens
  misc_feature: GYAE6OF01ARRZ2.40.81.H04.1.454.CMB.1.raw
  modified_base (125)..(125): a, c, t, g, unknown or other
  misc_feature (125)..(125): n is a, c, g, or t
tcagtctagcgactcacgaccggtgctcgatttagtagtgtagattcgcgggggagagcatcacccagcaaccacatctgtcctctagagaactcccctgagagctccgttcctcaccatggacncggacctggaggatcctcttcgttggtgcagcagccgcgacgcgcccactcccgaaggtcgcgacgtcgtgggtcgacgtggttcggtggggcttgggaaggtaggaaaggtaaccggtccgggtcggggtaccggttacgggtacgggtaaacggttcctccgtggaactaaacgttacgtttaccgtaacggaaaacctacccgtacggaactaacctaaacctaactaacctactaacgacgtacggagtcggcggccgaccggtaccgtagggtacggtacggggtttaggacggtagggtaagggttcggggtaacgtacgtaacccgtaacccggtaacggaaagggtacgggacgtaaacgaaaccgtaaagttaaccggtaacgaacgttaacgttaaaccgttcggaaacgggtacggtaaacggtaccgaaccgttaaggtacccgtaccgggtacggccggttaacgtacccgacgtaccgaaccgtacgtaacgtaacgtacggacgttacggtaggttaaaccacggttacgggggaaccttaacccgggccttacccgtaccggtaccgtaaccggaaccgttaccggaaccgtaacgttagttacgttaacgttaagggtacggaacggtaaagggtcgttacgggttcgggaccccggttacggacccgggttacggtacgggtaacccggtaccggggtccgggttaacccggg

SEQ ID NO: 99317 - DNA, 847 bp, Homo sapiens
  misc_feature: GYAE6OF01C3KL8.40.81.H04.1.454.CMB.1.raw
  modified_base (224)..(224): a, c, t, g, unknown or other
  misc_feature (224)..(224): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactccgtggagacgcccggccctccactcctccgtgccgaggttctagtcagacnccctacctaaaacactaagtgactactacttctttagaattcggtacctgacaagaacgccgagggactacgttcctaccacgacgtcttacttagtaattagttaggtttcggggttactttacgggtcccggggtccccggttacccggggtccctaggtaccggtacggttacgagggtcggacgtagggtaggtactacgtacgtacgtaacgtaagtttaactttaacgtaaacgtaacgtaaaacgttacggacgggtacgggtaaggggtacgggaacggaacgtaagggtaaggtaggttttagggttaacgggttttaattttacgttacgtacgtaccgtaacgttaccggtaacccttaaacccttaaccgtaaaaccgttaagggtttccgggttaaggggttaaccggggtaacccgggggttaaccgggaacccgggtaaaacggggtaaacccgggtaagggttaaaccgggtaaaacgtaaccgggaaaccgggtaaccggttaaacgggttcgggtaccggacccgttaacggtacccgtaaacccgtcgtttaccggttaccgttttacccggttaacccttacccgtttccccgtaacccccgg

SEQ ID NO: 99318 - DNA, 670 bp, Homo sapiens
  misc_feature: GYAE6OF01AQOUZ.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggatctggaggatcctcttcttgggtggcagcagccgcaggacgcccactcccgagggtcgcagcgtggtgcagtcgtgggggctggagggtgaagacggccgtggggcctcggtggaggtcctccgtgacagtactttcgaggaaccaccctgacgacaactactacactacacgtggagtcgcggccgacgggccccgtgggtaaccggtagggggtttggaggtgggaggtgggggtagactacccaacccgtacgaggacgggtacgacgaacgtaacgtatacggaacgtaacggttaccttgggaacgggcgacgggtaccaaccgtagtacggacccggtggggaccgtccgtaccacgtccgacgacccacgtactacgtacgacgttgaacttccggtagggaccggtccgggtacttaccggaccgtaccggacgtaccggtacgtaccggtcgaacggttcgtagttaccggttaggacgggaaagtacggttacgggtacgggagttccgggccgggtcgggtaccg

SEQ ID NO: 99319 - DNA, 690 bp, Homo sapiens
  misc_feature: GYAE6OF01CTZYK.40.81.H04.1.454.CMB.1.raw
  modified_base (323)..(323): a, c, t, g, unknown or other
  misc_feature (323)..(323): n is a, c, g, or t
  modified_base (521)..(521): a, c, t, g, unknown or other
  misc_feature (521)..(521): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctaggaaacaccctgagcaactactacatacactggatgcggcaggcccctggacgaggggtttgagtggagtggggnggataccgaaccctacgaggaggtggaccaactaaaaggtactacgaacgaacggttaactttcgaaggggacctaaggggtaccaaccgtaagtacggaacccgtacgggggaaccgtccgtaccaagttaccgaacggaccacgacggttaccctaagtacgtagggacttccgtaggaaccgggcgggttaaacncggtaacccgacggttcgaaccggtaacaaccgggccctaaagttacggttacttaccggtaggtacgggtaaacggtgggtaaccgggttttggggaacggtcccggttaacccgggtcgggggacctttcgggaaacccccgtcgggttacggggggaacccccggg

SEQ ID NO: 99320 - DNA, 834 bp, Homo sapiens
  misc_feature: GYAE6OF01E1XR4.40.81.H04.1.454.CMB.1.raw
  modified_base (159)..(159): a, c, t, g, unknown or other
  misc_feature (159)..(159): n is a, c, g, or t
  modified_base (181)..(181): a, c, t, g, unknown or other
  misc_feature (181)..(181): n is a, c, g, or t
tcagtctagcgactcacgaccggtgctcgatttagtagtgtagattcgcgggggagcatcaccccagcaaccacatctgtcctctagagaatcccctgagagctccgttcctcaccatggactggacctggagatcctcttcttggtggcagcagccgnaggacgccccactcccaggtcncagctggtcgctaggtcgtgggggtcctaggagggtagaaaggaaggccccggttgggggtcccgttacggggttacgaaggttccctcccgtggacctaaaggtacttttccgtacggaaacctacccgtgacgacctaaaccttactaacactacacgtggtaagtggccggtaccgaaccggtccccgtgggaaccggttaggggttagcgggttaggtacggttagggggtcgaactcccaaacccgtacgaggtacggtacgaccaaacgtaaagtacgtacggaacgaaacgttaccgttacggaacggggaccgtagggtacctaaccgtaggttaccgaaccgggtacgggaccgtaccgtaccgactacgtaacggtcctaaccgtaccgttacgaacgtacgtacgggtaccgttagtaaccgggacggttaaccggcgttaacccggtacgttaacggacgggttaacccgaacgggttacccgacccgtaaggtttccggttaaacttcccggggtaaggtttaacggtaaaccgggtaaggtttaccggggttccgggtacgtaacccccgggggttacggtacccgggttacggtacccggtacccggaaaccggggtttccccgggggaaacccgggg

SEQ ID NO: 99321 - DNA, 837 bp, Homo sapiens
  misc_feature: GYAE6OF01BZNHT.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttgggtggcagcagccgcgaggacgccccacctcccgagggtcgcgacgtcgtgggtcgcgtaggttcgtgggggctaggagggtaggaaaggaacggccggtgggggccgtcgggtaggtaacgggtccttccgtggactaagttacgttttcgtaacggaaacctacccgtaggaacgtacctaaactaacctaactaactactacgtggacgtcggccggaccgccggtccccgtagggtacgggttaggggtttggagggttagggtagggttcggggtacgtacttaaccgaaccgtacggaggtacggtacggacaaagtaaagtacgtacgaacgtaacgttaacgttacgggaacgggtaccggtacgggtaccaaccggtacgtaccggtaccgggtaccgggtaaccggccctacgtaaccgtacgaaccgaacctacgttaacggtacccgttaagtaccggttaggtacttcgggtaaccgggaaggcccgggttaaccgttaccggtacccggtacgtacccgggaaaccggaccgacccggtacgttacgttacggttaacgtttaacggtggggtaaaacgacgggttaacggggtttaccgggttaggtcccgggttaaccgggtacccggggcgggggttaacccacgggtcccggggtaaccggggtacccgggg

SEQ ID NO: 99322 - DNA, 759 bp, Homo sapiens
  misc_feature: GYAE6OF01C0LC1.40.81.H04.1.454.CMB.1.raw
  modified_base (193)..(193): a, c, t, g, unknown or other
  misc_feature (193)..(193): n is a, c, g, or t
  modified_base (742)..(742): a, c, t, g, unknown or other
  misc_feature (742)..(742): n is a, c, g, or t
tcagtctagcgactcacgaccggtgctcgatttagtagtgtagattcgcgggggagagcatcacccagcaaccacatctgtacctctagagaactcccctgagagctccgttcctcaccatggactggacctggaggatcctcttcttggtggcagcagccgcaggacgcccactcccgaggtgcagctggtncagtcgtgggctggaggtgaagacgtccgtggggcctcggtaagaacggttctaccgagtctaaggtacttttcgacggaaacctaccctaggacgtactaaacgtactaacacgtaacacgtaggatacggccggtacgaccggtccccgtaggaaccggtaggggttttaggaggttagggtaagggttagggggtacgtaaccgttacccgaaacccgttaccgaaggtacgggtacggaccgaaacgtaaaacgtacgttaaccgaacgtaacgtaaccgtttcgggaacggtacgtaacgggtacctacgaacgttacgacccgggttaacgggaccgtacccgggtacctagttaccgaacgtaccgaacgtacggttaccgtaacgtaggttggtaacctcggttaacggacgggaaccggtaccgttaacgggtacccttaggtaccggaaccaacggttaccggactaacgtacgttatacgtcggtaagaacggtacggtaacggtcggtaaccgacgttaccgggacggtcgttaacnccgtaacggtaccgggg

SEQ ID NO: 99323 - DNA, 700 bp, Homo sapiens
  misc_feature: GYAE6OF01D8IIP.40.81.H04.1.454.CMB.1.raw
  modified_base (494)..(494): a, c, t, g, unknown or other
  misc_feature (494)..(494): n is a, c, g, or t
  modified_base (636)..(636): a, c, t, g, unknown or other
  misc_feature (636)..(636): n is a, c, g, or t
tcagtctagcgactcacgaccggtgctcgatttagtagtgtagattcgcggggactgatcaggactcctcagttcaccttctcacaatgaggctccctgctcagctccgtggggctgctaatgtctcgtgggtctcgtggactccgaggtgggattagtgtgatcggactctacgtcctacctacctcctcccgtcggccctcctaccgtccgtagggacgaccggcccggtcctcacgttcctcgtacgcgtacggtctaggtcaacggactaccgtaactaaactacgtagtagtacttactacttagttacgtaagtttccgactgacgtaaggaccgacggcggtacacgtccaactgaactcgttatagtacttaagtcggtttacggtcgtacggtccggtcccggtcggtcctacggacgttggtacgcgggtcgagtaggtacggtatcggtactacgaattacgttacttaagacgtaaagtacnggtaaacgtgggagggtaacgaggtaactaaggtagttaggttaggtaagttacgttacgtagtcgaactagtaccgtaaccttaactagtaacccgtaggttacggtagggtaccggtcggtaacggaacgggtaaaacgnggggttaaataaccgggtaactacgggtaaccgtacgttacggagggtcctacgtaacgtaccg

SEQ ID NO: 99324 - DNA, 698 bp, Homo sapiens
  misc_feature: GYAE6OF01B5C7G.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggaccgtggaggatcctcttcgttggtggcagcagccgcgaggacgcccactcccaggtgcagcgtggtgcagtcgtggggctgaggtagaagaagcgtgggccgtggtgaaggtctccgtgacgtaagtagtttcgtaacggaaacctcccgtagacgtaccaaaccttaacctacaattaccaagttggagtacgggccggacgtaccggtccccgtaggtaacggttagggggtttagagggtagggtaagggtcggggttagactaacccgtaacccgtaacgtacggagggtacggacgaaacgtaaacgtagtaaccgacgtaacgttaacgtttcgggaggtacgacggttacacgagtacggaccgttagggccgtacctactacgtacgaacgactaacgacgttccaacgtgaggtacttcgacggtaggacccggtagtccgtacgttacgacgacgtacgacggtcaggttacagttagtcggaagaaggttggtaacgggtcgacgggttacccggtccgggtacgggtaccctacgggtaccggtcgggtaacccggggg

SEQ ID NO: 99325 - DNA, 952 bp, Homo sapiens
  misc_feature: GYAE6OF01EG84V.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctctgggtctctggatcaggtggggatattgtgatcgactcattcctccactcctccctcgcccgtcacctccgtggagaccgcccggtccctaccctacttccctccgtcgtacgtacggttacgtagtaccgaacggtaccgtaccccttaaaccttaaaaaccaacttaaacgttacggtaaccttaaccctttaccgtttacttttagttaaacggtttcggttaaacccgtcggaaccgaaaggtaacggacccgggaagggggtacctaccggttaccctacccgtaacgacgttccctttacgtttagtaacgtttaaggtttacggttttcggggtttactttaccgggtaccccgggggttccccggtacccccggggttaccgtaggtaaccggttacggtttacgtacgggtacggtacgtagggttacggtactacgtaaccggttactaacgttaactttaacgttttaaccaaacgttaacgtaaacgttaccggtaagggtacggggtaaggggttacgggaacgggtaacgaaaggggtaaacggtttagggttttaggggttttaaccgggttttaagtttttaaccgttaacggtttaggtaaacccgttaacggtaacccgggtaaaccccttaaacccgtttaaaccgttaaacttaacggggttttgggtacgggtaaaccggggtaccccgggtaaccgggtaaacccgggtaaacggggtaaccgtagggtttaaccgggaaaacggtaaacgtaaacgggtaccggtaaagttaacccgggttaggttacccggtagtaacccgg

SEQ ID NO: 99326 - DNA, 725 bp, Homo sapiens
  misc_feature: GYAE6OF01D29M5.40.81.H04.1.454.CMB.1.raw
tcagtctagcgactcacgaccggtgctcgatttagtagtgtagattcgcggggagcatcacccagcaaccacatctgtcctctagagaatcccctgagagctccgttcctcaccatggactggacctggaggatcctcttcgttggtggcagcagccgcgaggacgcccactcccaggtgcagctggtgcagtcgtggggctgaggtgaagaacgccgtggggcctcggtagaacggtctccgtgactaagtattacgtacggaaacctacccgtagaacgtaccaaacgtactaacaactaccacgtggacgtcggccggaccgaccggtccccgtaggaacggttggggttagacggtggtagggtggggtagtacgtaccgaaaccctacggaggtacggtacgaacaaacgtaaagtacgtacgtaacgtaacgtaacgtttcggaagggacgtacggtaaccgacgaagtccggtaaccgggtacggaccggtacgtaccctaagtccgaacggactaaccgtacgtaccgtaacacggtacgtaacgttcgaaggtaccggtacggtaaccgtaccggtacccgtaacgtaccggaaccgtaacgaccgtacaaggttacttagtacggaggtaacggtaaggtaaggtccggttggtaccgggtaaccgtaccggggtcggacctaccggaaccggtcgggaccggggtaaaccccgg

SEQ ID NO: 99327 - DNA, 677 bp, Homo sapiens
  misc_feature: GYAE6OF01DFK6O.40.81.H04.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
  modified_base (661)..(661): a, c, t, g, unknown or other
  misc_feature (661)..(661): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctcctgcccgtcactcctggagagccggcctcatctcctgctaggtctagtcagagtcctaccaaaanacttaagaggtaatacttaccttcgtttagaactttggtacctgacaagaacgacccgaagggactacgtactccgaanacgctcttagtattaaattggttaggggtttcccttaagtccggggtaccgtttcccgggggtaccctaggaaccgtaggttactaggttcggactaggttgggaactccgtaaggtcctaacgtaagttaacttttaaccgtaacttaagaaaaactcgaacgggtacgaagggttaggaggacgtaaaggaaagtacgttggtttacgggtaattttaattactagtactaacgttacgaactaaccttacttaacccgtaaagttcggtaaggtgggacgtacgggaccgtaaaacgggactaaagggtaggtaaaacgtagaaacgtacgtaaacgtnttacgggcgtgaaacc

SEQ ID NO: 99328 - DNA, 555 bp, Homo sapiens
  misc_feature: GYAE6OF01E0KJO.40.81.H04.1.454.CMB.1.raw
  modified_base (549)..(549): a, c, t, g, unknown or other
  misc_feature (549)..(549): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtggggcctcggtgaaggtctccgtgacaagtatttcgtaggaaaccaccctgacgacaactactacatacacgtggatcgcggcacggcccctggacgtaggggtttgaggtggagtggggtgtactccgaacccgtacgaggacggtcggacaacgaaagtgacgactaacgtaacgttcgagggacgagggtcaccagtacgaccgtgggaccgcgtacagtacacgccacgacgtctacagtgactcgtagacggcggtcgtagaccgtacggcgaacgacgacgcagtcgtntgtagg

SEQ ID NO: 99329 - DNA, 760 bp, Homo sapiens
  misc_feature: GYAE6OF01EPEOC.40.81.H04.1.454.CMB.1.raw
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgctagtcggtgggctggaggtagaagacgtcggtcgggcctcggagacggtctcgngacgagtatttcgacgaaccncctagacgactaactacgtactatacctacgtaggtagtcggaccggccggaccggtccccggtggggtaaccgggttagggggttttacgggagggttaggggaggggtttagggggtacgttaaccgtaaccccgtaaacccccgtaaccggtaagggtacggggtaccggaacgtaaaacggtaaaggttaccgtaacggaacgtaacggtttaaaccgtttacgggaacgggtaccggtaacgggtaccaccgtaagtaccggtaccggtacgggaccggtacccgtacgtacgtacgaacggacctacgtaccgttactacgtacgtacggtactcggtgacgggtaccgtacgtaccgacgttacgacgaaccgacgtaccggactcggttaacgttagtacgtagggtaggtaagtacggttcgggtacgggtaccggtacccggtacggggtccggtaccgtaccggtaccggcggggtaacccggg

SEQ ID NO: 99330 - DNA, 869 bp, Homo sapiens
  misc_feature: GYAE6OF01CHNXT.40.81.H04.1.454.CMB.1.raw
tcagtctagcgactcacgaccggtgctcgatttagtagtgtagattcgcgggcgtagactttgtgtttctcgtagtctccctgctcagctccgtggggctgctaatgctcgtggtctctggactccgaggtggggatattgtgatgactcacgtcctccactcctccctcgcccgtcacctccgtgggacgacggcccgcctccacttcctccgtgacgtacggttacgtagtacgaacggacctaccccttaaacctaaaactaacgttaaagttcggtaacttaaccttaccgtttcgttttaaggtaaacgtttccggtacctggacgaaggaaacggtccggacggggtacctacggttaccctacccgaactcggtcctttacggtttagtaagtttacggtttacgggttttaggggttttacccttaacgggttccccggggttccccgggtttaccccgggggttccctaaacgggtttaccggtaagggtttccggaggttacgggtcgtaaggggtacgttaactacgtacgtactaaacgtaacgtttaactttaaccgaaacgttaaagaaacgttacgacgggtacgggtacgggggaggtacggaacgtaaagggtaaggttaggtttaagggtttaagggttacttttaaccggttaacgcggttacacgttacgtaaccgttaaccttaacgtaaccgttaacggttagggtacgggtacgggtaaccgggttacgaaccgggtaacggaaccggtaagggaacgttaacgaacgtacggtaacgacggtcgtacgaccggttacaaccgtacgtcgttacgttaccttacttacctccgtttaccgtacccg

SEQ ID NO: 99331 - DNA, 744 bp, Homo sapiens
  misc_feature: GYAE6OF01B0K7N.40.81.H04.1.454.CMB.1.raw
  modified_base (621)..(621): a, c, t, g, unknown or other
  misc_feature (621)..(621): n is a, c, g, or t
  modified_base (680)..(680): a, c, t, g, unknown or other
  misc_feature (680)..(680): n is a, c, g, or t
  modified_base (718)..(718): a, c, t, g, unknown or other
  misc_feature (718)..(718): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtgcagcagccgcaggacgcccactcccaggtgcagcgtggtgcagtcgtggggctggaggtgaagagccgtggggcctcggtgaacggtctcgtgcaagtactttcgtaggaaaccacccgtagacgactaactaacctacactaacacgtggagtcggccggccgaccgggtcccccgtaggggaaccggttagggggttttacgggtaagggttaggggtaaggttcggggggttacggtaacgttacccgtaaaaccccgttaccggaagggtacggggtacggacgtaaaaccggtaaaacggttacgttaaccggtaacgtaacggttaaaccgttttacggaacggggtacgtacggggtacctaaccggtacgttaccgggacccggttacgggaccggtacccggtaccctaaacgtccgaaggtaccctaacgtaccgggtactaacgacgttaggacttacgngacggtcgggacctggacctacggtacgaccggtacgacgtaccagtcttaacgttcgnggtagtaagtgggttcggttacggcggtacggtccggngggactccgaacggtcggtaccgggg

SEQ ID NO: 99332 - DNA, 550 bp, Homo sapiens
  misc_feature: GYAE6OF01A49IM.40.81.H04.1.454.CMB.1.raw
  modified_base (356)..(356): a, c, t, g, unknown or other
  misc_feature (356)..(356): n is a, c, g, or t
  modified_base (487)..(487): a, c, t, g, unknown or other
  misc_feature (487)..(487): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagattctggaaacaccctgagcaactactacatacactggatgcggcacggcccctggacgtaggggtttcgagtgggagtggggtggactcaaccctacagaggtggcacaaagtancgacagtaactttcgagggcagggtcaccgatcgaccgtgggaccgcgtaccatcgagcacacgtactacgagtggatcgtagacggcggtactcgaccgtctacgaccgacgacgaccatgtacttacgnggtaggagacggtacggttggtcggacgtaccggcgggtactagaccgtggcggggtacccgg

SEQ ID NO: 99333 - DNA, 713 bp, Homo sapiens
  misc_feature: GYAE6OF01DMVOP.40.81.H04.1.454.CMB.1.raw
tcagtctagcgactcacgaccggtgctcgatttagtagtgtagattcgcggggatcaggactcctcagttcaccttctcacaatgaggctccctgctcagctccgtggggctgctaatgctctgggtctctggatccagtggggatattgtgatgactcagtctccactctccctgcccgtcacttctggagcgccggcctccatctcctgcaggtctagtcagacgtcctacctaaacacttaagtggtatactactactttagtaacgtttggtacctaggacagaacgccgtagggcacgttcaccacacggtcttcgttagtacttagttaggtttggggtttaccttacggttcccgggtccccgttccgggggttaccctagggtaaccgtacgggtttcgaacgggtttcggaccgttagggtacgtacgttaccgacggttaacctacgtaaggttttaactttttaaccgaaccgttaaaggtaaaactttacggtaacgggtaacggtagggggtacggaacgggacgtaagggaagggtttaacggttagggtttaacgttttaacgttttaagttaccgttgactaacgtacggtacccttaacgtactaacgttaacgtagttgacgggtacggtcgacggaacgggtaacgaaggtacgtaatacggaacgtacggaacttcggacgcacgctcgtacg

SEQ ID NO: 99334 - DNA, 674 bp, Homo sapiens
  misc_feature: GYAE6OF01DNZ2P.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgcccggcctccattcctcctgcaggtctagtcagacgcctacctaaacactaatggtactactacttctttagaatttcggacctagacaggacgccgagggcagtcctccacagtcttcttagtattagttagttcggggttacttagccgggtccgttcccgggtccctaggactagggttcaggtggtcgaggtgtactcgaagtacacgtaagttactttaactaagtaagtaaactacgtaggtacggtgggtaggacgggtacgaaaggtaagtagttagggtttaggttaacgttttacttacgtagtacgtaacgtacggtaccctaaccgttaaccttaaacctagttcggttaacgggttacggggtaccgggtaccgggaaccgggaaaacggggtaaccgaaaggggtaacgaaacggttaacgaaacggtaacgtaaacggtaggtcggtccgtaggtaacccg

SEQ ID NO: 99335 - DNA, 692 bp, Homo sapiens
  misc_feature: GYAE6OF01CMC6M.40.81.H04.1.454.CMB.1.raw
  modified_base (179)..(179): a, c, t, g, unknown or other
  misc_feature (179)..(179): n is a, c, g, or t
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccgaggtncagctggtgcagtcgtgggctggaggtnaagacgccgtggggcctggtagaacggttctccgtgacaagtntttcgtaggaaaccaccctagacgcaactactacatacacgtgatgcgcncggccctaggacgtgggtttgagtggagtgggngactaccaaccctacgagaggtgacagaaagtcgtacgaacagtaacttggaggcgagggtccacgtagtacggtaccgtagggaacccgtcgtaccacgtaccgacgtaccgacgtacgtaccgtaactacggtaggacctttacgacggaccggtacggtaaccgtccgtacccgttaccgtaccggaacccgttaaccgaaccgggtacttaacgttacgtaacgttaccggtaggtaagggtaaccggttaaggtacccgggtttaagggttacccggaccggtttaacccggggaccggggttaaccctaccgggtaaacccccgtggggttaaaccccggggtaacccccggg

SEQ ID NO: 99336 - DNA, 746 bp, Homo sapiens
  misc_feature: GYAE6OF01ENDDS.40.81.H04.1.454.CMB.1.raw
  modified_base (167)..(167): a, c, t, g, unknown or other
  misc_feature (167)..(167): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (697)..(697): a, c, t, g, unknown or other
  misc_feature (697)..(697): n is a, c, g, or t
tcagtctagcgactcacgaccggtgctcgatttagtagtgtagattcgcgggggagcatcacccagcaaccacatctgtcctctagagaactcccctgagagctccgttcctcaccatggactggacctgggagatcctcttcttggtggcagcacgccgcaggacncccactcccgaggtcgcagcttggtcgctacgtcggtggggctaggaggtagaaagtacggccgtcggggtcctaggtagacggttcnccgtgactaagtcttcgacgaaccnccgtagacactaactactacaacgtacacgtaggactcggacggtccgaccggtacccggtaggtacggttaggggtttacagggtcgggtagggtacggggtacgaactaacccgaaaccgtacgaggacggtagaaccaaaggtaagtacgtacgaaacgtacggtttaacctcgggaaggtaccggtaacggtaccaacgtaacgtaccgggaacccgggtacgggtaccgtacccggttacgtaaccgacgtaaccgacggtaaaccgttgttaaacccgttaacggagtttaaccgggtatttacccgggaacggaccggttaaccgggttagttaaccgtacccggtaaggttaccgaaacgttaccggacggtacttaaggacgtttagtacgtaggaacgtagtacggnggttcggagtaccggacgggtcgtactaccggagtcgggcggtaaccgg

SEQ ID NO: 99337 - DNA, 719 bp, Homo sapiens
  misc_feature: GYAE6OF01C8Q3T.40.81.H04.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
tcagtctagcgactcacgaccggtgctcgatttagtagtgtagattcgcgggcacgaccggtgctcgatttagtagtgtagattcgcggggagagcatcacccagcaacccacatctgtcctctagagaatcccctgagagctccgttcctcaccatggactggacctggagatcctcttcttggtggcagcagccgnaggacgccccactcccaggtgcagtcgtggtgcgtagtcgtggggctggaggtgaaggagccggtcggggcctggtagtacggtctcgngacaagtntttcgtacggaaaccnccgtggacacctaaactactanactactacgtagtagtcgccggcacggtcccgtggtacggtagggttcgaggtggtaggtggggtacgacgtaccgaaccccgttacggagggtacgggtacggaaccgtaaacgtaaacggtacgtaacggaacgtaacggttaaccggttacggaacggggtacgacggggttaccaacccgttaggtacgtacccgggtacggggtaccccggtaccggtacctaaccggtaccgaaccggtaccgtaccgtaaaccgttccgttaaacggtcggtaacggtaccgttcgtaggaaccgggtccggtaaccgtacgttacccggtccggtaccgggacccgacgtaacccggacgttacgttaaagttcggttataacggggg

SEQ ID NO: 99338 - DNA, 638 bp, Homo sapiens
  misc_feature: GYAE6OF01DBD5I.40.81.H04.1.454.CMB.1.raw
  modified_base (386)..(386): a, c, t, g, unknown or other
  misc_feature (386)..(386): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtgggcctcggtgaaggtctccgtgacagtatttctaggaaaccacccgtgacgacaaacttactacacttacacgtggatggcggcacggcccgtggacgtaggggtttgaggtggagtggggtgactaccgaaccgtacgaggacggtgacaacgaaagtanacgacaagtaacgtttcgacgggcgaggtcaccgagtacgaccgtcgggacgtccgttaccacgttcgacgaccgacgtacgtactaacgagttacggtacgttcgacggacggtaccggtacgttacggaccttacggtaccgaacgtaaccgacggaccttagtacggtttaacttacggttacggtaagggaacgtacggtacggttacgggtacgggtacccggtacgggccggggtcgtaacccggg

SEQ ID NO: 99339 - DNA, 793 bp, Homo sapiens
  misc_feature: GYAE6OF01AYTZL.40.81.H04.1.454.CMB.1.raw
  modified_base (332)..(332): a, c, t, g, unknown or other
  misc_feature (332)..(332): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctcgtgggtctctggtatccgaggtggggattagttgtgatgactcagtcctcctactcctccctcgcccgtcacctcgtaggagacgcccggtccctacctacttcctccgtgaccgtacggttactacgtacgacggtacacccctaacctaaaactacttaaagtacggtaacttaaccttacttcgtttagtaacttccggtaccnggaacaagaccggcgtacgggctacgtcctaccactacggtcttacttacggaatttaggtttacgggttttacgggtttaccgtaaccggttccccggggtcccgggttcccggggttacccgtcggtaaccggttacggtttacggagggttacggtacgtagggtacgtaacgtacgtaccggtactaacggtaactttaaccgtttaaacgaaccgtaaagtaaacgtacggaacgggtacgggtacggggtaagggaacggtaacggtaaaggtaacggttagggttttaaggttacgggtttaactttacggttacgtacgtacgtacgtacctaaccgtaacttaaccgtaacgttacggtggtacgggccggtaccggtaccggaaccggtaacggaacgggtaaggtaagaacccgtagaacggtacgtaggtacgtcggtcgtcgaacccg

SEQ ID NO: 99340 - DNA, 729 bp, Homo sapiens
  misc_feature: GYAE6OF01BXDLP.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagcttccgttcctcaccatggactggacctggaggatcctcttcttggtggcagcaggccgcgaggacgcccacctccccgaggtcgcgagtcgtgggtcgcgagtcgtggggctggtagggtagaaaggtaacggcccggtcgggggccgttacggggtaggtaacgggttctccgtaggaccgtaaagtacgtttacgtacggtaaaacctacccttggaacgacctaaactactaactaactaacctacgtaggacgtacggccggacgacggtccccgtggtaccggtaggggttgaggtaggtaggtggggtagtacgtaccgaaccgtacgaggtaggacgactaacgaagtacgacgactaaggtaacgttacggacggtacgtacggacaccgtagtacgtaccggtacgggacgtcgtacgtacgtcgaacgacgaaccgtagtaccgtacgagtacggtatacgtagggaccggtacggtacgtcgtaccgtacgtaccggtaaccgaccggtaccgtaccgttagttacgtagttacggaggtacgggtaaaggtacggtaacgggttcggtaccgggtaaccgtcccggggtacgggtaccggtaccgg

SEQ ID NO: 99341 - DNA, 595 bp, Homo sapiens
  misc_feature: GYAE6OF01BO6H3.40.81.H04.1.454.CMB.1.raw
  modified_base (202)..(202): a, c, t, g, unknown or other
  misc_feature (202)..(202): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcnggggctgaggtgaagaagccgtggggcctcggtgaaggtctccgtgcaagtatttctaggaaacaccctgacgcaactactacatacactggactggcggcacggcccgtggactaggggtttgagtcggagtggggtgatacaacccgtacgaggaggtggacgacgaaagtatacgaacagtaactttacgagggcgacgggtcaccgagtcgaccgtgggacgcgtaccactcgagccaacgtactactaactacgttgggaacttcgtaggacggaccgggtacgtcggaccctacggtaccggaaccgacgaccgaccggtattcgtaacgttacgtagagggaacgtacgtacggttacggcgtaccggtacgggcgggtctaccgg

SEQ ID NO: 99342 - DNA, 693 bp, Homo sapiens
  misc_feature: GYAE6OF01CJBB4.40.81.H04.1.454.CMB.1.raw
  modified_base (189)..(189): a, c, t, g, unknown or other
  misc_feature (189)..(189): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtncagtcgtggggctgaggtagaagacgccgtggggcctcggtgaaggtctccgtgacaagtatttcgacggaaacctacccgagacgaccaacttactacatactacgtggatcggccgacgccggcccgtggacggttagggggtttgagggtgggaggtggggtgtactaccgaacccgtacggaggaggtacgacaaacgtaagtacgacgaactacgtaacgtttcggacgggtcgtacgggtaccaacgtagtccggtaaccggtacggggaccgtccgttaccgacgtaccgacgacctaacggtaccgttacgtacgtacggtacggtacttacggtacgggtaacggtccggtacgtcggtaacccgtcggtaccgaacggaaccggtacgtaaccgtacgttagtacgttaggttcggaagggtacgtagggttcggttacgggtcggtaccggtaccgggtcgggtacctaccggaccggttcgggtacccgggg

SEQ ID NO: 99343 - DNA, 762 bp, Homo sapiens
  misc_feature: GYAE6OF01AOG0A.40.81.H04.1.454.CMB.1.raw
  modified_base (180)..(180): a, c, t, g, unknown or other
  misc_feature (180)..(180): n is a, c, g, or t
tcagtctagcgactcacgaccggtgctcgatttagtagtgtagattcgcggggatcaggactcctcagttcaccttctcacaatgaggctccctgctcagctcctggggctgctaatgctctggtctctggatccagtggggatattgtgatgactcagtctccactctccctgcccgtnactccgtggagacgccggcctccattcctcctgctaggtctagtcagacgcctacctaaacactaagtggactactacttctttagactttcggtacctgacagaacgccaggggctacgtcctacccacgagtccttcgttgattagttagtttggggtttacttacggtccgggtcccgttccggggtccctaggtaccgtagggttcgaggttacggctaacggttgacgtcgaacggttcaacgtagttaactttacgaacgtaataaactcgaggtacgtacggggtaggacggacgaaggtaacgttaggttaggtttaggttaacttttacgttacgtacgtaacgttaacgtacggtaacccttaaccgttaaccgtaaacgttaaacgtttacggttaccgggtaacgggtaacccggggttacccgggaaacccggtaaaacgggggtaaacccgggtaaaacggggttaaacgggtaaaacggttaacccgggtaaacgggtaaccgggtaaacggttcgggttaccgggtaccggttaacccggtaacccgttaacccggtttaaccggg

SEQ ID NO: 99344 - DNA, 828 bp, Homo sapiens
  misc_feature: GYAE6OF01CUAI6.40.81.H04.1.454.CMB.1.raw
  modified_base (357)..(357): a, c, t, g, unknown or other
  misc_feature (357)..(357): n is a, c, g, or t
  modified_base (462)..(462): a, c, t, g, unknown or other
  misc_feature (462)..(462): n is a, c, g, or t
tcagtctagcgactcacgaccggtgctcgatttagtagtgtagattcgcggggactgatcaggactcctcagttcaccttctcacaatgaggctccctgctcagctccgtgggctgctaatcgctcgtgggtctcgtggactccgaggtgggatatgtagatgactcattctccacttcctcccgtgccctcaccgtccgtaggacgaccgcccggtcctaccatcctcctgacgaggtcgtagtacaacgaacgtaccctaactaaaacacttaagcgtaattactacgttactttaggaacttcggtacctgaacgaaggaacgccgtaaggctaacgtccaccgacagtacctnttaaggacttaggtttcgttacggggttacttaacggcccggggtcccgttaccgggtacctaggtacgtaacgggtctaggtcgggactagggtacgttaacgngtaaccgtacgtaacgtaacgtttaacgttttaacaagttaaacgaaaataccgggtacgtaaacgggaacgggggttagaacgggtaaggaaagggttaaaggacgttttaggggtttaaggtttaaccgttttaaacgttaaacggcggttaactaaggtaccccgttaaacgttaaaaccccgttacttaaaaccgtaacgggttacgggttcggggtaaaccggggtacccggggttaaacccggaaaaccgggttaaaaccgggggaacggttaaaacgggggtaaaacggttaaaccgaaccggtaaaacgggtaacccgtaaacgggtttggacccggggttacctcccgggtaaaccc

SEQ ID NO: 99345 - DNA, 714 bp, Homo sapiens
  misc_feature: GYAE6OF01AFB9I.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgccctcactcctggagacgcccggcctccatcctcctgcaggtctagtcagcaccctacctaaacactaatgatactacttcttagaattcggtacctgacaaggaacgccgtagggctacgttcctaccgaactacgtccttactttaggtaattagttaaggttttcgggggtttactttacgggtcccggggtcccggttccccgggggttccctaggtacgttacgggttacgagggttcggacgtagggtacggtaactccgtaagtaccgtaacttaggttaactttttaaccaacgttaaacgtaaaacgtcgaacgggacgggtaagggggtaacgggacggtaacggaaggtaaggttaggttaggggtttaggttaacttttagtacgtgtactacgtcgaacctaaccgtataacgtaacgtggtacggaggtaccgggacgaaccggaaggtacgtaagggacgtaaatacggaagtaccgtagtcggtgtaacgtcaccgtactacgttcgttacgttacctactcccgttcgtacccg

SEQ ID NO: 99346 - DNA, 681 bp, Homo sapiens
  misc_feature: GYAE6OF01AR57D.40.81.H04.1.454.CMB.1.raw
  modified_base (277)..(277): a, c, t, g, unknown or other
  misc_feature (277)..(277): n is a, c, g, or t
  modified_base (520)..(520): a, c, t, g, unknown or other
  misc_feature (520)..(520): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccaggtggggatattgtgatcgactcagtctccactcctccctgcccgtcactcctggagacgcccggcctccatcctcctgcgtaggtctagtcagacgccctactaaacactaatgactactactcttgaacttggtaccngacagtaacgccgtaaggggctacgtcctaccactacgcttacttaggtaattacgttaggtttcggggttacttacggtccggggtaccccgttcccgggggtccctaggtaaccgtaggtttacgaggttcggacgtaggtcggaatcgactcaacgtattacttaacgactaagaaacgtcaggtacggaagggtgaacgtagaagtaacggtagttcgggttaggtactttaagttcgngtactagtacgaccttaacctacttaaacgtaacgttggtacggtaccgggtacggttaccggaaaccggtaaacggggaacggtaacggtaaccggtaaacgtcgtaaaccggaccggtacggttaggtaccggacttaccgacccgtacgtttaacccg

SEQ ID NO: 99347 - DNA, 631 bp, Homo sapiens
  misc_feature: GYAE6OF01ATT0I.40.81.H04.1.454.CMB.1.raw
  modified_base (615)..(615): a, c, t, g, unknown or other
  misc_feature (615)..(615): n is a, c, g, or t
  modified_base (621)..(621): a, c, t, g, unknown or other
  misc_feature (621)..(621): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagagtccgtggggcctggtagaaggtcctaccgtgacaagtatttcgaggaaaccacccgtagacgacaactactacatacacgtggatcggcggtcgacggcccgtaggacggttaggggtttagagggtggtagtcggggtagactaccgtaaacccgtacggaacggtaggtacggactaaacgtaaagtacgtaaccgacgtaacgtaacgtttacggacgggtacgtacgggtaccaccgtacgtacgtaccggtcgggaccgtccgtaccgagtaccgacgtacgtaactacgtacgtaacgtacgtacggactacgtacggtacgggtccggacgttcgacgtcgtacgacgacgacgcagtgtatacgagtagagacgtggttcgcgtcgacgcggacnggaccnggtcggaccg

SEQ ID NO: 99348 - DNA, 662 bp, Homo sapiens
  misc_feature: GYAE6OF01ESM0L.40.81.H04.1.454.CMB.1.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
tcagtctagcgactcacgaccggtgctcgatttagtagtgtagattcgcgggcgtagactttgtgtttctcgtagtctccctgctcagctccgtggggctgctaatgctcgtggtctctggatccaggtggggatagttgtgatgactcgatctccactctccctgccctcactccgaggagacgccgcctcatcctcagcgagtctagcagcacctacaaacactagngtactactcttagtgtagttcgtacctganaacgacgaccggngtactactccaccgatacgtcttactagtattagttaggtttacgggttaccgttcggccgggtccggtaccggtcctaggccgtagggtcctaggcgtagaggttacgatactcgagtactagtaacttagtaaactagtaaactcgtaggacggaggtacggtaggaagtaaggtacgttaggttaacggtaggttaaacttttacgagttacgaccgtagtaacctacccgtaacgttaacctaaacgagttccgggttaggacccgggtacggggtaacccgaacgggtaaaccgggaagtaaacgggtaagtaacgtaccgagtaaccgtaggcgtacgcacggaccctaagtccgtacttcgtacctactaccgtccctaaccg

SEQ ID NO: 99349 - DNA, 722 bp, Homo sapiens
  misc_feature: GYAE6OF01B8G5E.40.81.H04.1.454.CMB.1.raw
  modified_base (184)..(184): a, c, t, g, unknown or other
  misc_feature (184)..(184): n is a, c, g, or t
  modified_base (642)..(642): a, c, t, g, unknown or other
  misc_feature (642)..(642): n is a, c, g, or t
tcagtctagcgactcacgaccggtgctcgatttagtagtgtagattcgcgggggtgccctgagagcatcacccagcaaccacatctgtcctctagagaactcccctgagagcctcccgttcctcaccagtggactcggaccgtggaggacttcctcttcttggtggcagcacgccgcgaggacncccacctccgaggtcgcgagcgtggtgcgagtcgtggggctggaggtagaacggaacggtccggtcggggtccgtgggtacggaacggttcctccgtgacgtaagttactttacgaacggaacccacccgtagacgacctaaccgtactacactacacggtggtactcggccggacggacccggtcccgtagggtaacgggttaggggttcggagggttagggtagggttacgggtcggaaccgtaacccgaaccgtaacggagggtacggtacgaacgtaaacgtaaacgtacgtacgaacgtaacggttaccgtacggaacgggtactaacgggtccaaccggtacgtacgggaccggtacgggcgccaccgtaacgcgaacgtacaccgtacgttcaacggttagcgtactggacgacggtccgattacgtaactggaacaccggtagtaccgtntaaacgtagttacggtacgttagggaacgtagcgggtttacggacgttccggggacgtacccgggttgggaccgacccgg

SEQ ID NO: 99350 - DNA, 724 bp, Homo sapiens
  misc_feature: GYAE6OF01ERBM8.40.81.H04.1.454.CMB.1.raw
  modified_base (265)..(265): a, c, t, g, unknown or other
  misc_feature (265)..(265): n is a, c, g, or t
  modified_base (443)..(443): a, c, t, g, unknown or other
  misc_feature (443)..(443): n is a, c, g, or t
  modified_base (619)..(619): a, c, t, g, unknown or other
  misc_feature (619)..(619): n is a, c, g, or t
  modified_base (715)..(715): a, c, t, g, unknown or other
  misc_feature (715)..(715): n is a, c, g, or t
tcagtctagcgactcacgaccggtgctcgatttagtagtgtagattcgcgggcacgaccggtgctcgatttagtagtgtagattcgcgggggagagcatccacccagcaaccacatctgtcctctagagaactcccctgagacgtccttcccgtttcctcaaccagtcgggacgtcgggaccgtggacggtacttcccttcgtttcgttggggtcggcacggccacggccggcgaacgggacgccccgtacctcccgaggggtcncgaacggtccgttaggtactacggtcggtgggggcgtaggtaacggaggaaacggacggcccgggtggggtccgttacggggtaggtaaccggttcctccgaggaacgtaagttacgttttacggaaccgggtaaaccaccggttacgaacgtacctaaacgtacctacgaactacgnggtaggtgtcggcggacgtacccggtccgtaggtacggtaggggttgacggtgggtaggtgggacgtacaccgaacgtcgagggtcgtacggactaacgtaagtactagaactacgtacgttacggacggtacgtaacggaccacgtacgacgacggtcgggaccttccgacgacncgaaccgtctaacgtacgtcaaggtcgtacgtagcggtagcggtacgtactcggtactacggaccgacggtacgacgtactagttactacggtggngtaaacggg

SEQ ID NO: 99351 - DNA, 936 bp, Homo sapiens
  misc_feature: GYAE6OF01B5TYE.40.81.H04.1.454.CMB.1.raw
  modified_base (180)..(180): a, c, t, g, unknown or other
  misc_feature (180)..(180): n is a, c, g, or t
tcagtctagcgactcacgaccggtgctcgatttagtagtgtagattcgcgggcgtagactttgtgtttctcgtagtctccctgctcagctccgtggggctgctaatgctcgtgggtctctggatccaggtgggatattgtgatgactcagtctccactctccctgcccgtctacctccgnggagcgcccggtcctccattcctccgtggccgggtctagtacagaccgtccctaacctaaacacgttaagtggtaactaaccttcgttacgtttagtaacgttcggtaaccctgacaacggaaccgccggagggtcctacgtccaccgtagagtacttcgttaagtactttaagtttcggtttacggggtttccttaacgggtccggggtacccggtttcccggggtaccctaggtaacgttcggggttacacgggtcggaccgtaggtaggtacctacgacggtacctaacggtttaatttaacctttaaccgagttaaaacgtaaagtccgaacggtacggggtaagggggtaccgagggtaaagaaaggttaacggttcgggttttaaggggtttaaagtttaacgtttaccgttacgggtactaaccggtaacgttacccgaaaccccgtttaacctttaaaccgtaaacggtttaacgggttcgggggttaacggggtaaccggggttaacccccggggtaaaccgggggtaaacccgggttaaaaccgggggtaaaaccggtaaacggggggtaaacctttaaaaacgggaaaaccccgggtaacgggttacccggtaaagttaccgggggttaaccgtcgggtaaacccctaacgggttaaccccgttttaaagttccccccgggttttttactcccccgtttaaacccgttcccgttttaaccccccgggtaccccggtttaaaaccg

SEQ ID NO: 99352 - DNA, 757 bp, Homo sapiens
  misc_feature: GYAE6OF01EGGTT.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcagtctccactcctccctcgcccgtcactccgtggagacgccggcctccactcctcctgctaggtctagtcagacgtcctacctaaacactaagtcggattactacttcgtttagtagttcggtacctgacgagacgcggaggcacgtccaccacgtacgtccgttattagaactttagttacggttttcggggtttactttaccgggtcccggggttcccgggttaccccgggggttccctaggtaccggttacgggttacgtaacgggttcgggacgtagggtacggtactaccgtaacggtacctaagtaacgtttaacttttaaccgaagttaaacggtaaacgtacgtaacgggacgggaagggggttacgggaaccgggtaagtaaacgggtaaggttaggtttagggttacggtttaaattttacgtacgtagactacgtacgtaccttaacttacgtaacgtaacgttcgggtaggtaccgggtaaccgggtaccggaaaccgggtaacgggtaaacggtaagggtaaacgtaaacgtaccggtaaacggaccggttaacggttacggtacggtccgtgtaaccccg

SEQ ID NO: 99353 - DNA, 783 bp, Homo sapiens
  misc_feature: GYAE6OF01CFRDT.40.81.H04.1.454.CMB.1.raw
  modified_base (191)..(191): a, c, t, g, unknown or other
  misc_feature (191)..(191): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggactccttcttcttgggtggcagcacgccgcagggacgccccactccccgagggtcncgagtcgtgggtcgcaggtcgtggggctgggaggtagaaagacggccggtcgggggtcctggtgtaaggtcctcgtagcgtaagtntttcgacggaaaaccncccgtagaacgactaaacctactaacaactacctacggtggtacgtcggccggccgaccgggcccccgtagggaaccgggttaggggtttggacgggttgggtagggtggggtacgaacgttaccgaacccgttacggaggtacgggtcgaacgaaacgtaaacgttacgaccggtaaacgtaacggttaaccgtttacggaacggggtacgtaacgggttaccgaaccgtagtacgggtaaccggtcgggacgtacccggtaccacgtaccgaagtacctaacgacgttaccgtagacgtacgggtacttacggtacgaacgggtccgggtaacctaccggacccgttcgtaacgggaacccgtacgtacccggtactacggttatttaccgtagttagggaacgggttattaacgggggtcgttacgggttcgggtaccgttacccggggacgtacggttcccgaaacggggtcgggtaacccggggg

SEQ ID NO: 99354 - DNA, 660 bp, Homo sapiens
  misc_feature: GYAE6OF01EAXOV.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactctttgaattggtacctgcagaacgccgagggcagtctccacagcctcttgatattagtttgggttacttacgtccggggcccgttccggggtccctggtacgtaggttcagggtggcgtaggttggtactacgtacgtcaacgtaggttaactttttaaccgaacgttaaggtaaaaacttcgaacggtcggttagggggtaggaacgggacgtaaaggaaggtaacgtttgggtttagggttaattttaacgttacgtgtactagtcgtaacccgtaaccttacgtaaccaacgtttgtacgggtacgggtaccgggtacgggacccggtaaacggggaaccgtaaggggtacgaaaacgtacgaaacggtaccgtaacgttggtacggtcgtggtaacccg

SEQ ID NO: 99355 - DNA, 809 bp, Homo sapiens
  misc_feature: GYAE6OF01A3RSU.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggacggtgaaggaagccgtggggtcctcgggtgaacggtctccgtgactaagtatttcgaggaaaccctaccgtaggtacacctaaaccttaacctacaacttaaccgtacgtggtactcggaccggaccgaccgggtccccgtaggacggttagggggtttagaagggttagggtaacggtcgggggttagaacgtaccgaaccccgtaacggaggtaacgggtcggaactaacgtaaacggttacgtaccggtaactaaggttaaccgtttcgggaaacgggtcggtaaacggggtaccaccgagtacggtacccggttaggggaaccgtccgtaacctacgtacggaaccgacgaaccggttaacgtccgttaaaccacggtttacgggtacttaccgggttaaggaccggtaccgggtaaccgttaccgggtacccgtttaacggaccggtaacccgaacggtaaccggtaccgtagttacgttacgttaagtaccggggtaaacggaagggtaaccgttacgggtttcggggaccgttacccggttacccggggcccggggttacgaacccggtaccgggtaacgggttcccgggaaccccggg

SEQ ID NO: 99356 - DNA, 722 bp, Homo sapiens
  misc_feature: GYAE6OF01BHQMI.40.81.H04.1.454.CMB.1.raw
  modified_base (160)..(160): a, c, t, g, unknown or other
  misc_feature (160)..(160): n is a, c, g, or t
tcagtctagcgactcacgaccggtgctcgatttagtagtgtagattcgcggggactggatcaggactcctcagttcaccttctcacaatgaggctccctgctcagctcctgggctgctaatgctcgtgggtctctggatcagtgggatatgtgatgactnagtctccatctccctgcccgtcacgtctggagacgccggcctccgatcctcctgcaggtcctaggtcaggacgcctacctaaacactaatcggaatactactcttgaattggtacctgcagaacgccgagggctagtctaccacagcttacgtttagacgttaagttgtttcgggggtttcttaacgtccggggtacccgttacccgggggtaccctcgggtaaccgttaggggttaccgtaagggttccgggactaacgggtttagggaaccttcggaagttacccgaacgtagttaactttttaccaacgttaacgtaaaaacgtccgtaagtaccggtaggggtacgggagaccgtaaagggtaacgtaagttacgggttaagggtaacttttacgttaacgtcgtaccgtaagtcgtaaacctaacccgttacttaaacgtaaacgtcgggttacggtaccggggtacggtacccggaacccggtaacggggtaacgttaaggggtacgtaaacgttaccgaaagtacccgtaaggcgttcgggaccttcggaacccg

SEQ ID NO: 99357 - DNA, 608 bp, Homo sapiens
  misc_feature: GYAE6OF01A7MLT.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatcctcctgcaggtctagtcagagtccctacctaaacactaatggatacttacttctttgaatttggtacctgcagaacgccgagggcagtcctccacagcttcttgattattagttggggtttcttagtccgggcccgttccggggtccctgacgtaggttcaggtggctaggtgatcagtcacagttatttacacgtagaaactcagcgagggtggaggacgaggtaagtagttaggttagggttattttagttacgtgactatacgacctaacctactaactaacgttggtacggtacgggtaccggtacggaccggaaacgggaaccgtaaagggttaggaaacgtcggaaacggtaccgtaaacggttcggtacgggtaccgtcgacccgtacgttaccg

SEQ ID NO: 99358 - DNA, 765 bp, Homo sapiens
  misc_feature: GYAE6OF01AN115.40.81.H04.1.454.CMB.1.raw
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (756)..(756): a, c, t, g, unknown or other
  misc_feature (756)..(756): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctcgtggatccaggtggggatagttgtgatgactcagtcctccactcctccctgccccgtcactccgtaggacggacgcccggccctccacttcctccgtgctagggtctagcagcgcctacctaaacgntaatgactactacttnttagacttcgacctgcaagacnccggnggctacgtcctacgactacgtcttcgttagattacttacggttttgggttaccttaggtcccggggtacccgttcccggggtaccctagtaccgtaggttccgaggtcggactaggttcgacgttcctaacgttcccaacttacggtttaatttaacccggataaacgggtaaacttcccggaagggtacggtaggggggttaacggaccgtaagggtaaagggtaaacgtttcggtttaaggggtttaacgggttttaacttttaacgttccggtagtaaccgttaacgttcccgggaaaccctttaacccgtactaaacccggttaggttcggtcggggtaccgggttacccgggtacccggaaaccggtaacgggggttaaccggttaaggaaaccgggttaacacccggtaaaggtaccccgttaagggttccgtacgggaccccgttntaaccccgg

SEQ ID NO: 99359 - DNA, 770 bp, Homo sapiens
  misc_feature: GYAE6OF01CXPD8.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctctgggtctctggatccaggtgggattattgtgatgactcagtcctccactctccctcgcccgtcacctccgtggacgacggcccggtccctccacgttcctcccgtgcgtacggtctacgtcagaccgtccccttaaccgtaaaactaccttaagtcggtaaacttaccttacttcgttttagaacgttttcggtacctgcgaacgacgccgagggtactacgttccaccgacgtacgtccttagttagtattaacggtttggtttacggggtttaccttacgggtcccgggtccccggttccccggggttcccttagggtaaccgttacgggttacgtacgggtcggtacgtagggttacgacttccgtaaccgtacgtaaacgtacgttttaactttaaccgaagttaaacgaaacgttccggagggtaaccggggttaaggggacgggtaacgaacgtaacggtaaagtcggttttacggttaaggtttaacttttacgtacgtactaacgactacccgtaacgttacctacgttaacgtaggttcggtacggtaacgggtaccggtacggtaacggaaaccgggtaactaaaggggttccaaaagtacacgggtaacgttcgtggacgtcgtacggtaccc

SEQ ID NO: 99360 - DNA, 605 bp, Homo sapiens
  misc_feature: GYAE6OF01EG9MU.40.81.H04.1.454.CMB.1.raw
  modified_base (168)..(168): a, c, t, g, unknown or other
  misc_feature (168)..(168): n is a, c, g, or t
  modified_base (590)..(590): a, c, t, g, unknown or other
  misc_feature (590)..(590): n is a, c, g, or t
  modified_base (592)..(605): a, c, t, g, unknown or other
  misc_feature (592)..(605): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgnaggacgcccactcccaggtgcagctggtgcagtcgtggggctgaggtgaaggaacgccggtcggggtcctcgggtagaacggtctcctgactaagtatttcgacggaaaccaccgtagacgaccaacgtactaacactacacgtggatggcgcgccggcccgtagggacgtagggtttgaggtggaggtgggtagactaccgtaaccgtacgagggtacggtacgacgtaacgtaaagtacgtacgaacgtaagttaacgtttacggaacggggtcgaacgggttaccaccgtaagtcggtaaccggttacgggaccgtaccgtacaacgtaccgacgaccgtactacgtactaagacgttaggtacgtcgagggttaccggagggtccggacggtaacggacggcgacggtagtagcgagngnnnnnnnnnnnnnn

SEQ ID NO: 99361 - DNA, 744 bp, Homo sapiens
  misc_feature: GYAE6OF01ANMPZ.40.81.H04.1.454.CMB.1.raw
tcagtctagcgactcacgaccggtgctcgatttagtagtgtagattcgcgggcgtagactttgtgtttctcgtagtctccctgctcagctccgtggggctgctaatgctctgggtctctggatccagtgggggatattgtgatgactcagtcctccactctccctgcccgtcactcctggagagcccggcctccatcctcctgcgaggtctagtacagacgccctactaaacactaagtggtactacttacttctttagaatttcgggtacctgacaagaacgccgaggggcctaggttcctaccacgacgtcttacgtttagtattagttagttttcggggtttacctttacggtcccgggtcccggttcccggggtacccgtggtaccgtaggttcgtacgggtggtaccgaggtacggacgtacgtagtccgaacgttacgttactttttacaaaccgttaagtaaaactacgtaggacgggtaaggggttagggaacggtaacgaagggtaaggtagttaggggtttacggtaattttaacgttacgtcggtactacgtacgtaaccgtaacccgtactaacgtaaacggttcggtagggttaccgggtaccgggttaccgggaaaccggtaacgggtaaccggtaacgggtaagtaaccggtacggaaacgttacgaacgtcggttacgggcttacgacctacgtacttacgttacgttctacttccgtcccttacccg

SEQ ID NO: 99362 - DNA, 630 bp, Homo sapiens
  misc_feature: GYAE6OF01AWZZP.40.81.H04.1.454.CMB.1.raw
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtgcagcagccgcaggagcccactcccaggtgccagctggtgcagtcgtggggctggaggtagaagacgccgtggggcctggtgaacgtcctccgtgacaagtacttcgaggaaaccncctgagacaactactacatacncgtgntgcgacgacggccctaggacggtaggggtttgaggtggaggtggggtagactacccgaacccgtacgagggtaggtacgacaacgtaagtacgtacgaacgtaacgttaacgttcggacgggtacgtacgggtaccaaccgtagtacggaccggtacgggacgtcccgtacgactaccgtacgacctaacgtcgttaactacggtagtaggacttcggaggacggtaccgggtacgtaccgggtaccgtcggtaccggaacgacggtaccgtacctaagttacgtttacgtcggtaacggg

SEQ ID NO: 99363 - DNA, 712 bp, Homo sapiens
  misc_feature: GYAE6OF01BERMH.40.81.H04.1.454.CMB.1.raw
  modified_base (124)..(124): a, c, t, g, unknown or other
  misc_feature (124)..(124): n is a, c, g, or t
  modified_base (183)..(183): a, c, t, g, unknown or other
  misc_feature (183)..(183): n is a, c, g, or t
  modified_base (315)..(315): a, c, t, g, unknown or other
  misc_feature (315)..(315): n is a, c, g, or t
tcagtctagcgactcacgaccggtgctcgatttagtagtgtagattcgcgggggtgccctgagagcatcacccagcaaccacatctgtcctctaagagaactcccctgagagtcctccgttccncaccagtggactggacctggaggatccctcttcgttggtggcagcgagccgcgagggcncccactcccgaggtgcgagtccgtggtacgcgacgtcggtggggctaggaggtagaaggtacgtccggtaggggcccgttgggaggtacggttctccggtagacgtaacgttactttacgaacggtaaaccnccgtagtacgactaactacactatacacgtagacgtcggaccgacgaccggtccgtagggtacggttaggggttaggagggtaggaggttcggggtaagaccgttaaccgaacgtaccggagggtacggtacgacgaaagtaagtaccgaacgtacgtaaaggaccttacgggacgggacgtacgggttaccacgtacggtacggtaacgggacggtaccgtaccgttaacgagtaccgactacgtaaccgtacgtacgtacgaagtgtacgttacgcggtaaccggcgtacgtacgtaacctcgacggtacacccgggaacacgtagtacgttagtaccgtaggtaccgaaggtaggtcggttacggacgaaccggggccgtagggtccgtacggg

SEQ ID NO: 99364 - DNA, 928 bp, Homo sapiens
  misc_feature: GYAE6OF01EJYPD.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggcctgctaatgctcttgggtctctggatccgaggtggggattattgtgatcgactcgacgtctccactcctcccgtcgcccgtccactcgtcggacgccgcccggtcctcctattcctcctgcgacggttacctacgtacgacggacgtccccttaacctaaacgtacgtaagtcggtaacttaacttacttccgtttgtaaacgtttcggtaccgtagaccgtaaggaaccgcgtacgggtacctacgtcctaccgacgtacgtacgtttacttacggtacttagtttacggtttacggggtttcctttaccgggtccggggtacccgttcccggggtaccctacggtaccggtacgggtttacgacgggttacgggtacctacgggtacgtaaccggtaccggttaacggtaacccgttaaccgttaaacggttttaaccgttttaaaccgaaaccgtttaaacggtaaaaccggttacgaaacgggtaacccggggtttagggggtaaaccggggtaaccggtaacccggtaaagggttaaaccggttacgggttttaccggggtttaaacgggtttttaaaccgttttcgtttaaaccggtccggttaacgtaccgggtttaccgtaaaccccgtttaaccccgttaacgttaaacccggttaaggttaccgggttacgggttaaaccgggtaccggggtaacccggtaaacccggggtaacgtaacccgggttaaaggtaacccggttaaaacggtaccgtaaacggtacccggtaaggttaccggacggtaaacccggttcgtaacccgg

SEQ ID NO: 99365 - DNA, 841 bp, Homo sapiens
  misc_feature: GYAE6OF01EYNPQ.40.81.H04.1.454.CMB.1.raw
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
tcagtctagcgactcacgaccggtgctcgatttagtagtgtagattcgcgggggagagcatcacccagcaaaccacatctgtcctctagagaatccccctgagagctccgttcctcaccatggactggacctggaggatcctcttcttggtggcagcagccgcaggagcccactcccgaggtgcagcctggtgcagtcgtggggctggaggtgaagaacgccgtggggcctcgggngacggtctcctgacgaagttactttcgacggaaacccncccgtaggtaacgctaaacgttaacctactaacgtaacctacgtggttaaaccgtcggaccggaccaggggtcccccgttacgggggtaaccggtaacgggggggtttttacggggtaacgggttacggggggttaacgggttacggggggttacgggtaaccggttaaccccggtaaacccccgttaacccggtaacggggtaacggggttacgggtaaccgtaaacggtaaaacgggtaacgtaaccggtaacgtaacggtaaaccgtttaccggaacggggtaccggtacgggtaccgtaacccgtaacggttaccggtaccggttacggggaccggtaccggtacccgtacgtaccgaacgtaccgtacgtacgtaccgtaacgtacgtacggtacgttacgtacgacggtaccggtaacgtaccgtaccgtacggtacggtaccgaccgtaccggtacgtaccgttacgtacgttacggttaggtaacgggtaacggtacggttacggttacgggtacgggtaccgggtacccgggtccggggtccgggtaccggtacccgg

SEQ ID NO: 99366 - DNA, 695 bp, Homo sapiens
  misc_feature: GYAE6OF01DO575.40.81.H04.1.454.CMB.1.raw
  modified_base (191)..(191): a, c, t, g, unknown or other
  misc_feature (191)..(191): n is a, c, g, or t
  modified_base (379)..(379): a, c, t, g, unknown or other
  misc_feature (379)..(379): n is a, c, g, or t
  modified_base (605)..(605): a, c, t, g, unknown or other
  misc_feature (605)..(605): n is a, c, g, or t
  modified_base (646)..(646): a, c, t, g, unknown or other
  misc_feature (646)..(646): n is a, c, g, or t
tcagtctagcgactcacgaccggtgctcgatttagtagtgtagattcgcgggggagagcatcacccagcaaccacatctgtcctctagagaatccccctgagagctccgttcctcaccatggactggacctggaggatcctcttcttggtggcagcagccgcaggacgcccactcccaggtgcagctggtncaggtcgtggggctggaggtgaagaacgccgtcgggggccttagggtaggaacggttcctccgtagtaccgaaagtacttttacgaggaaaaccctcccgtaggaaccgtactaactaacttacaagtaccacgtggtatcggccggacgaaccggccccgttagggtaacggtaggggttttacggnggttacggtaggtagggggtcgaaccgttacccaaccccgtaacggaggtaagggtacggaaccaaacgtaaaaggtactaccggaaactaagtaaccggtttacgacgggaacgtagggacctaacgaccggttacgacccggtaggaccgttaccggtcagtacacggacccaggtactacgtacaggttacgagttccgtaaggcggaacgactacggacctnacggaactagaccgtaccgaattgtactagtacgaggaagnggtaacgttggtaccgcggttccgagggctaacggccgtaggtaccggg

SEQ ID NO: 99367 - DNA, 969 bp, Homo sapiens
  misc_feature: GYAE6OF01CHVO3.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtgggatattgtgatgactcagtctccactctccctgcccgtcactccgtggagacgccggcctccactcctcctgcaggtctagtccagacgtaccctacctaaaacactaatggtactaacctacttctttagaacttggtacctgcgaagaacggccgaacgggctacggtacctacccacgtacgtcttcgtttacgtatttacgttacggttttacgggggtttccttttaacgggttcccggggtccccggtttcccgggggttacccctcggtacccggtaggtttccgtacgggtttacggggcctaagggttcggtaacgtccgaacgttaccgtaactaacggttaacgttttaacccaaagtttaacgtaaaaacgttcgaacgggtacggtaacgggggttacgggaacgggtaaccggtaaaggtaaacgggttaaggtttaaggggtttaaggggtttaaacgtttttaacggtttaaccgttaacggttaaccggttacggttaaccgttaacccggtttaaaaccctttaacccggtttaaaacccgtaaaaccggtttcggggtttaacgggggttaaccgggggtttaaaccccgggggttaacccggggaaaccccggggttaaaaaccggggggtaaaccccgggttaaacgggggttaaaaccggtaaaacgttaaaccgggtaaaaccgggtaaacccggttaaaccggttacggggttacccgggaaccgggtttccggtaaacccgtaaacccgttacggtttccgtttaaccggtttaacccggtttaccgttaacccggttaccccgtttaacccccg

SEQ ID NO: 99368 - DNA, 947 bp, Homo sapiens
  misc_feature: GYAE6OF01CI4V3.40.81.H04.1.454.CMB.1.raw
  modified_base (158)..(158): a, c, t, g, unknown or other
  misc_feature (158)..(158): n is a, c, g, or t
tcagtctagcgactcacgaccggtgctcgatttagtagtgtagattcgcggggactgatcaggactcctcagttcaccttctcacaatgaggctccctgctcagctctgggactgctaatgctcgtgggtctcgtggatccgaggtggggatagttgngatgactcacgtcctaccacttcctcccgttggccccgtcactccggtagggaacggaccgcccggtcctaccgacgttcctccgtggacgtacggttactacggtcaacggtaccgtccttaaaccctaactaacgttaacgttacggtaaccttaccgttaccttcgttttaacggtaacgttttacggtaaccccgtggaaccgtaacggaacggtaccggtacggggtactacggtttaccccgtacccgaactacgggttaccctttagtttacgggtaactttaacggtttacgggttttacggggtttacgttaccgggtcccggggtaccccggtttaccggggtacccttggtaaccggttacgggtttacgtaggggttacggtacggtacggttacggtaccgttccgtagttaaccgaacgtttacggtttaactttaaacggaacgttaaacggtaagttaccggtacggttacggggttacggggtaacggacgggaagttaagggaacggttaggtttacggggtttaacggttagttttaaccgtacgttacggtaactacgggttaaccctaacccttaaacgttaaccgttaacgtttaccgggttaggttaacggggttcccgggggtaaccgggtaaccggggtaaacggggtaaaaccccggggtaaggttaaaccgggggtaaaccggttaaacggtaacggtaaacggggttaaccggttaaccggttcggggttaaaacccggtcggtaacccgtttaacccggg

SEQ ID NO: 99369 - DNA, 649 bp, Homo sapiens
  misc_feature: GYAE6OF01EHMN8.40.81.H04.1.454.CMB.1.raw
  modified_base (160)..(160): a, c, t, g, unknown or other
  misc_feature (160)..(160): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctctttcttggtggcagcagccgnaggagcccactcccagggtgcagcttggtgcagtcgtggggctggaggtgaagaacgccgtggggcctagggtagaaggttcctacctgacaagtattttacgtaggaaaacaccctggagaccaacctaactacactacactggatgacggccgacggccccgtggacgtaggggttagaggtggagtggggtggactcaaccgacgagaggtgacaacgaaagtacgtacgacaacgtaactttacgagggcgaagggtacaccgagtcgaccgttagggaccgtaccgtaccgacgtacgagcgtaacctacgtaccgtaacgacgtacggtaattccgtaggacggaccgggtacgtaggtaacccgtaccggtaacggaccgtaacgtaccggaactagtactagttaccgtaacggacggtaaggtacgaccgttggaccgggttacacggtacgggctaggaccgtaacggtcgggaaaccg

SEQ ID NO: 99370 - DNA, 768 bp, Homo sapiens
  misc_feature: GYAE6OF01BKBRO.40.81.H04.1.454.CMB.1.raw
  modified_base (180)..(180): a, c, t, g, unknown or other
  misc_feature (180)..(180): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggactcgaggtgggattattggtgatgactcacgtctccactcctacccncgtccctacacgttccgtggacgacgcccggtccctccattcctccgtgacgtcggtactaggtaccgagaccgtccctaacctaaacacgtaagtcgtaacttactactttcttagtaagtttccggtactagacgaacgacgccggtagggcctacgtcctaccgaacgtacgttcccgttaagtttaggtaattttaacggttttcggggttttacgggtttaacccgttccccgggttcccgggggttttcccccgggacccggggtttccctagggttaaccgtgggtttaacggccgggttagacggttaaggtccggtatacgtacgactaacgtttaaagtttactttaacgaacttaacgaaagttcggaacggtttagggacgggtacggaacgtaacgaaggtaaggttcggttaggtttacggttaatttcgttaagctaacggtctaacgttaccctactaacgtaacttacggtcggtacggtacgggtacggtaccgaacgggaaaccgggtacggtaaaggtacgaacgagaacccggtgtacggtacggcctacgtcgacccgttgtaccg

SEQ ID NO: 99371 - DNA, 712 bp, Homo sapiens
  misc_feature: GYAE6OF01BEANH.40.81.H04.1.454.CMB.1.raw
  modified_base (123)..(123): a, c, t, g, unknown or other
  misc_feature (123)..(123): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctntgggtctctggatccaggtggggatattgtgatgactcagtctccactctccctcgcccgtcactccgtggagacggcccggcctccatcctcctgcgaggtctaggtcagcgccctacctaaacactaagtcggtacttactacttctttagaatttcggtacctgcaaggaacgccgaagggtcacgtcctaccagcgtctcgtacgtagttacgttaggtttcggggtttactacggttcccgggtcccgttcccggggtaccctgggtaaccgtacgggttacagggtcggtacgtagggtacgacttcgacgtaccgtacgtaacgtttaacgtttaactaacgtaacgtaaagttcgaaggcgggtagggtacggaaggacaacggtaaggtacgtttgggttaaggttactttttagtacggtagtacttaacggttcgaacccgtaaccgttaccgttaaacgtaaccgtggtacgggtaccgggaaccggtaccggaaccggaaacgggtaacgtaaggggtaacggtaaaccgtacggaacggtacgtaaacggttcggacggtccgtagcccgtaacg

SEQ ID NO: 99372 - DNA, 910 bp, Homo sapiens
  misc_feature: GYAE6OF01BY4C5.40.81.H04.1.454.CMB.1.raw
  modified_base (56)..(56): a, c, t, g, unknown or other
  misc_feature (56)..(56): n is a, c, g, or t
  modified_base (176)..(176): a, c, t, g, unknown or other
  misc_feature (176)..(176): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
tcagtctagcgactcacgaccggtgctcgatttagtagtgtagattcgcgggggtnccctgagagcatcacccagcaaccacatctgtcctctagagaactccccctgagacgcctccgttcctcaccatggactggacctggaggtatcctcttcttgggtggacagcagcccgngaaggcgcccacctcccgaagggtcgcagtcgtgggtcgcaggttcggtggggtctaggagggtgaaaggacgtccggtcggggccgtggtaggacggtccttacgngacgtaagttacgtttaccgtaaccggtaaaccctacccgtagaaccgtaacctaaaccgttaacaactaactaaccgtcggtacggtacncgggtacggccggtacccgggtcccggtaggggaacggggttacggggtttaggggtaacgggtcggggtaaggggttcgggggggttaaccgaaccgttaaccccggtaaaccccgttaaacgggacgggggtaacgggttaccggaacctaaaaaccgggtaaagtttaacccggtaaccggtaaacgttaaaccggttaaacccgtttaaccggggagggtaacccgggttaaccggtaccctaaacccgggtaccgttacccggggtaacccgggtaacccggggtcccggtaaccgtccgtaccgtaaccggtacgtaacccggtacgtaaccgtttaccgtacggttaacgttcggtaaccgtcggtaaccgggtaccgggtaccggttaacggtccgttaaccccgtagggaccgttaacccgaacggtacccgttacggatttaggttaaccgtttagacgggtaactaacggggtaggttccggttaacggggtaccaccggggtcccggtgggtactaccccgggg

SEQ ID NO: 99373 - DNA, 831 bp, Homo sapiens
  misc_feature: GYAE6OF01CTZAJ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctcgtgggtctcgtggactccgaggtgggggtattagttgtagatgactcacgtcctaccactcctccctcgtccctcactccgtaggacgcgccgtcctctacttcctccgtgcgtacggtacttagtaccgaacgacgtaccccttaacctaaaacctaacttaagtacggtacttaccgttactttcgtttaagtaacggttttcggtaacctcggtacgaacggtaacggccgggaacgggtacctaccgtccttaccgaacgtcgtactttacggttataaacgtttaggtttacgggttacggggtttacctccggggttcccggggtccccggttacccggggttaccttacggaacggttacggtacgtaacgggtcggtaaccggtaggtacggtactacggtaaacgttacctaacgtaacgttttaaacctttacgtaaacgttaaagtaaactggtaaacggtacggggtaaggggtacggacggtaaacgaaggtaagttcggtttaaggtttaacggttattttaacgttaccgtataccggtaaccgtaacgtaacccgttaaactaacgttaaacgtagggttacgggtacggtaaccgggtcgggtaccgggtaaaccggaaacgggtacgttaacgggaaacgaacgtaagaaccggtacgttacggtaggtaccgtcgggaactaaccgg

SEQ ID NO: 99374 - DNA, 949 bp, Homo sapiens
  misc_feature: GYAE6OF01A8QQH.40.81.H04.1.454.CMB.1.raw
  modified_base (862)..(862): a, c, t, g, unknown or other
  misc_feature (862)..(862): n is a, c, g, or t
tcagtctagcgactcacgaccggtgctcgatttagtagtgtagattcgcgggggagcatcacccagcaaccacatctgtcctctagagaactcccctgagagctccgttcctcaccatggactggacctggaggatccttcttcttgggtggcagcacgccgcacgggacgccccacctccccgagggtcgaccgacggccgttggggtcgccgtacggttccggttgggggccgttagggaagggttaacggaaaacggaacggtccccgggttcggggggtcccctttacgggggttacggaaaccgggtttcccttacccggttacggaaccgtaaaacggtttacgtttttaccggtaaccggaaaaacccgtaccccgttaggaaaccgtaaccgtaaaaccttaaccctaaactaactaaacctaaccggttagggtacgtcgggaccggtaccggacccgggtacccccggtaggggtaaccgggtttaggggggtttacggtaacgggttagggtacggggttcgggggtacggtaaccgtaaccccggaaacccggttacggaacgggtaacgggtcggaaacctaaacgggtaaaaggttacctaaccggtaacgtaacggtttaaacccggttttacgggaacggggtaccggtaaaccggggttaccaacccgggttagggtaccggaacccggggttcggggaacccgtccggttaccgtaacgtaccggaacggtaaccgtaccgttaacgtaccctaacggtacgttcggtacttacgggtacggacggtaccggtaacgtaccggtacccgtacgtaccggaacgtaccgtaccggtcaacggttntaaacggtcgtagggtaagtagggtaccgtagggttcggaccgtaccggtacgggcgggctaaccggcggtccgggtccgggaccgg

SEQ ID NO: 99375 - DNA, 656 bp, Homo sapiens
  misc_feature: GYAE6OF01BWWEH.40.81.H04.1.454.CMB.1.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (638)..(638): a, c, t, g, unknown or other
  misc_feature (638)..(638): n is a, c, g, or t
tcagtctagcgactcacgaccggtgctcgattttagtagtgtagattcgcgggggagagcatcacccagcaaccacatctgtcctctagagaatcccctgagagctccgttcctcaccatggactggacctggaggatccttcttcttggtggcagcacgccgcaggacgcccacctcccaggtcgcagctgggtncagtcgnggggctgaggtgaagagccgtcgggcgtcggtagaacgtctctgctaagtactttcgacggaaaccaccgtagacacgaactactacatacacgtgntggcgacgcggcccgnggacggtaggggtttcgaggtggtaggtgggtgactaccgaacccgtacgagagggtcgaacaacgaagttacgacgaacgtaacgttaacttacgggacggacgtacgggtaccaactacggtacgacccgggttagggacccggtaccttacccgtacttacgaacgaccgtaacgttaacgtaccgtaacgttaggtaggtacctttacgtagggacggtaccggtacgtccggacttaacgggacctacgacggacgctaagtaccgttagtaccgtaggtaggagtaggtcgttcggtcggtaccgtcggcggtacncggaacgtcgacccgggg

SEQ ID NO: 99376 - DNA, 734 bp, Homo sapiens
  misc_feature: GYAE6OF01AWK8V.40.81.H04.1.454.CMB.1.raw
  modified_base (201)..(201): a, c, t, g, unknown or other
  misc_feature (201)..(201): n is a, c, g, or t
  modified_base (667)..(667): a, c, t, g, unknown or other
  misc_feature (667)..(667): n is a, c, g, or t
  modified_base (704)..(704): a, c, t, g, unknown or other
  misc_feature (704)..(704): n is a, c, g, or t
  modified_base (719)..(719): a, c, t, g, unknown or other
  misc_feature (719)..(719): n is a, c, g, or t
tcagtctagcgactcacgaccggtgctcgatttagtagtgtagattcgcgggggtgccctgagagcatcacccagcaaccacatctgtcctctagagaactcccctgagacgcttcccgttcctcacagtggactggaccgtggagactccgtcttcgttaggtggcagcacgccgacgaggacgacccactcccgaggtncgagtcgtgggtgacgtaggtcgtagggctagggaggtacggaagtaccggccggttacggggccgtacgggtaggtaaccggtcttaccgtagacgtaagttactttacggaacggaaacctccgtaggtactaacctaactactaacgaacgtacgtaaccggtgtagaccgggtccggaccggccgtaaccggtcggtagggtgggttacggaggtacgggtacgggtacgggtaacgtacgtaaaccccgagtaacggtaggacgtacggaactaagtaacgtacgtaaagaccgtaagttaaccgggaggtacgacggtacgtacgacgtacgtacgtcgggtaccgtacgtaccgtacgacgaccgtaccgaacgttaccgacgtaacgtacgacgggtactacggtacgtacggacggaccggttacgtcgaccggtacgacgtaccggactcgggtanaggttaccgtagtaccgagtacggcggtagtaccggngttaacgcgggtacncgggtacgtaccggg

SEQ ID NO: 99377 - DNA, 708 bp, Homo sapiens
  misc_feature: GYAE6OF01EYAQT.40.81.H04.1.454.CMB.1.raw
  modified_base (184)..(184): a, c, t, g, unknown or other
  misc_feature (184)..(184): n is a, c, g, or t
  modified_base (216)..(216): a, c, t, g, unknown or other
  misc_feature (216)..(216): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
  modified_base (582)..(582): a, c, t, g, unknown or other
  misc_feature (582)..(582): n is a, c, g, or t
tcagtctagcgactcacgaccggtgctcgatttagtagtgtagattcgcgggcgacgaccggtgctcgatttagtagtgtagattcgcggggagagcatcacccagcaaccacatctgtcctctagagaactcccctggagaggcttccgttcctcaccatggactggacctggaggactcctnttcgttggtggcagcagccgaacgacgggacnccaccgtccagggtcgccacggcttagggctccgaggtcggtaggggtacttagggaagggttgaaaggacggccggtcgggccgtacggtaggaacgttctctagactaagtactttcgacgaacctccgtanacgactaactaacanactacacggtgagcgccgtccgacggtcccgtagggtacgtcgggggttanagggtgggtaacgggtggggtacgtaccgtaaccaaccggtacgaggggtaacgtcggaacgaacgtaacggttaactacggtaacggtaaacggtaacgttaacggacggggtaccgtacgggtaccaacggtcgttacggaccgggtacggacgtccgtaaacncgacgtacaccgtaacgtcgtaacaggtccgtaagtaccgttgaaacgggccgggtaacgtcgtaaaccgtcggtacgacggtaaccggaacgacccggtatacgttagtaaccgttggtaacggg

SEQ ID NO: 99378 - DNA, 793 bp, Homo sapiens
  misc_feature: GYAE6OF01BNMBK.40.81.H04.1.454.CMB.1.raw
  modified_base (660)..(660): a, c, t, g, unknown or other
  misc_feature (660)..(660): n is a, c, g, or t
  modified_base (666)..(666): a, c, t, g, unknown or other
  misc_feature (666)..(666): n is a, c, g, or t
  modified_base (737)..(737): a, c, t, g, unknown or other
  misc_feature (737)..(737): n is a, c, g, or t
  modified_base (748)..(748): a, c, t, g, unknown or other
  misc_feature (748)..(748): n is a, c, g, or t
tcagtctagcgactcacgaccggtgctcgatttagtagtgtagattcgcgggcacgaccggtgctcgatttagtagtgtagattcgcggggagagcatccacccagcaaccacatctgtcctctagagaactcccctggagacgtccttcccgttcctacaccagtcggactcgggaccgtgggaggtacttcccttctttcgttgggtcggcacgccacgcccgacgacggacgccccacctcccgaggtcgcgagtcgtagggtcgacgtacggtcggtgggactagggaggtacgaaggtaccggccggtcgggtccgtacgggtaggaacggtctccgtgaacgtaacgttactttacgaaccggaaaacctcccgtagacccgaactaaccgttaaacgtacgtaactacgaacggtcggtacgtccgggaccgaacccgtcggggtaccccgtagggggtaacgttaggggggttagaggggttgggttaaggggtcccggggtaactacccgttaacccgaaccggtaaccgggagggtaccgggacggaacgtaacgtaaccggttacgtacgaacgttaacgtaaccggttacggggacgtacggtaacggtccaacggtcggtacggaccggaccggggtcctaacccgngtaccnggacctaccggtaattaccggtacacgtatacggagttaccgaggtacggtccgtaccgttactacccggngtaaccccggngaacggtacccgtagttaacgttacggttaaacgttgggtaacgg

SEQ ID NO: 99379 - DNA, 836 bp, Homo sapiens
  misc_feature: GYAE6OF01CY6B2.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggagatcctcttcgttggtggcagcagccgcaggacgcccactcccaggtgcagctggtgcgagtcgtggggctggaggtagaagacgccgtggggcctcggtgaacggtcctccgtggacaagtacgttttcgtaacgggaaaaccctacccgttaggacgaacctaaaaccttaacctaacaacttaacgaacgtggactcggccggaccgtaaccgggtcccccgtaggggaaccggttaaggggggttttagagggttcggggtaagggttcggggggtacgtaaccgtaccccgtaaaaccccgtaccggtaagggtacgggttaccggaactaaacggtaaagttacgtaacgaacgaacgtttaacgttcggaagggtccgtaacggtaccaccgtagtaccgtacccggtgggaacctccgtaccagtccgaacgtaccgacgtacggttactaacgtagtacgtacgttacggtacggaccgggtacccggtaaccgtccggtaaaccccgttcgggaccggtaaccgtaaaccggtacccggtacccgtaagtttaaccgtaacgttaccggttaagggaacccgggaaaggttaccgggttaccgggttgggtaccccgggtacccggttaacccggggtcgggttaacccgttacccgggaaaccccgttcgggggtccgggggtaaaacccccgg

SEQ ID NO: 99380 - DNA, 877 bp, Homo sapiens
  misc_feature: GYAE6OF01EWJQ8.40.81.H04.1.454.CMB.1.raw
tcagtctagcgactcacgaccggtgctcgattttagtagtgtagattcgcgggcacgaccggtgctcgatttagtagtgtagattcgcgggggagagcatcacccagcaaccacatctgtcctctagagaatcccctgagagctccgttcctcaccatggactggactggagatcctcttcttggtggcagcagccgcgaggacgaccccacctccccgaggtgcgacgcgttagggtcgacgaggtccgtgggggctaggagggtaggaaaggaacgcccggttcggggggcccgtacgggttaggtaaacggggttccttacctcggtaaccgtaaacggtaacgtttttacgtaacgggaaaaacccgtaaccccgtaggaaccggaacctaaaacccgttaaccgtaacctaacttaaaccgaacggttacggaagttcgggacccgggaccgaaccgggtacccccgttaggggtaaccgggtagggggttttaggaaggttagggtagggttaggggggttagggtaaccgtacccgtaaaaaccccccggtaaccggtaaagggtacgggttacgggaaccgtaaaccgtaaaaggttacgacgtaaccggtaacgtaaacgtttacggaagggtaccgtaacggggtaccctaaccggtaacgtaggtacccggtaccggggtaaccggtacccgtacgtaacgcgtaaccgaccgtaaacgtacggttacctaaccgtaaggttaccgtagttaccgttcgggaacggtaccgggaacccgttacggtacccgttacccggtaacggaaccggaacccggtaacccggaccgtaacgtttaacggttaagtttaacccggttaagggg

SEQ ID NO: 99381 - DNA, 689 bp, Homo sapiens
  misc_feature: GYAE6OF01AORFQ.40.81.H04.1.454.CMB.1.raw
  modified_base (308)..(308): a, c, t, g, unknown or other
  misc_feature (308)..(308): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcgaggcgcccacctcccgaggtcgcgagcctggtgcagtcgtggggctggaggtagaagacggccgtgggccgtcggtgacgtctccgtgacaagtacttcgacggaaccnccgtgacgacactaactacatacacgtgatcgacgcgaccggcccgtggacgtaggggttcgaggtggtaggtggggtacgactacccgaaacccgtacgacggacgggtacggacctaacgaaagtaccgtacggaacaacggttaaccgtttacgggaacgggtaccggtaacggggtacccaacggtacgtaccggaccgggtacggaccggtccgttaccgacgtaccgaacggaccgtacgtaaccgttaacgttaccgagttacggtacgtcggtacgggaccgggtaccggtaccgtcccgaacggttaccggtaccggaacccggttacggaccccgggtacttaacggtacggtttacgttggttaacgggg

SEQ ID NO: 99382 - DNA, 833 bp, Homo sapiens
  misc_feature: GYAE6OF01EPI0N.40.81.H04.1.454.CMB.1.raw
  modified_base (336)..(336): a, c, t, g, unknown or other
  misc_feature (336)..(336): n is a, c, g, or t
tcagtctagcgactcacgaccggtgctcgatttagtagtgtagattcgcggggactgatcaggactcctcagttcaccttctcacaatgaggcctccctgctcagctcctggggctgctaatgctctgggtctcgtggatccaggtgggattattgtgatcgactcagtccacctactcctacctcgcccgtcactcgtaggagacgccgcctaccatcctccgtgcaggtcctagtacagacgtaccctaacctaaactactaagtaggtaacttaccgtacctttacgtttagtaacgtttaccggttaactcggacgtaagaaccggaaccgnggggaacctacggtacctaccgtaccgtactcgttacttagtaattagtttagggttttaccgggttattacggtccggggttcccggttaccgggtacccgtacgtaaccggtaggtttacggacgggttacgacgtaagggtacgtagtaccgtaacgtactaacgtaacgtttactttaacctaacgtaaacgtaaatacgaacggtacgggtaggggaacggtaacggaacgtaaaggtaagtaacgtttagggtttaaggtttaacgttttaacgttaacggttaccggtacttaacgttacctaaaccggtaacccttaaaccgtaaccgtaaacgttaccgggtaacgggtaaccgggtaccggggtaaacccggtaacggggtaaaacccgggtaaaccggttaacgggtaaacggttaaacgtacccgggtaaaaggtacccggttaaaggttacgggttaaccccgtaggtaacccgtaaaacccgg

SEQ ID NO: 99383 - DNA, 885 bp, Homo sapiens
  misc_feature: GYAE6OF01DG0RT.40.81.H04.1.454.CMB.1.raw
  modified_base (120)..(120): a, c, t, g, unknown or other
  misc_feature (120)..(120): n is a, c, g, or t
  modified_base (239)..(239): a, c, t, g, unknown or other
  misc_feature (239)..(239): n is a, c, g, or t
  modified_base (387)..(387): a, c, t, g, unknown or other
  misc_feature (387)..(387): n is a, c, g, or t
  modified_base (841)..(841): a, c, t, g, unknown or other
  misc_feature (841)..(841): n is a, c, g, or t
tcagtctagcgactcacgaccggtgctcgatttagtagtgtagattcgcgggcgtagacttttgtgtttctcgtagtctccctgctcagctccgtggggctgctaatgcttcgtggtctntggactccgagtggggattattgtgagtcgactctacgttcctaccctacttccctaccccgtccggtccccgttacctacccgttccggtaggacggaccggtcccggccctaccctntccttcgcgtcgtaggttctaggtacacgtaccgtaccctaacctaaacaacgttaagtggtacttaaccgttacttacgttttagtaacgtttccggtaccaggaacgtaacggaccgtacggacgggtctaccgttccacccgtanaccgtttgtactagttaacgttgtttacgggtttggtttaccctacggggttcccgggtcccggttcccgggttacccgagttaccggttagtcggtacggtacggacttacggtagaccgtgaaccgtacgaaacggtttcttaaacgttacctaaagtaacgtaacgttcggaacgggtttaggtaaggggtacgaacggaacgggttaaggaaacggtttggttttaacgggttagtttaacgtttaagttacggtagtacgttttaccgaaccgtaaccgtttaaccgtaaacccgtttaaagtcgggttaacggttaccggggtaccggttacccgggggtacggtaaacccggggtaaacggttaacgggtaagggtaaaccgttaaccgtaaccgggtaaacgtccgggtaacgttcgggtaaccgttccggttaacgaccgtttanacgtttccctggtttaccccttacgtcccgttaccgtaccccgg

SEQ ID NO: 99384 - DNA, 861 bp, Homo sapiens
  misc_feature: GYAE6OF01DECRJ.40.81.H04.1.454.CMB.1.raw
tcagtctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgacgaggacgcccactcccgaggtgccagcgttggtgacagtcgtggggctggaggtagaagaacgccggtcggggcctcggtagaggttcctccgtgacaagtatttacgtacggaaaccaccccgttaggacgaccaaccgttaacctaacctaactaccaacgtaggacgttcggaccgggacgtacccgggtacccccgttaggggaaccgttaggggggttttcggaaggttgggtaaggttcgggggttaggaaccgttaaccccgaaaaccccttacggtaacggggtcgggtaacgtaaccgtaaacgtaaaacggtacgtaacggaaaccgttaacggttaaacccgtttcggaaaccgggggtacgtaacggggttacccaaccgtagtaccggtaacccggtacgggtaccggtaacccgtcgtaaccgttccgaacgtaccgtacgtaaccgttacctaacgtggtacgtacgttacgtacgggacgggtaccgtaacggtaccggtacccgtaaccgtccgggtaaccgtaccggtaacccggtactaacggttcctttaaagttaccggttacgggtaaagggaaacggtaccggggtttagggttccggggtaccgttaccgggtacccgggaccggggtttaccggtacccggtaaccggttacccgggtaccggggggttaaaccccg

SEQ ID NO: 99385 - DNA, 805 bp, Homo sapiens
  misc_feature: GYAE6OF01BYH6M.40.81.H04.1.454.CMB.1.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcgttggtggcagcagccgcgaggacgcccactccgaggtgcagctggtnacgngtcgtggggctgaggtagaagacgccgtgggcctggagacggtcctcgtagacaagttacttcgaggaacctaccgtagacgacctaaactaccgtacactacgtacgtggactcgggccgacgaccggtcccgtagggtacggtaggggtttcgaggtcgggtaggtcggggttacgaaccgttaccgaacccgttacggaagggtacggtacgaacgtaaacgtaaggtactacgtaaacgtaacgttaccgttacgggacggtacggacgggttaccaaccgtagggtaccgtaacgggttcggaacctccggttaacaacggttccgaaaccggtaccgtaaccgttaacggttaaccctaaagggttacgtacgggtcctttaacggggaggtaccccgggaaccggttacgttaacccgggtacccgttaacgggtaacccggttaccgaaccgggtacccgtaaccgttaaggtttccgtaaacgtttcgggaacggttaacgggtaaacgttcgggttaacgggttcgggtacccggttaccggaacccggggttcggaccccggttagggaccccggttaccgggacccgggggtaacccgg

SEQ ID NO: 99386 - DNA, 679 bp, Homo sapiens
  misc_feature: GYAE6OF01AVLCB.40.81.H04.1.454.CMB.1.raw
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctgaggtgaagagccgtgggcctcggtgagtctctgacaagtatttcgaggaaacnccctgacgacaaactacctacatacactggatggcggacacggccctggacgtaggggtttnaggtggagtgggtgactaccgaaccctacgaggacggtacggactaaacgaaagtcgtacgtaacgaacgttaacctttcgaaggggtcgtacgggtcctaaccgagtacggtaaccggtcggggaccgtccggtaccaacgtacgaacgaccgtaagacgttaccgtaaagtagtcggtaacgtcggtacgaacggccggtaacgtccgtaccgtccggtacgaacccgaacccggaccggtaccgtaggttacttacgttaacggttgggtaacgggaagtacgggtacggtttacggggtgacccgggttacccggacggggtacccttacgggaacccgttcccggggtacggggg

SEQ ID NO: 99387 - DNA, 697 bp, Homo sapiens
  misc_feature: GYAE6OF01DYTD2.40.81.H04.1.454.CMB.1.raw
  modified_base (685)..(685): a, c, t, g, unknown or other
  misc_feature (685)..(685): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtgcagcagccgcaggacgcccactcccagttgcagctggtgcagtcgtggggctggaggtagaagaacgccgtaggggcctcgggtagaacggtcctcctgaccaagtactttacgtaacggaaacctacccgtagacgacctaacctaactaactaactaaccgacgtacggacgtcggaccggaccggaccggtacccggtacgggtaacgggttaggggtttaggtagggtacgggtagggttacggggtacggtactacccgtaacccgtacggacgggtacggtacggaacgaaacgtaaacgtacgtaacgaacgtaacgtaaccgttacggacgggtacggtacgggtaccactacgtacgtaccgggtacgggacgtccgtaccgtacgacgacgaccgaacgtacgtactaacgtattacggacgttcggtacggacggtacggtacgtaccggacggtacggacgtacgacgtacgactagtacgtcgtagtagtacgagtacgtcgtaggtcgacgtacggacganacgccgaggcgg

SEQ ID NO: 99388 - DNA, 861 bp, Homo sapiens
  misc_feature: GYAE6OF01DAVZC.40.81.H04.1.454.CMB.1.raw
  modified_base (380)..(380): a, c, t, g, unknown or other
  misc_feature (380)..(380): n is a, c, g, or t
tcagtctagcgactcacgaccggtgctcgatttagtagtgtagattcgcggggatcaggactcctcagttcaccttctcacaatgaggctccctgctcagcctccgtggggctgctaatgctcgtgggtctcgtggactccgaggtggggtaattagtttggtagagttcgaccttaccgtacgttcctaccctaccttccttccccgtccggtacccctctaccgtccgtaggggaacggccggcccggtccctaccactcctccgtacgacgtacggtactagtcgaacggactaccctaacctaaaactacgtaagtacggaacttacttacgttcttaggtaacgttcgtacctgacacggacgcggacgggtacncgttccacctacgacgttctacggttataagttagtttacgggtttcgggtttaccttaccggggtcccgggttacccgggttccccggggtaccgttacggtaccggttacggttaccgtaagggtcgtacggtagggtaccgtagtaccgtacgtacctaacggttaacgtttaacctttaacgaacgtaaagtaacgacgggtaacgacggggtaagggtaacgggacgtaaagtaagggtaagttagggtttacggtttaaggtttaacggtttactttaacgggacgttaacgttactaaccgtaaccgtaaactttaaccgtaaagtacggttacgggtacgggttaaccgggtacgggtaaacccggtaacccgggaaacggggtaaaccggttacggtaaaggtaacggtaaccgtaacggggtacggttaacgtccggggacgtaaccgtccgtaaacctacgttaaccggg

SEQ ID NO: 99389 - DNA, 658 bp, Homo sapiens
  misc_feature: GYAE6OF01BXLEJ.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcgaggtctagtcagacgccctacctaaacactaatggatactactcttagattggtacctgcagaagccgaggcagtctaccacagctctgatagttagttggggttcttagtcgggtcccgttccggggtccctggtacgtaggttcaggttcggcgtaggtgatcgagtcaacgtagtactttacgactagaaaactcgagtacgagggtggacgacgaaggaagtagttgggttagggtaattttacgttacgtagtactagtacgacctaaccttaccgtaactaaacggttggttacggtacgggtacgggtccgggtaaccggaacgggaaccggtaagggtaaggtaaacgtacggtaaacggaacgtaacggttcgggtacggtaccgttacggaccgtacccgttacgttcgttacgtttaccttaccgttaccgtttccccgttaccccg

SEQ ID NO: 99390 - DNA, 779 bp, Homo sapiens
  misc_feature: GYAE6OF01C1XJS.40.81.H04.1.454.CMB.1.raw
tcagtctagcgactcacgaccggtgctcgatttagtagtgtagattcgcgggcacgaccggtgctcgatttagtagtgtagattcggcggggagagcactccacccagaccaaccacacttctcgtcctacgtagacgtaactcccgtaggagacgtccttcccgttcctaccaccgtagtcggacgtcggaccgtgggaacggtacttccgttcgtttcggttgggcggacgacgcgacgccgacgacggccgacccaccgtccggaggtcgactacggtcgttcgggtcgcgtacgggttcggtcggggtcgtaggaagggtaaggaaacggacggtccggtcggggtaccgtagggtacgtacggtcctcgagaacgtacgttacgttacgaaccggaacctaccgagacaactaactaactacgtaactaacgtacggtagtacggacggaccggtaccgaccggtaccggtagggtaagggttacggggttaggtagggtagggtagggtacggggtaacgtaaccgtaaacccgtaaccggtacggtaagggtacggtacggaacgaaacgtaagttacgacgtaacgtaagtacgttacgggacggtacgaacggcaacgtacggtacgaacgggtcgaccgtaccgaacgtacgtaacgacgtaactacgtacgtaacttacggacgttaggtactacggaacggtaaccggacgttaccacgtaccacggtaaccgacgaaccgtacgacttaagtacgttacgaaggtg

SEQ ID NO: 99391 - DNA, 811 bp, Homo sapiens
  misc_feature: GYAE6OF01AV1WA.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtccctctagacgaactcccctgagagccttcccgttccctccaccagtcggactcggacccgtgggacgggttccttccgtttcgttggtggcgagcgacggcccgcgaggaccgaccctacctcccgaggtcgcgacgtcgttggtcgcgtcgtcggtggggcgtaggtaggtagaaggacgcccggtcggggtccgtcgggtaggtacggtccgtccgtaggacgtaacgttacttttacggaacggaaacccgtacccgtagacgtaacctaacctacctaactaactacgtacgtggacgttcggccgggaccgacccggtcccggtacggttaacgggttaggggtttacggacgggttacgggtagggtacggggttacggtaacccgtacccgtaaaccccgtaaccggacgggtaacggggtaccgtaacgtaaacccggtaaaggttaaccgtaccgaaccggttaacggttaaccgttacgggacgggtaccggtttaaccggaaccgtacgtacggtacccggtaccggtacggtaccccggtacgtaccgacggtccaaccggtaccgtaccgtacgtaaccgtcgtacggtacgtacgtacgtcggtaccggtccggtaacgtcccgaacggtactcccggaacgttaccggacgacgttcgtagtacggtgtacggtagg

SEQ ID NO: 99392 - DNA, 777 bp, Homo sapiens
  misc_feature: GYAE6OF01BQ6MW.40.81.H04.1.454.CMB.1.raw
  modified_base (311)..(311): a, c, t, g, unknown or other
  misc_feature (311)..(311): n is a, c, g, or t
  modified_base (650)..(650): a, c, t, g, unknown or other
  misc_feature (650)..(650): n is a, c, g, or t
tcagtctagcgactcacgaccggtgctcgatttagtagtgtagattcgcgggggtgcccgttggagagcatcacccgacgcaaccacatctgtcctctagagaactcccctggagagcctccgttcctcgaccatcggactggacctggaggatccgtcttcgttggtggcagcagccgcgaggacgccccacctcccgagggtcgaccgagtccgttgggtcgacagggttcgtggggggtcttagggagggtaggaaaggaaccggtccggtcgggggacccttcggggtaggtaacggttccttccgngaccgaaggttactttacgtaacggaaaacctcccgtaggaacgacaaaccttacctaactaagtacctacgtggacgtcggccggcgaccggtcccgtgggaacggttagggggtttagagggttgggtaaggtgggggtacgtaccgtacccgtaaaccccgtacggagggtacgggtacgaacgaaacgtaaggtacgtaacgaacgttaaacggttaaaccgtttcgggaagggttaccggaacgggtacctaacccgtaggtaccggtacccgggtacggggaccgtccggtacctaacgtacgacgactacgtacgtactaacgtagacggtntccgtaggcggtacggcgttacgaccttagacggaccgtacgtaccgtcgtacgttagtaccgtttagagggtacgaaggtcggttacgggtgggtacggtaccgtccgggtcggtacgtacccggg

SEQ ID NO: 99393 - DNA, 750 bp, Homo sapiens
  misc_feature: GYAE6OF01ALUI6.40.81.H04.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
tcagtctagcgactcacgaccggtgctcgatttagtagtgtagattcgcgggggagcatcacccagcaaccacgatctgtcctctagacgaatcccctgagagctccgttcctcaccatggactggacctggaggatcctcttcttggtggcagcagccgcaggacgcccactcccaggtcgcagctggtgcagtcgtggggctggaggtgaaggacgccgtgggcctggtagacggtcctcgtgacaagtntttcgacggaaaccncccgtgacgcaactactacactacacgtgatcgcgtcgacgtcccgtggacggtaggggtttcgaggtggtagtggggtacgtacttaccgaaaccccgttaggacggtaggtccggtaacgaaacgtaaaggttcgtaccgaacggtagtaaccgtttcggaacgggtacgtacgggtaccaacccgtagtacggaccgttcgggaaccgtccgtaccgagtaccgacgacctacgacgttacgactacgtcggacttacggtaggaccggtacggtaccgttacgtacccggttacgaccgtaacggttacccgacccggttaccgtaggttaccttaacggtttaacggtaaccgggttacggaaacggttaccgggttacgggtttaccgggtaaccgggtaccccgggttaaaccgggtccggggtaacccgttaaccggaacccggggtacccggggttaccggggaaacccccggg

SEQ ID NO: 99394 - DNA, 881 bp, Homo sapiens
  misc_feature: GYAE6OF01ATWF7.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactcggacctggaggactcctctttcgttgggtcggcagcacggcccgacgaggacgcccaacctcccgaggtgacacggtcgtgggtcgacgtaggtcggtggggtctgggtaaggtaggaaaggaaccggtcccggtcgggggaccgtcgggtaacggtaacgggttccgtaccggtaggtaacctaaagggttactttaccggtaaccggtaaaaccctacccgtaggaacgtaacctaaaacctaactaacctaacgttaccgacggtaggacgtaccgggccggtaaccgacccgggtaccccggttaggggaaccgggttttagggggtttaagacggggttaggggtaagggttacgggggtaccgtaaaccgtaaccccgtaaacccggttaacggagggtaacggtacggaacgtaaaacgtaaaagtacgtaacggaaacgtaacgttaacggtaccggaagggttacgaaccggtactaaccgagtaccggtacccggtagggaaccttccgaaccgtagtaacgaccggtaacgtaacccgtaagtactaaccggtagtaccggtacttacgggtacggtaaggtacccggaacgttaccgggaacccttaggacccgttagaaccgtacgtaactacgtaagttaccgtagggtaacgtaccggaaagttcgggccgttagggaaaccgttccgggtaaccgggggtacccaggtttaaacccccggggagcccgggttaaacgggg

SEQ ID NO: 99395 - DNA, 898 bp, Homo sapiens
  misc_feature: GYAE6OF01A40Z4.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactcctccctcgcccgtcactccgtggagacgcccggcctccatcctcctgcaggtctagtcaggacacctacctaaactactaagtgacttacttacttcttagtaattcggtacctgacgaagaacgccgagggcacgttccaccgacgtacgtcttacttagtaattagttaaggttttcggggtttacttacggttcccgggtccccggttcccggggttcccgtaggaaccggttacggtttacggacggttcggtaccgtaggttacggtaagtaccgtaacggtaccgtaaacgttaacggttaaacttttaacccgaaacggttaaaacgtaaaacggttaccgaagggtaacccggtaaagggggttacccgggaaaggaacgtaaagggtaaaggtttagggttaacgggttttagggtaaacgttttttaacgaagggttccgttaaaccgtacggttaaccgtaaacccttaaacccgtttaaccggttaaaacgtaaccggttttggggtaaccggggtttaaccggggaacccggggttaaccgggtaacccggggttaaaacggggaacccgttaaaggggggtaaactaaaaccggttagggaaaacccggttaacggttaaaccggtttcggggtaacgggttacccgaccggaacccgttaaacgtacggtttaccgttacgggtttaaccctttacccgttaaccctttcccccggggttaaaccc

SEQ ID NO: 99396 - DNA, 692 bp, Homo sapiens
  misc_feature: GYAE6OF01BIET2.40.81.H04.1.454.CMB.1.raw
  modified_base (242)..(242): a, c, t, g, unknown or other
  misc_feature (242)..(242): n is a, c, g, or t
  modified_base (599)..(599): a, c, t, g, unknown or other
  misc_feature (599)..(599): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtgggcctcggtgaggtctctgcaagtnttctaggaaaccaccgtgacgctaaactactacatacactaggatggccggtcgaccgggtccccgtagggtaccggtagggggtttagaggtcgggtaggttcgggggtaggtactaccgaaacccctacggaggtacgggtacggacaacgtaaagtacgtacgaacgtaacgtaacgtttaccggaagggaccgtacggggtaccaaccgtagtaccggtacccggtaggggaccccgtcggtacccgtaacgtacggaacgtaccgaacgtacgtacctacgaggtcggtactcggtacggacggccgggtaacctacgggtacctacggtaagaacccgtcggaacccggtntaagtacgtttactacggtttggaggtaagtacgggttcgggttacgggcgtcccggtacgggggacggtacgtacggacgtccggggacggg

SEQ ID NO: 99397 - DNA, 779 bp, Homo sapiens
  misc_feature: GYAE6OF01B1FRP.40.81.H04.1.454.CMB.1.raw
  modified_base (488)..(488): a, c, t, g, unknown or other
  misc_feature (488)..(488): n is a, c, g, or t
tcagtctagcgactcacgaccggtgctcgatttagtagtgtagattcgcgggcgtagacttttgtgtttctcgtagtctccctgctcagctccgtggggctgctaatgctcgttgggttcctcgtggatccgaggtagggggattagtttagtggattagacctcagttcctaccaccttcctcccgtcgcccgtacactccgtaggaggaccgccggtacctacctacttccctccgtagacgtcgggttactacggtacaacggtacctaaccttaaccctaaaagtaaccttaagtacgtaacgttacttaccgttatttagtaacttcggtaccagaacgacggaacgtacgacgggactccgttaaccaccgtaagtcgtcttagttagtaattacggtttagggttttcggttacgtttacggtccgggtcccgttccgggtaccttagaacgtaggttacggcggtcacgtacggtgtaanccgtagtaactcgtaatttaacgttagaattaaacgaaagtccgagtacgggtaggaggaagtacgaagtagtagtaggtagtttaacgttagttacgtagtcgacgtactaaccgtaacgtaacgaaccgttaacgtgtaacgggttaaccgggtcggggtaaaccggaaccggaaaccgggtaaacggaaggtttaaaccgaaacggtaacgaaccgtaaaggtaaccggttagtaccgtagtaccggaactacgtaactccgttacttacgtactcgttacccgtacg

SEQ ID NO: 99398 - DNA, 733 bp, Homo sapiens
  misc_feature: GYAE6OF01BJ061.40.81.H04.1.454.CMB.1.raw
  modified_base (136)..(136): a, c, t, g, unknown or other
  misc_feature (136)..(136): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagacgaatccccngagagcctccgttcctcaccatggactggacctggaggactcctctttcgttggtggcagcgacgccgcgacggacgcccacctacccgagggtcgcgacggtcgtggtcgcgtacggtcgtcgggggtacgtaggaaggggtagaaaggaacggtcccgggtgggggtccgtacgggtaggtaacgggttccttaccggtaggacttaaaggttacgtttacgaacggaaaaccctccgaagtaccgaacctaacttactaactactacgacgtggaagtacggccgacgccggtccgtaggtacgggttgggtacggtaggtcgggtacggtggggtacgtacttacccgaacccgtaacgaggtacgggtacgaaccgtaaaggtaaacgtacgacggtaacgtaaggttaaccgtaggacgggtaacgacgggttaccacgaggtacgaaccggtcgggactaccgtacgacgtaccgacgacgtacgaacgtactaaggtactcggttaacacgtggaacggtacccgtacggacgttacctcggaacggtaacggaccgtaacggtcttaagtttacgtacgttgggaacg

SEQ ID NO: 99399 - DNA, 752 bp, Homo sapiens
  misc_feature: GYAE6OF01CURYD.40.81.H04.1.454.CMB.1.raw
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
tcagtctagcgactcacgaccggtgctcgatttagtagtgtagattcgcggggatcaggactcctcagttcaccttctcacaatgaggctccctgctcagctccgtggggctgctaatgctctgggtctcgtaggactccgaggtggggattatttgtgatgactctagtctcctactcctccctagtcccgtactaccgttccgaggagacgccccggtcctaccattcctcctgacgtacggtcttagacgacgtacgtaccctaactaaactacgtaagtcggaacttaactaccgtttnttacgtaacgtttcggtacctagaacgaaggaaccgtaccggaagggtctaaccgttccnccacgtactcctttacgtagtattagtttacggtttcgggttccgtttacggcccgggttaccgttccccggggtactcggacggttacggtagtacgggtcgtaagttacgggtacgtactcggtacgtaacctaagtaacgtttactttaaactagtaaacgtaacgttacgacggtacgggtaggaacggtacggaagaggtaagttaggttagtttaacggtacttttaagtctacgtaacgtcgtactacctaacgttaccttaagtacggttaggtcgtaacgggttaaccggtcggaaccggtaacgggtaacgtaacgggtaacgaaacggtaccgaaacgggtaacgtacggtcgtaacggtcgaacgtccgtagtaccg

SEQ ID NO: 99400 - DNA, 844 bp, Homo sapiens
  misc_feature: GYAE6OF01CUYDQ.40.81.H04.1.454.CMB.1.raw
  modified_base (765)..(765): a, c, t, g, unknown or other
  misc_feature (765)..(765): n is a, c, g, or t
  modified_base (825)..(825): a, c, t, g, unknown or other
  misc_feature (825)..(825): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggagatcctcttcttggtggcagcagccgcgaggcgcccactcccgaggtgcgagtcgtgggtcgcgtagtcggtaggggtcgtaggtaggtaggaaggtaacgtccggtcggggtacccgttgggtacggtaacggttccgtccgtcggaacgtaagttacgttacgaacgaaacccgtaccgagtaaccgtacctaaaccgtaacctaactaccgtaaccgtacgtacgggtaacgtcgggaccgggtaccgtacccgggtccccggtaaggggtaacggggttaacggggttttacggaggggttacgggttaacggggtttcgggggtaacgtaaccgtaaacccccggtaaccccgtaacggtacggggtacgggtaccgaaaccggtaaacgtaaaggttaccgtaacgtaacggtaaaccgtttaaccggtttacgggaacgggaccgttaaacgggtacccaaccggttaggttaacccggtcccgggtacgggaacccgggttacctaaccggtaacgtaccggtaacgtaccgaacgttacgtaaccgttaacgagggtaccgtagttaaccggcgggtacgggtaccggtaacgtccggtaaccgtcgtacgtaccgtacgacgtntagtcgttacgagtggtaacgagtacgggtgtccgaggtccgtacgggtcgacgtacccngggtaaccgcggtaacggg

SEQ ID NO: 99401 - DNA, 723 bp, Homo sapiens
  misc_feature: GYAE6OF01BWAKT.40.81.H04.1.454.CMB.1.raw
  modified_base (265)..(265): a, c, t, g, unknown or other
  misc_feature (265)..(265): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcacctccgtggagacgccggcctccatcctcctgcaggtctagtcagacgcctacctaaacactaatggtatacttactcttagaattcggtacctnacaggaacgccgagggcagtcctaccatacgcttcttgtattagttagtttcggggtttacttacggtccgggtcccggttcccggggttccctacggtacgtagggttccgtaggtcgggactagggtggacgtcaacggtacgaacgtagttaacgttttaacaactaagtaaaactacgaacggtacggaggggtacggaacgggtacgaaaggtaacgtaagtttagggtttaacggggttattttaaacgttacggtgactaagttccgacctaaacccttactaacgaacgttgggttacggtacgggaccgggttaacccgggacgggtaaacgggtaccggaaagggtaagtaaacggtacgaaagggtacccgtaaagggtggtacggacgtacaacccgtaccgtacttccgttacgttacccttcgtaccctttcccggtaaccccg

SEQ ID NO: 99402 - DNA, 676 bp, Homo sapiens
  misc_feature: GYAE6OF01C83NQ.40.81.H04.1.454.CMB.1.raw
  modified_base (96)..(96): a, c, t, g, unknown or other
  misc_feature (96)..(96): n is a, c, g, or t
  modified_base (231)..(231): a, c, t, g, unknown or other
  misc_feature (231)..(231): n is a, c, g, or t
  modified_base (525)..(525): a, c, t, g, unknown or other
  misc_feature (525)..(525): n is a, c, g, or t
tcagtctagcgactcacgaccggtgctcgatttagtagtgtagattcgcgggcacgaccggtgctcgatttagtagtgtagattcgcggggagagnatcacccagcaaccacatctgtcctctagagaatcccctgagagctccgttcctcaccatggactggacctggagatcctcttcgttggtggcagcgacgccgcgaggacgcccactccgaggtgcacgcgtggngcgtaggtcggtgggacgtaggaggtagaaaggacgccggtcggggtccgtacgggtacggtaacggtccgtcgtacgacgtaagtactttcgaacggaaacctacccgtagacgaaccaaaccgtactaacgtaactaccgtacgtaggacgtcggaccggtacgaaccggtcccggtagggtacggttaaggggttagtaggtagggtaggtgggtacgaccgtaccgaacccgtacgaggacggtcgaacaacgaagtactacgaatagtacgttcggacggcgtagaccncgaacgtcgtaccggtacggtcgtacgttacaactacgacgtactacgtacgtacgtacgtagaggtaccgtaggcggtaacggccgtacgtaccgtacgtacggacgaacccgtacggtaacgtacgtattacggtagttcggtaacggg

SEQ ID NO: 99403 - DNA, 866 bp, Homo sapiens
  misc_feature: GYAE6OF01CHTQ0.40.81.H04.1.454.CMB.1.raw
tcagtctagcgactcacgaccggtgctcgatttagtagtgtagattcgcgggggagagcatcacccagcaaccacatctgtcctctagagaactcccctgagagcctccgttcctcaccatggactggaccgtggaggactccttcttcgttggtggcgagcacgccgcgaggacgccccactcccgagggtcgacgacggcgttgggtcgccgtaggttcggtggggtcgtagggagggtaggaaacggtacggtccggtcgggggtcccgtacgggtaggtaacggttcctccgtacggactaaagttacgtttacgaacggaaaccctaccgtagaacgtaacctaaaccttaacctactaactaaccgtacgtggtagtcggaccggccgaccggtcccgaggtacggtaggggttgagggtggtaggtggggtacgacgtacccgaaccgtacggaggtacgggacgaacgaacgtaaagtacgtacgaacgtaacggttacgttcgggaacggtacggaacggtacgaaccgtacgtaccggtaccgggtaccgggccggtaccgtacccgtaacgtaccgaccgtaccgaacgtacgttaaccgtaacgtacggtacggtacgttcggtacgggacgggtaaccgggttaccgtaccgttacccgtacggttaaaccggaaccccggttaaccggaccgtaaccgttaggtttaaccgtttacggtttaacgggtttaacgggtaacgggttacgggttacgggttcgggttacccggggtaccgggttacccggggtacccgggtaccggttacccgggtaacccggtacccgggggtcccggggttaaccccggggg

SEQ ID NO: 99404 - DNA, 731 bp, Homo sapiens
  misc_feature: GYAE6OF01D62EJ.40.81.H04.1.454.CMB.1.raw
  modified_base (259)..(259): a, c, t, g, unknown or other
  misc_feature (259)..(259): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccaggtgcagctggtgcagtcgtggggctgaggtgaagagccgtggggcctcggtgaggtctccgtgcaagtattcgtaggaaaccncccgtgacgactaactactacatacactggatcggcggcgaccggccccgtagggacggtacggggtttgaggttcgggtaggttcggggtagtacgtacccgtaaacccgtaccggaagggacgggtacggaaccaaacgtaaacgtacgtacgaacgtaacggttaaccgtttcgggaaccggggaccggtaacgggtaccgaaccgtaacgtcggtaccccggttacggggaccgtcccgtaccgaacgttacgaacgtacctaaccgtacgtaccgtaacgtacgttacgggtaacctcgtacggtacgggacgtactacgaccgtcgtacgaccgacgtacggtacgttaatacggttacgttagtacgggtaggtaacggtaggtcgggttcgggttccggaccgtttaccccgggggcgggttaccgtacggtaccccggaccgggttccggggtaaccccgggg

SEQ ID NO: 99405 - DNA, 564 bp, Homo sapiens
  misc_feature: GYAE6OF01DVQOZ.40.81.H04.1.454.CMB.1.raw
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcgggtgaaggtctcctgcaagtattctggaaaccacctgagcaactactacatacatggatgcggcacggccctggacgtaggggtttgaggtggtagtggggtgactaccgaaccctacgaggaggtggacaacgtaaagtatacggaactaacgtaacgtttcgagggcgaggtaccaccgagtcgaccgtgggacgtcgtcatcgacgcacgagtctacgntcgatcgngacgcggactcgacctntagacacgacggcagtctattacgtgtaggaacgtgtaggttggacggtcgtaccgggtcgggtacgtacggaccctgggtcggggtacccggg

SEQ ID NO: 99406 - DNA, 671 bp, Homo sapiens
  misc_feature: GYAE6OF01A8WMH.40.81.H04.1.454.CMB.1.raw
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
tcagtctagcgactcacgaccggtgctcgatttagtagtgtagattcgcgggggagcatcacccagcaaccacatctgtccttctagagaatcccctgagagctccgttcctcaccatggactggacctgggaggatcctcttcttggtggcagcagccgcaggacgcccactcccaggtgcagctggtgcagtcgnggggctggaggtgaagagccgtgggcctggtgagtctctgactaagtgtttcgaggaaaccnccgtagacgactaactacgtacactacacgtggatcggcggcgacggtcccgaggacggttaggggttacgaggtaggtaggtacggggtagactaccgaacccgtacggaggtacggtacggacaacgtaaaggtcgacggtaacgaacgttaacgtttacggacgggtaccgtacgggtaccaccgtacgtacggtaccggtacgggaccgtccgtaccacgtacgacgacgtacgacgtaccgtacgtagtacgtactcgtacggacggcgtacgtcgtaccgtacggtaccggacgtacgtaccggactcgtacgttacgtacggtaggtacggtacggtacggtacgggttcggaccggtaccggtaccgggacggtacgaacggcccggacggtcgggaacccggg

SEQ ID NO: 99407 - DNA, 717 bp, Homo sapiens
  misc_feature: GYAE6OF01END0O.40.81.H04.1.454.CMB.1.raw
  modified_base (357)..(357): a, c, t, g, unknown or other
  misc_feature (357)..(357): n is a, c, g, or t
tcagtctagcgactcacgaccggtgctcgatttagtagtgtagattcgcgggcgtagactttgtgtttctcgtagtctccctgctcagctccgtggggctgctaatgctctgggtctctggatccagtggggatattgtgatgactcagtctccacttcctccctcgcccgtcacctcctggagacgccgcctccatcctcctgcaggtctagtcagacgaccctacctaaaacactaatggactactacttctttagtaattcggtacctgcaagaacgccgaggcagtcctccacagtcttctgattagttagtttggggttcttacgtccggggtcccgttcccggggtacccngtacgtacggttcgaggtcggcgaggtggactcgagtcaacgtagttactttacacgtaagtaaaactcgacgtacgggtaggggtcggaaggcgaagaaggtatttggggttaggttaattttagtactgactagtactacccgtaaccttaaccgtaacgttaaaccgttgggttaacggtccgggtaacccgggggtacggaaacccggtaaacggggggtaacccaaagggggttaacggaaaacgttaccgtaaaggtaacccggtaaagggttcggtacgggaccgttccgaacccgttaaccgtacgtttcccgttaccgtttaccgtttctccccgttcccgttaccccccg

SEQ ID NO: 99408 - DNA, 719 bp, Homo sapiens
  misc_feature: GYAE6OF01DF4JG.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggactggaggatcctcttcttggtggcagcagccgcaggacgcccactcccgaggtgcagctggtgcagtcgtggggctggaggtgaagaagccgtggggcctcggtgaggtcctcctgacaagtactttacgtaggaaacctacccgtggaacgaccaaaaccttaactaacataaccgaacgtagggactggccgggaccgaacgggcccccgtaggggaccggtagggggttttggaggtgggaaggttggggggtacggacttacccgaaacccgtacgaaggacgggttcggaccaaacgaaaagtacgtaccggaaacaaggttaacctttcggaaggggccgtaaggggtaccaaccgtagtacggtaacccggtcggggaaccggtaccgtacccgaataccgtaacgacctaacgtaccggttaccttaaacgagttacggtacgttcgtagggaacgggtccgggtaacttcggacccgttacgtacggaaccgacgtaccgggacagtttacgtactcgtaggtaggtaagacgtaggttacgagtccggacgtccgggacggcgtacggccgtcgggtaccgggg

SEQ ID NO: 99409 - DNA, 830 bp, Homo sapiens
  misc_feature: GYAE6OF01EIF33.40.81.H04.1.454.CMB.1.raw
  modified_base (56)..(56): a, c, t, g, unknown or other
  misc_feature (56)..(56): n is a, c, g, or t
  modified_base (659)..(659): a, c, t, g, unknown or other
  misc_feature (659)..(659): n is a, c, g, or t
  modified_base (686)..(686): a, c, t, g, unknown or other
  misc_feature (686)..(686): n is a, c, g, or t
  modified_base (800)..(800): a, c, t, g, unknown or other
  misc_feature (800)..(800): n is a, c, g, or t
tcagtctagcgactcacgaccggtgctcgatttagtagtgtagattcgcgggggancatcacccagcaaccacatctgtcctctagagaatcccctgagagctccgttcctcaccatgactggacctggaggatcctctttcgttggtcgcaggcacggcccgcgacggacgccccactccccgaggtcgcgacgtcgtggtcgactggttccggtggggcttacggaggtagaaacgggtaacggtcccgggtggggtaccccttggggtacgtaacgggttcccttcccgtgggaaactaacggttacgtttaccgtaaaggaaaaccctcccgtagggaactacctaaaccttaaccgtaaattaaccgtacgtaaccgttagggtacgtccggacccggacggtaaccccggtcccggttacggggtaacggggttaggtttacgggaggttaggggtaggtaccggggttagaacccgtaccccgtaaacccgttaccggaggtacgggtaccgaacgaaacgtaaacgacgtaccggtaaacttaggtaaccgtttacggacggggtaacgtcgggtaacctaacggtgtacccgggtacgtacgggaaccgtcggttaaccctgaacggtaccgaccaaggttacgttaacngtaagtcgtaacgttcgagggacccgnggtaccgttccaacggttacggtacccgaagtcccggaagtccgtaggtaacttacgtaagggtccgtaaaggcgtaacgggtagttcggtacgggaccgacggtcccgggtanacgggtccccgtagggcccgggtaacccgg

SEQ ID NO: 99410 - DNA, 798 bp, Homo sapiens
  misc_feature: GYAE6OF01ATCQH.40.81.H04.1.454.CMB.1.raw
  modified_base (439)..(439): a, c, t, g, unknown or other
  misc_feature (439)..(439): n is a, c, g, or t
  modified_base (622)..(622): a, c, t, g, unknown or other
  misc_feature (622)..(622): n is a, c, g, or t
tcagtctagcgactcacgaccggtgctcgatttagtagtgtagattcgcgggggtgccctgagagcatcacccagcaaccacatctgtcctctagagaactcccctgagagcctccgttcctccaccagtggacgtggacctggaggatccttctttcgttggtcggcagcacgccgcgaggaccgccctacgtccccgaggtcgcagtcgttcggtgacgtagtccggtggggtctacggaggtaggaaaggaaccgccggttcggggcccgttcgggtacggtaacggttccgtcgtcgtacgtaaacgttacgtttacggacggaaacctacccggtaggtacgacctaaaccgttaactaacctaatacgtaacgtaggtaaccgtcggccggaccggaccgggtcccgtagggtaacggtgggttacggtaggnggttaggtcgggtacgaaccgtacccaaacgtccggaaggtcggtagaaccgtaagaaacgtacgtaccgaacgtaacgtttaacgggtcacgggtaacgacgttcccgaaaccggtagtccgggtaaaccggtcgggtaacccgtccgtaaggcccttagccgtaacacgttacgtacccgnttaacggacggttacgtcgtagggtaccgggaaccctttggacccgtaagtcccgggaacgtaacccgcggtaccgtagttacgttaggttaaccgttagtcggtaaacggttaggaacccggttttggggacgttacggggaacccccgtcccgggtagggtacccgtacccggg

SEQ ID NO: 99411 - DNA, 821 bp, Homo sapiens
  misc_feature: GYAE6OF01DU0WA.40.81.H04.1.454.CMB.1.raw
tcagtctagcgactcacgaccggtgctcgatttagtagtgtagattcgcgggcgtagactttgtgtttctcgtagtctccctgctcagctccgtgggctgctaatgctcgtgggtcctcgtggatccgagtgggtatagttgtcgatcgactcgagttcctcctacctcctcccgtcgccccgtctaccgttccgtggacgcggcccggtcccttccagttcctccgtggtacgacggttctacggtcaacggtacctacccgttaaccctaaaactaaccgttaaggtggtaaccttaacctttacgttcgtttaagtacgtttacggtaccgtagacgaacggaacgtaccgagggaccttaccgtccctacccgacgtcgtacgtttacgttagtaagtttacggttttacggtttcgggttttaccttacggtcccccggggtacccgttcccgggttcccgttaagtacggttcggttacgcggtcggacgttagtcggtacaccgttagaccgttaacggtagttaactttaccgaaacgttaataaagtcgtacggacgggtacgggtaggtacggacgtaaggaagttcggttaggttcgttaacgtttacgttcgtacgtactacgcgtaccctaacgttactaacggtaacgttcgggtaacggtacccgggtaaccgggtaccggtaaccggaacggtaaccggtaaaggtaacgtaacggtacggaacgtaacggtaaccgggttcgacggttcgcgaacccgtactacgttcccgtagtttacccttaccgaccgttccgttaacccg

SEQ ID NO: 99412 - DNA, 861 bp, Homo sapiens
  misc_feature: GYAE6OF01AX1TT.40.81.H04.1.454.CMB.1.raw
  modified_base (204)..(204): a, c, t, g, unknown or other
  misc_feature (204)..(204): n is a, c, g, or t
tcagtctagcgactcacgaccggtgctcgatttagtagtgtagattcgcggggactgatcaggactcctcagttcaccttctcacaatgaggctccctgctcagctccgtggggctgctaatcgctcgtgggtctcgtggactccgaggtggggattattgtgatgactcagtctccactctcccgtcgcccgtcaccttccgnggacgaccgtcccggcctccatcctccgtgaccgtacggtacctaggtaccaggtaccgtccccttaaccgtaaaaccacttaagtacggtaaccttaacccgttacctttacgttttaggtaaacgtttccgggtaaccctggaccgtaaggtaaccgacccggttaagggcccttaacggttccctaacccgacgtaccggttccgtttacgtttaggtaacgtttaagttttacggggtttccggggttttacgtttaacccgggtccccggggggttacccccggtttacccgggggttacccctaggggtaacccggtttacgggtttaccgtacgggttacggtaccgtaagggtcgtaacgtccgtaacgtacctagtacgtttaactttaccgaacgttaacgtaaacgtacggtacgggtagggtagggtacgggaacgcggtaaaggtaaccggtaggtttagggttaacggttacttttaacgtacgtcgaatacggtaccgtaaccggttaacctacgtaaccggtacgttacgggttacgggtaccgggtaccggtaaccgggacggtaaaccggggtaacggtagggtaaacgtaaccgtacggtaacggtacgtacggttcggtcgtaccgggtcctaaccg

SEQ ID NO: 99413 - DNA, 807 bp, Homo sapiens
  misc_feature: GYAE6OF01B58N7.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagcctccgtcctcaccagtggactggaccgtggaggactcctcttcgttgggtggcagcacgccgacgaggacgacccaccgtcccgaggtcgcagtcgtggtcgcgtgtcgtggggctggaggtagaacgaacgccgtggggtccgtaggtggtaacggtcctccctagtccgaaagttatttcgtaacgggaaaccacccgttagacgacctaaactactaaccaacttacggaacgtacgtaagcggaccggtaccgaccggggtaccccgttaggggaaccgttaggggggtttacgaacggggttaggtacgggtaggggtacggtaactaccctaaaccccgtaccgtaagggtaccgggtacggaaccgtaaacgtaaacgtacggttaaccggaacgtaaaccggttaaaccgtttaacgggaacgggttaccggtaacggggtaacctaaaccgtaaccgtaaccgggtaaccggtacgggggtaacgtacccggtacccgtaaccgtacgacgtaacccgtactaacggttactaacggtagtacgggtacgtaccggttacggaacggcccgggtaacgtacggtaccccggtacgtaccgggacccggtaaccgtaccgggtacttaccgggtaacttaggttaacggttaaccggg

SEQ ID NO: 99414 - DNA, 705 bp, Homo sapiens
  misc_feature: GYAE6OF01DMVFU.40.81.H04.1.454.CMB.1.raw
  modified_base (111)..(111): a, c, t, g, unknown or other
  misc_feature (111)..(111): n is a, c, g, or t
  modified_base (191)..(191): a, c, t, g, unknown or other
  misc_feature (191)..(191): n is a, c, g, or t
  modified_base (627)..(627): a, c, t, g, unknown or other
  misc_feature (627)..(627): n is a, c, g, or t
tcagtctagcgactcacgaccggtgctcgatttagtagtgtagattcgcgggcacgaccggtgctcgatttagtagtgtagattcgcgggagagcatcacccagcaaccanatctgtcctctagagaactcccctgagacgcttccgttctcaccagtggactggacctggagacttcctcgttcgttggngcagccacgccgacaggaccgcccacgtacccgagggtcgccgtagtcgtcgggtacacgtacggtcggttcggggacttggtaacgggtagaaaggaaccggttccggtacggggacccttgggtaacggtaacgtccgtaccgtagtaacgtaagtttcgttttaacgaaccggaaaccctaccggtagtacgaaccttaacgtacctacgtaactaccgtaaggcgaacgtcgccggaatcccggtccgtaaggtaaccggtttgggtaagcggtagggtaacggtcggggtaactaccgttaacccgaaacccgtttaggaggtacggtacgaactaaacggtattaacgcgaacgttacgtactacggagcgtaacgtacacgtacgtacgtaacccgtggaccctacgtacctaacgtcaagcccgtaanccgttactcgagttcgtaatcgacgtaggcttacgacgtgtaccgacgaccgtacgctaactcgtaatacgctaaggg

SEQ ID NO: 99415 - DNA, 847 bp, Homo sapiens
  misc_feature: GYAE6OF01BXHGM.40.81.H04.1.454.CMB.1.raw
  modified_base (141)..(141): a, c, t, g, unknown or other
  misc_feature (141)..(141): n is a, c, g, or t
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
tcagtctagcgactcacgaccggtgctcgatttagtagtgtagattcgcgggggagagcatcacccagcaaccacatctgtccctctagagaatcccctgagagctccgttcctcaccatggactggacctggagatcctnttcttggtggcagcagccgcaggagcccactcccaggtcgcagctggtncagtcgtgggctgaggtnaagacgccgtgggcctggtagaacggtctcgtagactaagtatttacgacggaaactacccgtagacgacctaactaactaacataccgaactggactacggtaccggcgtaaccggtcccgtggaacggttacggggtttagacgggttagggtacggttagggggtacgtaacgttaccgtaaaccccgtaacggacggtaacgggtacggacgtaaaaccgtaaaacggttacgtaaccgaacgtaaacgggtaaccgttttacgggacggggtaccgtaacggggtttaccaacccggtaacgtttacccgggtaccggttaacggggaacccgtaccggtaccctaaagtaccgtaaacggtaccgaaccgtaacggtttaaccgtaaccggttaagttacgggtaactttaccggaacgggtaccggggttacgggtaacccggttacggtaaccccggttaacggttaccgggaaacccggttaacgaaccgtaaccggtagttaacggttaaccgttaacggtaggtaacgggtaacgtaacgggttaaccgggtttacggaaccgggttacccgtaaccgggggtcccggggttaactaccgggaaccggttcccgggtaacccgggggg

SEQ ID NO: 99416 - DNA, 506 bp, Homo sapiens
  misc_feature: GYAE6OF02IYO9N.40.81.H04.1.454.CMB.1.raw
  modified_base (461)..(461): a, c, t, g, unknown or other
  misc_feature (461)..(461): n is a, c, g, or t
  modified_base (498)..(498): a, c, t, g, unknown or other
  misc_feature (498)..(498): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacagggggtttgagtggatggggtggatcaacctaccagaggtggcacaaagtatcgacagaactttcagggcagggtcaccatgacctgggacgcgtccatcagcacagtctacatggatctgagcgggactggcctagcgacgactacggcatgattacngtggaagagagttgtggctaccggcgggctcgaccgngtacgggg

SEQ ID NO: 99417 - DNA, 731 bp, Homo sapiens
  misc_feature: GYAE6OF02H07ZB.40.81.H04.1.454.CMB.1.raw
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (706)..(706): a, c, t, g, unknown or other
  misc_feature (706)..(706): n is a, c, g, or t
tcagtctagcgactcacgaccggtgctcgatttagtagtgtagattcgcgggggtgggcccgtagagagcattcgaccccagcgaaccacagtactcgtcctctagagaacttcccctgtacgacgctccgttcctcaccgatcggactggaccctggaggatacctcttcttggtggcagctagcccgcacggacgcccactcccaggtgccaggactggtcgccagtctgggctggacggtgaagaagctggggcctggtgaagtcnctgcaagnttcnggaacnccgtgaggcaacctacgtacactacactgatgcgcaggcccctggacgacggggtttgaggttcggaagtcggggtaggtactccgtaacccgtaccgaaggtaggggttcgggacgaaccgaaaaggttacgttaccggaacctaacggtaaccttttaccgaaggggtccaagggggttcccaaacccggtaacgttacgggaaaccccgttgggggaaaccggaccggttacccgtaaggttaccttaaacggtccgtaacgtacgttaccgttaaccgaagtccggggtaattaccgtttacggaacgggtcccggggtcccgttacggggtacccgtaaaccgggggttccggaacccggaaagggttaacccgggtagggtacggacggtaacgtaaccgaacgtacgtaggngacgacgacgacgtacgtcgtgtcg

SEQ ID NO: 99418 - DNA, 509 bp, Homo sapiens
  misc_feature: GYAE6OF02JAM4Q.40.81.H04.1.454.CMB.1.raw
  modified_base (438)..(438): a, c, t, g, unknown or other
  misc_feature (438)..(438): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagctgggtggaggcagaagatgttgggtatttattactgctatgactaacctntaacaaactgtagtggacggtcggccgaagggaccaagggtaggaaatcgaaggcgaactggtggctgacc

SEQ ID NO: 99419 - DNA, 509 bp, Homo sapiens
  misc_feature: GYAE6OF02HR0GV.40.81.H04.1.454.CMB.1.raw
  modified_base (488)..(488): a, c, t, g, unknown or other
  misc_feature (488)..(488): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccagtgtattactgtggaagagacggttggnggcgtaccggcggggctacgg

SEQ ID NO: 99420 - DNA, 510 bp, Homo sapiens
  misc_feature: GYAE6OF02IMIHJ.40.81.H04.1.454.CMB.1.raw
  modified_base (405)..(405): a, c, t, g, unknown or other
  misc_feature (405)..(405): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtcatcagcacngtctacatggatctgagcggactgacctcgtgacgacacggccatgtattactgtggaagagacggttggtggctaccggcggggctggaccacgtggggacccg

SEQ ID NO: 99421 - DNA, 513 bp, Homo sapiens
  misc_feature: GYAE6OF02FT409.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagtattttacactagaaaatcagcagggtggaggcagaagatggttgggtatttattactgacatgactaaccttctaacaaactgtgtggacggtcggaccgaagggaccaagggtagaaatcgaagcgaacgtgtaggctgacc

SEQ ID NO: 99422 - DNA, 511 bp, Homo sapiens
  misc_feature: GYAE6OF02JAYPB.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcacatgacctgggacgcgtccatcagcacagtctacatggatctgagcggactgacctctgacgacacggccatgtattactgtggaagagacggttggtggcgtaccggcggggctggaccgacgtggggacccgg

SEQ ID NO: 99423 - DNA, 511 bp, Homo sapiens
  misc_feature: GYAE6OF02HRO6A.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtcatcagcacagtctacatggatctgagcggactgacctctgacgacacggcagtgtattactgtaggaagagacgttggtggcgtaccggcggggctggacccacgtggggacccg

SEQ ID NO: 99424 - DNA, 512 bp, Homo sapiens
  misc_feature: GYAE6OF02F6I6J.40.81.H04.1.454.CMB.1.raw
  modified_base (462)..(462): a, c, t, g, unknown or other
  misc_feature (462)..(462): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcacatgacctgggacgcgtccatcagcacagtctacatggatctgagcgggactggacctacgtcgacgacacggcagtgtattacngtggaagagtacgttggtggcgtacggcgggcttggacctagtgggaccg

SEQ ID NO: 99425 - DNA, 506 bp, Homo sapiens
  misc_feature: GYAE6OF02GXBWU.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagagcctacctaaacactaatggatactactctttgaattggtacctgcagaagccgagggcagtctccacagctcttgatatagttggggttcttagtcgggcctccggggtcctgactaggttcagtggcagtgatcagtcacagtatttacatagaaatcagcgagggtggagcagaagatggttggtatttattactgactagtcgactaacctctaacaaatgtgtggacgtcggacgaaggaccaggtagaatcgaagacgacgtggcgcgtgac

SEQ ID NO: 99426 - DNA, 502 bp, Homo sapiens
  misc_feature: GYAE6OF02IN1SK.40.81.H04.1.454.CMB.1.raw
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcacatgacctgggacncgtccatcagcacagtctacatggatcngagcggactgacctctgacgactacggccaatgattactgtaggagagacgttggtgctaccggcgggctaggccatcgggg

SEQ ID NO: 99427 - DNA, 506 bp, Homo sapiens
  misc_feature: GYAE6OF02JGVD1.40.81.H04.1.454.CMB.1.raw
  modified_base (421)..(421): a, c, t, g, unknown or other
  misc_feature (421)..(421): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttagtcgggcctccggggtccctgacaggttcagtggcagtggatcagtcacagtattttacactgaaaatcagcagggtgaggcagaagatgttgggatttatactgnatgcaactctaacaaactgtgtggacggtcggaccgaagggaccaagggtaggaaatcgaagcgaacgtggtggctggcactacg

SEQ ID NO: 99428 - DNA, 509 bp, Homo sapiens
  misc_feature: GYAE6OF02FXA7M.40.81.H04.1.454.CMB.1.raw
  modified_base (489)..(489): a, c, t, g, unknown or other
  misc_feature (489)..(489): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctacagaggtggcacaaagtatcgacagaactttcagggcagggtcaccatgactgggacgcgtccatcagcacagtctacatggatcgtgagcgggactggacctagtcgacgacacggccagtcgtaattactgtggagagacgttggnggcgtaccggcgggctacgg

SEQ ID NO: 99429 - DNA, 513 bp, Homo sapiens
  misc_feature: GYAE6OF02JB775.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatcccctgcaggtctagtcagagcctcctaaacactaatggatactactctttgaattggtacctgcagaagccagggcagtctccacagctcttgatatattggggttcttatcgggcctccggggtcctgacaggttcagtggcagtggatcagtcacagtatttacactagaaaatcagcaggggtgaggcagaagatgttgggatttatactgcatgactaacctctaactaactgtgtaggacggtcggaccgaagggaccaagggtgaaatcgaagcgaactggtggctgcaccatctgtcttcattcctcccgtac

SEQ ID NO: 99430 - DNA, 510 bp, Homo sapiens
  misc_feature: GYAE6OF02I33JY.40.81.H04.1.454.CMB.1.raw
  modified_base (386)..(386): a, c, t, g, unknown or other
  misc_feature (386)..(386): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatattggggttcttatcgggcctccggggtccctgacaggttcagtgcagtggatcagtcacagatttacactgaaaatcagcaggtgagcagaagntgtgggactttatactgcatgcaactctacaaacgtgtgtggaacggttcggacctaaagggacccaaaggtggaaaatcgaagcgaactggtaggctgcaccatctgtcttcattcctacccg

SEQ ID NO: 99431 - DNA, 515 bp, Homo sapiens
  misc_feature: GYAE6OF02HEE8O.40.81.H04.1.454.CMB.1.raw
  modified_base (418)..(418): a, c, t, g, unknown or other
  misc_feature (418)..(418): n is a, c, g, or t
  modified_base (455)..(455): a, c, t, g, unknown or other
  misc_feature (455)..(455): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcgaggcagggtcacatgactgggacgcgtccatcagcacagtctacatgatntgagcggactggacctagtcgacgacgacggccagtntatactggtaggaagaggtacgttggaggcgtaccggcgggtactcggaccgagtcgggg

SEQ ID NO: 99432 - DNA, 517 bp, Homo sapiens
  misc_feature: GYAE6OF02IWHQ9.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagtctcctaaacactaatggatactactctttgaattggtacctgcagaagccagggcagtctccacagctcttgatatattgggttcttatcgggcctccggggtccctgacaggttcagtggcagtggatcagtcacagtattttacactagaaatcagcagggtggaggcagaagatgttgggtatttatactgcatgacaacctctaacaaactgtagtggacggtcggaccgaagggaccgaagggtaggaaatacgaaggacgaactggtacggcgtgaccacctacg

SEQ ID NO: 99433 - DNA, 512 bp, Homo sapiens
  misc_feature: GYAE6OF02J1ZD7.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtgggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactagaaatcagctgggtagaggcagaagattggttagggtatttagttactgacatgctaaccttctaactaaactgtgtggacggtcggccgaagggccaaggtaggaaatcgaaggcgaacgtgtcggtctgacc

SEQ ID NO: 99434 - DNA, 686 bp, Homo sapiens
  misc_feature: GYAE6OF02I7W7A.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccaggtggggatattgtgatgactcagtctccactctccctgcccgtcactcctggagagccggcctccatctcctgcaggtctagtcagagcctacctaaacactaatggatactactctttagaattggtacctgcagaagccgagggcagtctccacagctctgatatagttggggttcttagtccgggcccgtcccggggtccctgtactaggttcaggtggcaggtggatcagtcacagtatttacactagaaaatcgagcgagggtggaggacgaaggaagagttaggttagggtaattttaattacgtgactagttacgacctaaacccttactaaaccgtaaaacgttggttacgggttacggggtaccggggttaccgggacccggtaaaacgggggaacccgtaaaagggggttaacgggaaaacttaccgggaaacggtaccggtaaaccggtttagggttacgggtacccgttacgggaccctaacccgttaacgtttacccgtttacgggtttaccctttaccgttaccgtttcccccgtttaacccccgg

SEQ ID NO: 99435 - DNA, 510 bp, Homo sapiens
  misc_feature: GYAE6OF02G6CHK.40.81.H04.1.454.CMB.1.raw
  modified_base (420)..(420): a, c, t, g, unknown or other
  misc_feature (420)..(420): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcacatgacctgggacgcgtccatcagcacagtctacatggatcngagcgactgacctctgacgacacggccatgtatactggtggaagagtacgttggcggtcgtaccggcggggctcggaccgacgtcggggg

SEQ ID NO: 99436 - DNA, 507 bp, Homo sapiens
  misc_feature: GYAE6OF02G9LO3.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcaccatgactgggacgcgtcatcagcacagtctacactggatctgagcggactgacctcgtgacgacacggccatgtattactggtggaagagacgttggtggcgtaccgcgggctcggaccagtacgggg

SEQ ID NO: 99437 - DNA, 502 bp, Homo sapiens
  misc_feature: GYAE6OF02G3WM3.40.81.H04.1.454.CMB.1.raw
  modified_base (391)..(391): a, c, t, g, unknown or other
  misc_feature (391)..(391): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggccctcggtgaaggtctcctgcaagatttctggaaacaccctgagcaactactacatacactggatgcggcaggcccctggacaggggtttgagtggatggggtggatcaacctaccagaggtggcacaaagtancgacagaactttcgagggcagggtcaccatgaccgtgggacgcgtcatcagcacagtctacatgatctgagcggactggacctacgtcgacgacgacggcatgtatatagg

SEQ ID NO: 99438 - DNA, 518 bp, Homo sapiens
  misc_feature: GYAE6OF02I1SG6.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctcacagctcttgatatattgggttcttagtcgggcctccgggtccctgacaggttcagtggcagtgatcagtcacagtattttacactagaaatcagcgagggtggaggcagaagtagtgttgggtatttagtactgcagtcgactaacctctaactaacgtgtcggtaggacggtacggacgaagggaccgaaggtagaaatcgaagcgaacgtcggtggctcgacactacg

SEQ ID NO: 99439 - DNA, 506 bp, Homo sapiens
  misc_feature: GYAE6OF02F25HP.40.81.H04.1.454.CMB.1.raw
  modified_base (466)..(466): a, c, t, g, unknown or other
  misc_feature (466)..(466): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcacatgacctgggacgcgtcatcagcacagtctacatggatctgagcggactgacctcgcgacgacacggcaatgtatactggtagaagganacggttggtggcgtacggcgggctggaccacgtgggaccg

SEQ ID NO: 99440 - DNA, 486 bp, Homo sapiens
  misc_feature: GYAE6OF02HTK7S.40.81.H04.1.454.CMB.1.raw
  modified_base (429)..(429): a, c, t, g, unknown or other
  misc_feature (429)..(429): n is a, c, g, or t
  modified_base (464)..(464): a, c, t, g, unknown or other
  misc_feature (464)..(464): n is a, c, g, or t
  modified_base (468)..(471): a, c, t, g, unknown or other
  misc_feature (468)..(471): n is a, c, g, or t
  modified_base (473)..(486): a, c, t, g, unknown or other
  misc_feature (473)..(486): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctgggggctgaggtgaagaagcctggggcctcggtgaaggtctcctgcaagatttctggaaacaccctgagcaactactaaatacactggatgcgcaggcccctggacgaggggtttgagtggagtggggtggatcaacctacagaggtgacacaaagtatcgaacagtaactttcagggcagggtacacatagaccgtagggacgcgtaccatcagcacagtactacatggatcngaggcggctggacgaaagggcgacgtaagtacggncgannnngnnnnnnnnnnnnnn

SEQ ID NO: 99441 - DNA, 508 bp, Homo sapiens
  misc_feature: GYAE6OF02HVJGZ.40.81.H04.1.454.CMB.1.raw
  modified_base (339)..(339): a, c, t, g, unknown or other
  misc_feature (339)..(339): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccgggtccctgacnggtcagtggcagtggatcgagtcacagattttacactgaaaatcagcagggtgaggcagaagatgttggatttattactgcatgacaacctctaacaaactgtagtggacggtcggaccaagggaccaaagggtggaaagtcgaagcggaactggtggactgactaccg

SEQ ID NO: 99442 - DNA, 500 bp, Homo sapiens
  misc_feature: GYAE6OF02GAZXE.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggagtggggtgatcaacctacagaggtgcacaaagtatcgacagaacttcaggcaggtcaccatcgaccgtgggacgcgtccatcagcacagtctacataggatctgagcggctggacctcgtcgacgacgacggccatcgtatactagg

SEQ ID NO: 99443 - DNA, 535 bp, Homo sapiens
  misc_feature: GYAE6OF02G0995.40.81.H04.1.454.CMB.1.raw
  modified_base (181)..(181): a, c, t, g, unknown or other
  misc_feature (181)..(181): n is a, c, g, or t
  modified_base (236)..(236): a, c, t, g, unknown or other
  misc_feature (236)..(236): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtnactcctggagagccggcctccatctcctgcaggtctagtcagagcctcctaaacnctaatggatactactcttgaattggtacctgcagaagccagggcagtctccacagctcttgactatattggggttcttatcgggcctccggggtcctgacaggttcagtgcagtgatcagtcacgtagtattttacactagaaatcagcgagggtggagcagaagtatggttggtatttagtactgctagtcgactaacctgtaacaaacgttgtacggtggaccgtcggacctaagggtacctaagggtacggtaaactacgtaagacgtacgtcggtacggacgtggccaccgtacg

SEQ ID NO: 99444 - DNA, 526 bp, Homo sapiens
  misc_feature: GYAE6OF02I2Z4B.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattgggttcttatcgggcctcgggtccctgacaggttcagtggcagtggatcagtcacagtattttacactagaaaatcagcgagggtggaggcagagatgttggatttatactgcatgacaacctctaacctaaacgtggttagtgggtacggtcggaccgaaggggaccctaaagggtggaaaagtcgaaaggcgtaacgttggaggtctcggctaaccg

SEQ ID NO: 99445 - DNA, 520 bp, Homo sapiens
  misc_feature: GYAE6OF02FWYXE.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacggtcgaccgacacggccatgtattacgtggtggaagagtacggttggtggcgtaccggcggggctcggaccacgtcgggg

SEQ ID NO: 99446 - DNA, 517 bp, Homo sapiens
  misc_feature: GYAE6OF02F88RS.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcacatgacctgggacgcgtccatcagcacagtctacatggatctgagcgggactggacctagtcgacgacacggccagtgtattacgtgtaggaagagacgttggtggcgtaccggcggggctggacctacgtgggacccgg

SEQ ID NO: 99447 - DNA, 507 bp, Homo sapiens
  misc_feature: GYAE6OF02GZLMX.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtcctgacaggttcagtggcagtggatcagtcacagattttacactgaaaatcagcagggtggaggcagaagatgttgggatttatactgcatgcaacctctaacaaactgtgtggacggtcggaccgaagggaccaagggtaggaaatcgaagcgaacgtggtaggctgccacctacg

SEQ ID NO: 99448 - DNA, 538 bp, Homo sapiens
  misc_feature: GYAE6OF02HSPBQ.40.81.H04.1.454.CMB.1.raw
  modified_base (253)..(253): a, c, t, g, unknown or other
  misc_feature (253)..(253): n is a, c, g, or t
  modified_base (476)..(476): a, c, t, g, unknown or other
  misc_feature (476)..(476): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttctggaaacncctgagcaactactacatacactggatgcggcaggcccctggacgtaggggtttgaggtggagtggggtggatccaacctaccgaggaggtggacaacgaaagtatacgaacagtaactttcgagggcagggtcaccagtcgacgtgggacgcgtccatcagcacagtctacagtggatcgtgagcggactggacctagcgacgacacggcagtgtattacgngtaggaagtaggtacgtggtacggccgtaccggcgggtactcggacctacggtcgggaccgg

SEQ ID NO: 99449 - DNA, 522 bp, Homo sapiens
  misc_feature: GYAE6OF02G71CK.40.81.H04.1.454.CMB.1.raw
  modified_base (465)..(465): a, c, t, g, unknown or other
  misc_feature (465)..(465): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacgtgacgacgtacggccatgtattacgngtcggaagagtacgttggtacggcgtaccggcggggctggaccgacgtggggacccg

SEQ ID NO: 99450 - DNA, 568 bp, Homo sapiens
  misc_feature: GYAE6OF02JG3F7.40.81.H04.1.454.CMB.1.raw
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (428)..(428): a, c, t, g, unknown or other
  misc_feature (428)..(428): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggcctcggtgaaggtctcctgcaagattctggaaacaccctgagcaactactacatacactggatggcggcaggcccctggacaggggtttgagtggagtggggtgatcaacccgtacgagaggtcggacaacgaaagtntacganagaacttcgaggcagggtcacgatcgaccgtgggacncgtcatcagcacagtctacagtgatcgnggagcggaactcgaaccttcgtacgacgtacgacggaccagtaccgttattacgtggtaaggaaacggtagtaccggttagggtacgtaccggtaccccgggtcggggtacccgttacggacccgacgggttaccggggg

SEQ ID NO: 99451 - DNA, 521 bp, Homo sapiens
  misc_feature: GYAE6OF02GYLR9.40.81.H04.1.454.CMB.1.raw
  modified_base (464)..(464): a, c, t, g, unknown or other
  misc_feature (464)..(464): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcgagggcagggtcacatgacctgggacgcgtccatcagcacagtctacatggatcgtgagcggactggacctcgtcgacgacgacggcatgtattacgngtaggaagtagtacggttggtggcgtacggcggggctggacctacggtggggacccg

SEQ ID NO: 99452 - DNA, 567 bp, Homo sapiens
  misc_feature: GYAE6OF02GQH3H.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgattatattggggttcttatcgggcctccggggtccctgactaggttcagtcggctagtggatcagtcacgagtattttacacttagaaaattcgaagacgagggtggaggacaagaacgtatggttgggtatttattactgcagtgctaacctctaactaaactgtagtcggtacggtcggaccgaaacggggaccgtaaagggtacggaaacgttaccgaaacggtaccggtaacgttaggttacgggaccgtaggtaaccccg

SEQ ID NO: 99453 - DNA, 500 bp, Homo sapiens
  misc_feature: GYAE6OF02FH348.40.81.H04.1.454.CMB.1.raw
  modified_base (337)..(337): a, c, t, g, unknown or other
  misc_feature (337)..(337): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggctccggggtccctgacnggttcagtggcagtggatcagtcacagattttacactgaaaatcagcagggtggaggcagaagatgttgggatttattactgcatgcaacctctaacaaactgtgtgggacggtcggccaagggaccaagggtggaaatcgaagcgaactgtggctgcactac

SEQ ID NO: 99454 - DNA, 543 bp, Homo sapiens
  misc_feature: GYAE6OF02HYLWI.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttagtcgggcctccgggtccctgacaggttcagtggcagtgatcagtcacagtattttacactagaaaatcagcagggtggaggcagaagatggttgggtaatttattactgcagtgctaaacctctaacaaactgtaggtcgggacggtcggaccgaaagggaaccaaagggtaggaaatcgaaggacgaacgtggtacggctggaccaccacttcgtgttaccttctacttccttaccccg

SEQ ID NO: 99455 - DNA, 568 bp, Homo sapiens
  misc_feature: GYAE6OF02JMSO5.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagagccgtggggcctggtgaaggtctccgtgcaagatttcgtaggaaacacctgagcaactactacatacactggactgcggcacggcccctggactaggggtttgagtgggagtggggtggacttccgaaccctacgaggaggtggacaacaaagtatcgaacagaactttcgagggcagggtacactagtgaccgtgggaccgcgtacctatcgagcacgtacgtctaacagtcggatcgtgacggcggactcgaccgtgcgaacgacgacggactagtcgtaattcgaggttacggaacgtagtacggttggtacggtcgtaccgggcgggctacggtaaccgacggtcggggacccg

SEQ ID NO: 99456 - DNA, 509 bp, Homo sapiens
  misc_feature: GYAE6OF02G552I.40.81.H04.1.454.CMB.1.raw
  modified_base (467)..(467): a, c, t, g, unknown or other
  misc_feature (467)..(467): n is a, c, g, or t
  modified_base (492)..(492): a, c, t, g, unknown or other
  misc_feature (492)..(492): n is a, c, g, or t
tcagtctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtgatcaacctacagagtggcacaaagtatcgacagaactttcagggcagggtcaccgatgacctgggacgcgtcatcagcacagtctacatggatctgagcggactggacctcgtgacgacacgggccaagtcgtatactgtaggaagngtacgtggtgcgtaccggcgggtcnggaccacggtgggaccg

SEQ ID NO: 99457 - DNA, 529 bp, Homo sapiens
  misc_feature: GYAE6OF02HHKTP.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatatattgggttcttagtcggcctccggggtcctgactaggttcagtggcagtggatcagtcacagtatttacactagaaatcagcgagggtgaggcagaagagtgtaggtattatactgcatcgacaacctactaactaaacgtgtgtacggacggtacggaccgaagggaccgaagggtacggaaactcgaaggaccgtaacgtcggtacggctacggaccacctacg

SEQ ID NO: 99458 - DNA, 511 bp, Homo sapiens
  misc_feature: GYAE6OF02HXZUC.40.81.H04.1.454.CMB.1.raw
  modified_base (373)..(373): a, c, t, g, unknown or other
  misc_feature (373)..(373): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctgggggctgaggtgaagaagcctggggcctcggtgaaggtctcctgcaagatttctggaaacaccctgagcaactactacatacactggatgcggcaggcccctggacaggggtttgagtggatggggtggatcaacctacagaggtggcacaaagtatcgacagaactttnagggcagggtcacatgacctgggacgcgtccatcagcacagtctacatggatctgagcggactgacctcgtcgacgacgacggccatcgtaattactgtaggaagagacggttggtggcgtaccggcggggtctacgg

SEQ ID NO: 99459 - DNA, 533 bp, Homo sapiens
  misc_feature: GYAE6OF02GZWDP.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagaagcctggggcctcggtgaaggtctcctgcaagatttctggaaacaccctgagcaactactacatacactggatgcggcaggcccctggacaggggtttgaggtggagtggggtggatcaaccctacagaggtggcacaaagtatcgacagaactttcgagggcagggtcacgatgacctgggacgcgtccatcagcacagtctacagtggatcgtgagcggacgtcgacctacgcgacgacgaccggctagtgtacttacgtggtaggaagtagtacggttggtcggcgtaccggcgggtctcggaccgtacggtgggtacccgg

SEQ ID NO: 99460 - DNA, 545 bp, Homo sapiens
  misc_feature: GYAE6OF02GV5HC.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggagtggggtggatcaacctaccgagaggtggacacgaaagtatacgacagaactttcgagggcagggtcacatgaccgtgggacgcgtccatcagcacagtctacatggatcgtgagcggactcgacctcgacgacgacgacggccagtgttacttacgtggtaggaagtaggtacggtttaggtcggtccgtaccgggcgggtaccgtcggacccgtacggtaccggggg

SEQ ID NO: 99461 - DNA, 527 bp, Homo sapiens
  misc_feature: GYAE6OF02F0PTF.40.81.H04.1.454.CMB.1.raw
  modified_base (426)..(426): a, c, t, g, unknown or other
  misc_feature (426)..(426): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagccctacctaaaacactaatggatactactctttgaattggtacctgcagaagccagggcagtctccacagctcttgatatagttgggttcttagtcgggcctccgggtcctgactggttcagtggcagtgatcgagtcacagtatttacactagaaatcagcgagggtgaggcaagaagagtgttggtatttatactgnatgacctaacctctaacaaacgtgtagtggacggtcggaccgaagggaccgaagggtaggtaaacgtacgaagacgaacgtggtaggccgtagactaaccg

SEQ ID NO: 99462 - DNA, 532 bp, Homo sapiens
  misc_feature: GYAE6OF02I2GO4.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatattgggttcttatcgggcctccggggtcctgacaggttcagtggcagtgatcagtcactagattttacactagaaaatcagcgaagggtggaggcagaagatgttaggatttatactgcaatgacaaccttctaactaactgtagtcgggtaacggtcggaccgaagggtaacccgaagggtaggaaagtcgaaacggacgaacgtcggtaggacgtggaccactaacg

SEQ ID NO: 99463 - DNA, 552 bp, Homo sapiens
  misc_feature: GYAE6OF02H73M0.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattgggttcttagtcgggcctccggggtccctgacaggttcagtggcagtggatcagtcatagtatttacactagaaatcagcgagggtggaggcaggaagagtggttgggtatttagttactgacatagactaaccttctaacaaacttggtagtacgggacgggttaccggaccgaaacggggaaccgaaggggtacggtaaaacgtacgaaaggaccggaaacgttggtacggtcctaggacc

SEQ ID NO: 99464 - DNA, 511 bp, Homo sapiens
  misc_feature: GYAE6OF02F8TWZ.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcaccatgacctgggacgcgtccatcagcacagtctacatgatctgagcggactgacctgtcgacgacacggccagtgtattactggtggaagaggtacgttggtggctaccggcggggctcggaccacgtcgggg

SEQ ID NO: 99465 - DNA, 378 bp, Homo sapiens
  misc_feature: GYAE6OF02I6MLS.40.81.H04.1.454.CMB.1.raw
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (364)..(378): a, c, t, g, unknown or other
  misc_feature (364)..(378): n is a, c, g, or t
tcagtctagcgactcacgaccggtgctcgatttagtagtgtagattcgcggggatactactctttgaattggtacctgcagaagccagggcagtctccacagctcttgatatattggggtccttatcgggcctccggggtccctgacaggttcagtggcagtggatcagtcacagattttacactgaaaatcagcagggtgagcagaagatgttgggatttattactgcatgcaacctctacagactgtgtggacggtcggccaagggaccaaggtggaaatcaagcaactgtggctgcaccatctgtcttcatcttcccgcatctgaatcgctagactgacgcgggntggcaaggcncatagnnnnnnnnnnnnnnn

SEQ ID NO: 99466 - DNA, 531 bp, Homo sapiens
  misc_feature: GYAE6OF02I6YZZ.40.81.H04.1.454.CMB.1.raw
  modified_base (415)..(415): a, c, t, g, unknown or other
  misc_feature (415)..(415): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacgaggggtttgagtggagtggggtggatcaaccctacgagaggtggcaacaaagtatacgacagaactttgagggcaggtcaccatgaccgtggacgcgtccatcagcacagtctanagtgatcgtgagcggactcgactacgcgacgacgacggccagtgtagttacgtggtacggaagtacgtacggttggtgaccgtacggcgggtactcggaccgacgtggggacccgg

SEQ ID NO: 99467 - DNA, 576 bp, Homo sapiens
  misc_feature: GYAE6OF02HTHRX.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttggggttcttagtcgggccgtccggggtccctgacaggttcagtggcagtggatcagtcacagtatttacactagaaatcagcgtagggtggaggcgaagaagtagttggttagggtaattttagttactgactatgacctaaacctctaactaacgtgtaggtacggaccgggtacggaccgaaagggaaccgaaaggtaggaaacgtacgaacgacgtaacgtggtacggcgtcgaccgtaaccgtacgttcgtagttccttacgtacttccgttaccccg

SEQ ID NO: 99468 - DNA, 780 bp, Homo sapiens
  misc_feature: GYAE6OF02FFNU1.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagtatttctaggaaaccaccctgacgacaactactacatacacgtggatcggcggcgacggccccgtgggacgtaggggtttgaggtgggagtggggtgactaccgaacccgtaccgaggacggtacggaccaacgtaaaacgttacgtaccggaaacgtaacggtaaaccgttttacggaacgggggtccgtaacgggggttaccaacccgtacggtttaccggacccggtacgggggacccgtacccggttacccaacgttacccgaacgggtaccctaaaccgtaacggtttacccgttaaacgtaacggtttacggggaaactttcccgggttaacggggaccgggtacccggggttaaccgtaccggggtaaccccgttacgggtaacccggaaccggtaaccgtaaccggtaccgttaagttacgttaacgtttacggacggtacgggtaacggtacggtaaccgggttcgggtaccggtaccggtccgggacgggttacctacgggacccgtacgggtaccggggtaaccccggg

SEQ ID NO: 99469 - DNA, 511 bp, Homo sapiens
  misc_feature: GYAE6OF02JFJMW.40.81.H04.1.454.CMB.1.raw
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcaccatgacctgggacgcgtccatcagcacagtctanatggatcngagcggactgacctcgtcgacgtacgacggccatgtattactgtagaagagacgttggtgtcgtacggcgggctgaccgtacgtgggacccg

SEQ ID NO: 99470 - DNA, 519 bp, Homo sapiens
  misc_feature: GYAE6OF02IFRH7.40.81.H04.1.454.CMB.1.raw
  modified_base (435)..(435): a, c, t, g, unknown or other
  misc_feature (435)..(435): n is a, c, g, or t
  modified_base (501)..(501): a, c, t, g, unknown or other
  misc_feature (501)..(501): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctgggacaggggtttgagtggatggggtgatcaaccctaccagaggtggcacaaagtatcgacagaactttcgagggcagggtcaccatgacctgggacgcgtccatcagcacagtctacatgatctgagcggactgacncgtgacgacgacgcatgtatacgtgtggaacgtaggtacgttggtggtccgtaccggcgggtccgngtacccgcgtaccggggg

SEQ ID NO: 99471 - DNA, 504 bp, Homo sapiens
  misc_feature: GYAE6OF02IG94I.40.81.H04.1.454.CMB.1.raw
  modified_base (358)..(358): a, c, t, g, unknown or other
  misc_feature (358)..(358): n is a, c, g, or t
  modified_base (417)..(417): a, c, t, g, unknown or other
  misc_feature (417)..(417): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcgcaggcccctggacaggggtttgaggtggagtggggtggatcaaacctaccagaggtggacacaaagtatcganagaactttcgagggcagggtcacgatgacgtgggaacgtcgtccatcagcacagtctanagtggatctgagcggactggaccacgcgacgtacacggcangtatcngtgaaganagtgtagctacggnggatgacgtcgtggaccg

SEQ ID NO: 99472 - DNA, 556 bp, Homo sapiens
  misc_feature: GYAE6OF02HIU2S.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctaggaaacaccctgagcaactactacatacactggatgcgcacggcccctggacgaggggtttgaggtggagtggggtgatcgaacctacgaggacggtggacaacgaaagtagtacgacaagtaactttcgaggcgaggtcaccgatcgacgtggacgcgtaccatcagcacagtctagagtgaatcgtgagccggagtacgaccgtacgacggacgacgacggcagtcgtatacgtgtacggaagtaggtacgttagggcgtacgtaccgggacggtccgtacggaccgacgggtccgggaacccggg

SEQ ID NO: 99473 - DNA, 545 bp, Homo sapiens
  misc_feature: GYAE6OF02HOZSY.40.81.H04.1.454.CMB.1.raw
  modified_base (290)..(290): a, c, t, g, unknown or other
  misc_feature (290)..(290): n is a, c, g, or t
  modified_base (342)..(342): a, c, t, g, unknown or other
  misc_feature (342)..(342): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagagcctcctaaacactaatggatactactctttgaattggtacctgcagaagccagggcagtcnccacagctcttgatatattggggttcttagtcggcctccggggtccctgacnggttcagtggcagtggatcagtcacagtattttacactagaaaatcagacgagggtggaggcagaagatggtagggatttattactgacagtgacaaccttctaaacaaactgtagtcggacgggttcggaccggtaaagggaccgtaaagggtaggaaacgtcgaaacggtccggtaaacgttgggtacggccttggaaccc

SEQ ID NO: 99474 - DNA, 505 bp, Homo sapiens
  misc_feature: GYAE6OF02IHZXC.40.81.H04.1.454.CMB.1.raw
  modified_base (421)..(421): a, c, t, g, unknown or other
  misc_feature (421)..(421): n is a, c, g, or t
  modified_base (452)..(452): a, c, t, g, unknown or other
  misc_feature (452)..(452): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactccccaggtgcagctggtgcagtctggggctgaggtgaagaagcctggggcctcggtgaaggtctcctgcaagatttctggaaacaccctgagcaactactacatacactggatgcggcaggcccctggacaggggttgagtggagtggggtgatcaaccctaccagaggtggcacaaagtatacgacagaactttcgagggcagggtcacangaccgtgggacgcgtcatcagcacagtctanatggatctgagcggactgaccgtcgtcgacgacgacggccagtgtacgtatgg

SEQ ID NO: 99475 - DNA, 512 bp, Homo sapiens
  misc_feature: GYAE6OF02F07R9.40.81.H04.1.454.CMB.1.raw
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
  modified_base (506)..(506): a, c, t, g, unknown or other
  misc_feature (506)..(506): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggagtggggtggatcaacctacagaggtggcacaaagtatcgaacagaactttcgagggcagggtacaccatacgaccgtgggacgcgtccatcgagcacagtctaacatcggatcgtagagcggactgacctacgcgacgacacgcatgtatctagngaagngtacgttgnggctaccggngggctcggacngtcggg

SEQ ID NO: 99476 - DNA, 517 bp, Homo sapiens
  misc_feature: GYAE6OF02GRUA7.40.81.H04.1.454.CMB.1.raw
tcagtctagcgactcacgaccggtgctcgatttagtagtgtagattcgcgggcgtagacttcgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttggggttcttagtcgggcctccggggtccctgacaggttcagtggcagtggatcagtcacagtattttacactagaaatcagcgagggtggaggcagaagagtggttagggtatttagttactgcatgacaacctctaacaacttgtgtggacggtcggaccgaagggaccgaaggtagaaagtcgaagcgaagtgtgctgcacatctgtcttcactcctcccg

SEQ ID NO: 99477 - DNA, 524 bp, Homo sapiens
  misc_feature: GYAE6OF02FKYLE.40.81.H04.1.454.CMB.1.raw
  modified_base (274)..(274): a, c, t, g, unknown or other
  misc_feature (274)..(274): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtgggatattgtgatgactcagtctccactctccctgcccgtcactcctggagagccggcctccatctcctgcaggtctagtcagagcctcctaaacactaatggatacctactctttgaattggtacctgcanaagccaggcagtctccacagctcttgatatattggggttcttagtcgggcctccggggtccctgacaggttcagtggcagtggatcagtcacagtatttacactagaaaactcagtctgggtgaggcagagattgttagggtatttattactgactatcgacaaccttctaacaaactgtgtggacggtcggaccgtaaagggacccgaaagggtggaaactcgaacggcgaaacgtggtcggctggacc

SEQ ID NO: 99478 - DNA, 579 bp, Homo sapiens
  misc_feature: GYAE6OF02HGQ25.40.81.H04.1.454.CMB.1.raw
  modified_base (369)..(369): a, c, t, g, unknown or other
  misc_feature (369)..(369): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactcttgaattggtacctgcagaagccaggcagtctccacagctcttgatatagttggggttcttagtcgggcctccggggtccctgactaggttcagtggcagtggatcagtcanagtattttacactagaaatcagcgagggtaggagacgaagaagtagttggttagggtatttagttacgtgtactagtcgacctaaccttactaactaaacgtgttaggtacgggtaccggtaccgggaccgaaacgggtaacccgtaaagggtaacggtaaacgtacgaaacggtacgtaaaccgttaggtacggtccgtaggtaacccg

SEQ ID NO: 99479 - DNA, 766 bp, Homo sapiens
  misc_feature: GYAE6OF02JBW00.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcgcacggccctggactaggggtttgagtggagtggggtggataccgaacccgtaccgaggaacgggttcgggacgaaacgaaaaggttacgtaccggaaaccgaaggttaaaacccgttttcgaacggggggtaccaacggggggtttacccaaacccgtaaggttacggaaccccggttagggggtaaccgtacccggttacccgaacgttacgaacggccgaaaccgtacggtaccttaacgaacgttcgggtaagttacccgtaggtaccgggacccgggtaacgttaccggtaacccttaccggttacggaaacccgggttaaccgaaccggggtaccccgaagtttaaccgggtttaaacttaaccgttaggggttaaacgggaaaccggtaaagggttaccgggttttaacggggttccgggtaacccggtttaaccccggggcggggggttacccttaacccggggg

SEQ ID NO: 99480 - DNA, 563 bp, Homo sapiens
  misc_feature: GYAE6OF02H8MKH.40.81.H04.1.454.CMB.1.raw
  modified_base (228)..(228): a, c, t, g, unknown or other
  misc_feature (228)..(228): n is a, c, g, or t
  modified_base (555)..(555): a, c, t, g, unknown or other
  misc_feature (555)..(555): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagngcctactaaacactaatggatactactcttgaattggtacctgcagaagccgaggcagtctccacagctcttgatattagttggggttcttagtcgggccgtcccggggtcctgacgaggttcaggtggcagtgatcagtcatagtattttacactagaaatcagcgagggtggaggacgaaggaagtagtggttaggtatttaattagtagtactagtcgacctaaccttactaacgtaaacgtggtagtaggacggtccggaccggaagggaaccgtaagggtacggtaaactacgaacgaccggtaacgtacggtaggtaccgngtaacccg

SEQ ID NO: 99481 - DNA, 524 bp, Homo sapiens
  misc_feature: GYAE6OF02IK8DI.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcgggtgaaggtctcctgcaagatttctggaaacaccctgagcaactactacatacactggatgcggcaggcccctggacaggggtttgagtggagtggggtggatcaacctacgagaggtgcacaagtatcgacagaactttcagggcagggtcacatgacgtgggacgcgtcatcagcacagtctacgatggatcgtgagcgactgacctcgtacgacgacgacgccagtacgtattacgtgtaggaagaggtacgttggtggtccgtaccggcggggtctcggacccgaggtaccgggg

SEQ ID NO: 99482 - DNA, 897 bp, Homo sapiens
  misc_feature: GYAE6OF02GJHTV.40.81.H04.1.454.CMB.1.raw
tcagtctagcgactcacgaccggtgctcgatttagtagtgtagattcgcgggggatcaggactcctcagttcaccttctcacaatgaggccctcctgctcagctccgtggggctgactaatgctcgtgggtctcgtggactccgagggtggggattagttggtgtagtcgtacctcgtacgttcctaccctaccttcccttcccctcggtccccgtacctacccttcccgtagggaacggaccggcccccggtccctaccctacttccctccgtcggaccgtacgggttaccttacgtaccgaggaccgtccccttaaaccctaaaacctaacgttaaagtacggtaacttaacccttaccttttaccgttttaaggttaaacgttttaccgggttaaccccttacggaccgaaaggaaccggacccggagggaccgtacggttccctacccaacgacgtcctttacgttagtaattaagtttagggttttcggggtttactttacgggtcccggggtccccgggttccccgggggttccctacggtaaccggttacgggttacgtacgggtcggtacggtagggtacggtactacgtacgtaccgtaacgtaagtttaacttttaaccgaacgttaaacgtaaactcggaacggtacggggtaaggggtaggggaacggaacggaaaggtaacggttaggttgggttttaaggtttaattttacgttacggtacgtacgtagttaccgtaacccttaaccgttacgtaaaccgttaacgttgggtaccgggtaacggggtaccgggtaccggaaccgggtaacgggtaaccggtaagggtaaacgtaacggtacggaaggtaccggtagtgggtccgacgtacgtaccgtacctcg

SEQ ID NO: 99483 - DNA, 555 bp, Homo sapiens
  misc_feature: GYAE6OF02J2ITC.40.81.H04.1.454.CMB.1.raw
  modified_base (393)..(393): a, c, t, g, unknown or other
  misc_feature (393)..(393): n is a, c, g, or t
tcagtctagcgactcacgaccggtgctcgatttagtagtgtagattcgcgggggactgatcaggactcctcagttcaccttctcacaatgaggctccctgctcagctcctgggctgctaatgctctgggtctctggatccagtggggatattgtgatgactcagtctccactcgtccctgcccgtcactcctggagagccggcctccatctcctgcaggtctagtcagagcctacctaaacactaatggatactactctttgaattggtacctgcagaagccagggcagtctccacagctcttgactatagttggggttctagtcgggcctccggggtcctgactaggtcaggtgcagtggatcgagtcacgagtactttacactagaaactnagtcgtgggtagaggtcaggtagtagttggtagggtatttagttacgtgactagtcgactaaccttactaacgtaaacgtgttaggtaggacggtacggaccggtaaacgggaccgaaagggtacggtaaacgtcgaacgacggaacgtgtacggctgaccg

SEQ ID NO: 99484 - DNA, 516 bp, Homo sapiens
  misc_feature: GYAE6OF02H53IU.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatatttggggttcttagtcgggcctccgggtccctgacaggttcagtggcagtgatcagtcacagtattttacactagaaaatcagcgagggtggaggcaagaagattgttgggtatttatactgcatgacaacctctaacaaactgtagtggacggtcggacgaagggaccaaggtcggaaatacgaagcgaactggtaggctcgactaacc

SEQ ID NO: 99485 - DNA, 507 bp, Homo sapiens
  misc_feature: GYAE6OF02I8XUK.40.81.H04.1.454.CMB.1.raw
  modified_base (451)..(451): a, c, t, g, unknown or other
  misc_feature (451)..(451): n is a, c, g, or t
  modified_base (498)..(498): a, c, t, g, unknown or other
  misc_feature (498)..(498): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctacagaggtgcacaaagtatcgacagaactttcaggcaggtcacatgactggacgcgtcatcagcacagtctacatggatctgagcggactgaccgtacgtcgacgactacggcatgtatcnggtaggaagtagacggtggtcggactacggcgggtctggacctacgngggtaccgg

SEQ ID NO: 99486 - DNA, 565 bp, Homo sapiens
  misc_feature: GYAE6OF02HYHZO.40.81.H04.1.454.CMB.1.raw
  modified_base (384)..(384): a, c, t, g, unknown or other
  misc_feature (384)..(384): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagtctccactctccctgcccgtcactcctggagagccggcctcatctcctgcaggtctagtcagagcctacctaaacactaatggatactactctttgaattggtacctgcagaagccagggcagtctccacagctcttgatattagttgggttcttagtcgggccgtccggggtccctgacaggttcaggtggcagtggatcagtcacagtatttacactanaaatcagcgtgggtggaggcaagaagattaggttggtatttattacgtgtactagtgtacctaacctactaacaaacgtgttagtcggacgggttccggaccgtaaaggggaacccgtaaagggtacggtaaaacgtacgaaacggtacggtaaaccgttaggtcggtacgtcgtaacccg

SEQ ID NO: 99487 - DNA, 585 bp, Homo sapiens
  misc_feature: GYAE6OF02JYJ43.40.81.H04.1.454.CMB.1.raw
  modified_base (432)..(432): a, c, t, g, unknown or other
  misc_feature (432)..(432): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaacaccctgagcaactactacatacactggatgcggcacggcccctggaccgaggggtttgaggtggagtggggtgataccaaccctacgaggaggtggacaacaaagtactcgaacagtaacctttcgagggcgaaggggtccacgagtacgaccgtgggacgcgtaccatccgagtccaanacgtctacagtcggactgtggagcggatcggacctagcgaccgacacggcctagtgttacttacgtagtacgggaaagtcggtacggttagggtcggtaccggtaaccgggtcggggtaccacgggtaacccgtcgggtaccgggaacccggg

SEQ ID NO: 99488 - DNA, 547 bp, Homo sapiens
  misc_feature: GYAE6OF02IY2VT.40.81.H04.1.454.CMB.1.raw
  modified_base (396)..(396): a, c, t, g, unknown or other
  misc_feature (396)..(396): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgccccgtcactcctggagagccggcctccatctcctgcaggtctagtcagacgcctacctaaacactaatggatactactctttagaattggtacctgcagaagccgaggcagtctccacagtctcttgatatagttggggttcttagtccgggcctccggggtcctgactaggttcagtggcagtgatcgagtcacagtatttacatagaaatcagngtgggtgaggcgaagaagtagttggttaggtattttactacgtgactagtcgaccaaccttactaactaaacgttgtagtcgggacggtcggaccgaagggaacctaagggtacgaaatcgaacggtacgaacgtggtcggacgtgacccg

SEQ ID NO: 99489 - DNA, 530 bp, Homo sapiens
  misc_feature: GYAE6OF02FZHJ5.40.81.H04.1.454.CMB.1.raw
  modified_base (293)..(293): a, c, t, g, unknown or other
  misc_feature (293)..(293): n is a, c, g, or t
  modified_base (472)..(472): a, c, t, g, unknown or other
  misc_feature (472)..(472): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacnccctgacgcaactactacatacactggatgcggcacggcccctggacgtaggggtttgaggtggagtggggtgatccaacccgtacgaggaggtggacaacgaaagtactcgacagtaacttcgagggcagggtcaccgatcgaccgtgggaccgccgtccatcgagcacgagtctacngtagatcgtgacgcggactcgacctcgtacggacgacgacgcctagtcgtatcgtagg

SEQ ID NO: 99490 - DNA, 502 bp, Homo sapiens
  misc_feature: GYAE6OF02FVHFZ.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggacgaagggaccaaggtagaaatcgaagcgaactggtaggctgcactacg

SEQ ID NO: 99491 - DNA, 539 bp, Homo sapiens
  misc_feature: GYAE6OF02FPNYJ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatcctcctgcaggtctagtcagagcctcctaaaacactaatggatactactctttgaattggtacctgcagaagccagggcagtctccacagctcttgatatattggggttcttagtcgggcctccggggtccctgacaggttcagtggcagtgatcagtcacagtatttacactagaaatcaagcagggtggagcagaagagtggttgggattttatactgacatgactaaccttctaactaaacgtgtacggtggaccggtacggaccgaaagggaccgtaaagggtaggtaaactacggaacggcgtaaacgtggtacggtacgtgaccc

SEQ ID NO: 99492 - DNA, 520 bp, Homo sapiens
  misc_feature: GYAE6OF02HG3AM.40.81.H04.1.454.CMB.1.raw
  modified_base (410)..(410): a, c, t, g, unknown or other
  misc_feature (410)..(410): n is a, c, g, or t
  modified_base (474)..(474): a, c, t, g, unknown or other
  misc_feature (474)..(474): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggagtggggtggatcgaacctacaggaggtggcacaaagtatcgacagaactttcagggcagggtcaccgatgacctgggacgcgtccatcagcacngtctacatggatcgtgagcggactgacctagcgacgacacggcagtgtattagtgtacggaagngtaacggttggtaggccgtacggcgggcgtacgaccgagtacgggg

SEQ ID NO: 99493 - DNA, 512 bp, Homo sapiens
  misc_feature: GYAE6OF02GAO86.40.81.H04.1.454.CMB.1.raw
  modified_base (383)..(383): a, c, t, g, unknown or other
  misc_feature (383)..(383): n is a, c, g, or t
  modified_base (476)..(476): a, c, t, g, unknown or other
  misc_feature (476)..(476): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtgaggnagagatgtggtatttatactgcatgcaacctctaacaaactgtgtggacggtcggaccgaagggaccaaggtcgaaatcgaagcgaacgtggnggactgacaccattcgtcgttctcactccttccccg

SEQ ID NO: 99494 - DNA, 549 bp, Homo sapiens
  misc_feature: GYAE6OF02HOQS3.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctggtctctggatccagtgggatattgtgatgactcagtctccactctccctgcccgtcacctcctggagagccggcctccatctcctgcaggtctagtcagagcctcctaaaacactaatggatactactctttgaattggtacctgcagaagccaggcagtctccacagctcttgatatagttgggttcttagtcgggtcctccgggtccctgacgtaggttcaggtggctagtggatcgagtcacgagtatttacactagaaatcagacgagggtgagacagaagattgttggtatttatacgtgtactatcgacaaccttactaactaaacgtgtgtacgggtacggtacggaccgtaagggaaccgtaagggttacggaaacgttacgaaaggccggtaacgtggtacggcgtgactaaccg

SEQ ID NO: 99495 - DNA, 557 bp, Homo sapiens
  misc_feature: GYAE6OF02GPDDR.40.81.H04.1.454.CMB.1.raw
  modified_base (440)..(440): a, c, t, g, unknown or other
  misc_feature (440)..(440): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttctggaaacaccctgagcaactactacatacactgatgcggcacggcccctggacgaggggtttgagtggagtggggtggatccgaaccctaccgagaggtggcaacaaagtatcgacagtaactttcgagggcgagggtccaacgatcgaccgtgggacgccgtacatcgagccacgacgtctacagtggatcngagcggacgtcgacctcgcgacgacgacggccagtgtacgttatggtaggaagacgtacggttggtcggtaccgtaccgggcgggtccgtaggaccggtacggtcggggtaacccgg

SEQ ID NO: 99496 - DNA, 571 bp, Homo sapiens
  misc_feature: GYAE6OF02IACXP.40.81.H04.1.454.CMB.1.raw
  modified_base (453)..(453): a, c, t, g, unknown or other
  misc_feature (453)..(453): n is a, c, g, or t
  modified_base (497)..(497): a, c, t, g, unknown or other
  misc_feature (497)..(497): n is a, c, g, or t
  modified_base (516)..(516): a, c, t, g, unknown or other
  misc_feature (516)..(516): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttcaggaacacctgagcaactactacatacactggatgcggcacggcccctggacgaggggtttgaggtggagtggggtgagtccaacctaccgaggaggtggacaacgaaagtatacgaacagtaactttcgagggcagggtacaccgagtcggacccgtaggggacgcgtaccagtccgagccaacacgtactacagtggatcgnggaggccggacgtcgaccgtcgacgaacgacgaacggccagttntacgttacgtaggaggaanggtacggttaggtacgggtaccgtaccgggcgggtactacggaccgagtccgggg

SEQ ID NO: 99497 - DNA, 601 bp, Homo sapiens
  misc_feature: GYAE6OF02I3F02.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttagaattcggtacctgcagaagccgagggcagtctccacagctcttgatattagttggggttcttagtccgggtccgtccggggtccctgactaggttcaggtggctagtggatcgagtcactagtattttacactagaaatcgagtcgtgggtggaggacgaagaagtagttggttagggttatttagttacgtgtacgagtcgtacctaaccttacgttaaactaaacgttgtaggttacggtaccgggttacggaacccggaaacggggtaaccgtaaagggttacggaaacgttacgaacggtaccggtaacgttagggtacggtaccgtaggtaacc

SEQ ID NO: 99498 - DNA, 518 bp, Homo sapiens
  misc_feature: GYAE6OF02FGI2F.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttagtcgggcctccggggtcctgacaggttcagtggcagtggatcagtcacagtattttacactagaaatcagcagggtggaggcagaagagtgttgggtatttatactgcatgacaacctctaactaaactgtaggtggacggtcggaccgaagggaccgaagggtaggaaactcgaagcgaacgtggtaggctcggcacctacg

SEQ ID NO: 99499 - DNA, 623 bp, Homo sapiens
  misc_feature: GYAE6OF02G01EE.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagccctacctaaaacactaatggatactactctttgaattggtacctgcagaagccgagggcagtcctaccacagctcttgattatagttggggttacttagtccgggtccgttcccgggtccctagacgtaggttccgaggtggctaggtggactcgaggtcaacgtagtaacttttacacgtagaaaactcgaaggcgtaggggtaggacggacgaaggaagtagttggtttagggtaatttagttacgtgactagtcgacctaaccgtacttaactaaacgttggtacggttacgggaccgggttaccggaaccggtaacggggaaccgtaaagggtacggtaaacgtaccgaaaggaccggtaacgttaggtacgggtactacggacctaaccg

SEQ ID NO: 99500 - DNA, 565 bp, Homo sapiens
  misc_feature: GYAE6OF02H6GK3.40.81.H04.1.454.CMB.1.raw
tcagtctagcgactcacgaccggtgctcgatttagtagtgtagattcgcgggggactgatcaggactcctcagttcaccttctcacaatgaggctccctgctcagctcctggggctgctaatgctctgggtctctggatccagtgggggatattgtgatgactcattctccactctccctgcccgtcactcctggagagccggcctccatctcctgcaggtctagtcagagccctacctaaaacactaatggatactacttctttgaattgtacctgcagaagccgagggcagtctaccacagctcttgattatagtttggggttcttagtcggggtccctccgggggtccctggactaggttcaggtggcagtggactcagtcacagtactttacactagaaactcaagcgagggtggaggcaaggaagagttcggtaggtatttagttcgtgcagtgacctaacctcgttaacaacgttgtacggtgggtacggtcggaccggaacgggacgtaagggtaaggtaactacgaagtaccggtaacgtggtacggtactgtaccg

SEQ ID NO: 99501 - DNA, 572 bp, Homo sapiens
  misc_feature: GYAE6OF02G8C2S.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcacggcccctggacgtaggggtttgaggtggagtgggggtggataccaacccgtacaggaggtggacaacgaaagtatcgaacacgtaactttcgagggtcgagggtccaaccgatcgaccgtgggaccgtcgtccatcgagcacacgtctacagtggatcgtagacggcggacgtggaccgtacgcggacgaacgacggccaagtcgtattacgtagtaggaagtacggtacggttggacggtccgtacggcgggtacctggacccgtacggtcgggtacccggg

SEQ ID NO: 99502 - DNA, 578 bp, Homo sapiens
  misc_feature: GYAE6OF02G6AWT.40.81.H04.1.454.CMB.1.raw
  modified_base (251)..(251): a, c, t, g, unknown or other
  misc_feature (251)..(251): n is a, c, g, or t
  modified_base (332)..(332): a, c, t, g, unknown or other
  misc_feature (332)..(332): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (477)..(477): a, c, t, g, unknown or other
  misc_feature (477)..(477): n is a, c, g, or t
  modified_base (540)..(540): a, c, t, g, unknown or other
  misc_feature (540)..(540): n is a, c, g, or t
tcagtctagcgactcacgaccggtgctcgatttagtagtgtagattcgcggggacgtgatcaggactcctcagttcaccttctcacaatgaggctccctgctcagctcctggggctgctaatgctctgggtctctggatccagtggggatattgtgatgactcagtctccactctcccgtgcccgtcaactcctggaagacgcccggcctaccatcctcctgcaaggtctagtcagacgcctacctaaaanacgtaatggaatactactctttagaattggacctgcaagaagccagggcagtctccacagctcttgatattagttggggtnttaagtccggggccttccggggtcctggacctagggtttcagtcggacaggttggaattcagtcatagtatttacactaagaaaatcagcagggtgaggnaagaagntaggtaggtatttaccgtatgctagtagcctaaacctntaaacctaaatcggtagtacggtacggtcggaacccgaaagggtaccaaagggtagaaacgtnaacggtaccgtaaagtcggttaggccgttagaaccccg

SEQ ID NO: 99503 - DNA, 615 bp, Homo sapiens
  misc_feature: GYAE6OF02HQ1O1.40.81.H04.1.454.CMB.1.raw
  modified_base (430)..(430): a, c, t, g, unknown or other
  misc_feature (430)..(430): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactcttgaattggtacctgcagaagccgaggcagtcctccacacgctcttgatattagttggggttctttacgtcggggcccgttcccgggggttccctggtaccgtaggtttcaggtgggtagtggatcgagtcaacgtagtaattttacactaagaaatcaaggtcgttaggggnggaggacgaaggaaagtagtaggtttagggtattttagttacgtgacgtagtcgacctaacctacttaaactaaaccgttgtacggtacgggtacgggttaccggaccggtaaacggggaaccgtaagggtacggtaaacgtacgaacggtacggaacgttaggtacgggtacgtcgactaaccg

SEQ ID NO: 99504 - DNA, 632 bp, Homo sapiens
  misc_feature: GYAE6OF02IM7MQ.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcccgtggggcctcgggtagaaggttcctccgtgacaagtacttttcgacggaaaccaccgtgacgactaactactacataccacgtggatggcggacgaccggccccgtgggacgtaggggtttgaggtggaggtggggtggactaccgaacccgtacgagggtagggtcggacaacgtaaagtacgtaccgaaacgagttaacctttacggacgggtacggacgggtaccaaccgtagtacggaccggtacggggaccgtccgtaccagtaccgacgaccacgtacgtacctaacgtagtacggacttcgtaggacggtccgggtacgtacggaccgtacggacggaaccgacggtacggacctagtcgtactacgtacgg

SEQ ID NO: 99505 - DNA, 531 bp, Homo sapiens
  misc_feature: GYAE6OF02H5R9W.40.81.H04.1.454.CMB.1.raw
  modified_base (294)..(294): a, c, t, g, unknown or other
  misc_feature (294)..(294): n is a, c, g, or t
  modified_base (445)..(445): a, c, t, g, unknown or other
  misc_feature (445)..(445): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactccccaggtgcagctggtgcagtctggggctgaggtgaagaagcctggggcctcggtgaaggtctcctgcaagatttctggaaacnccctgagcaactactacatacactggatgcggcaggcccctggacgtaggggtttgaggtggagtggggtgatacgaaccctaccgagaggtggacacgaaagtagtcgacagtaacttcgagggcagggtccacgatcgaccgtgggacncgtcatcgagcacacgtactacagtgactcgtgagcggctcgtaccgtacgtcgacgacgacggacctagtagttacgtagtacgg

SEQ ID NO: 99506 - DNA, 517 bp, Homo sapiens
  misc_feature: GYAE6OF02JFJI1.40.81.H04.1.454.CMB.1.raw
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (465)..(465): a, c, t, g, unknown or other
  misc_feature (465)..(465): n is a, c, g, or t
  modified_base (497)..(497): a, c, t, g, unknown or other
  misc_feature (497)..(497): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttctggaaacaccctgagcaactactacatacactggatgcggcaggcccctggacaggggtttgagtggatggggtggatcaacctacagaggtgcacaagtancganagaactttcagggcagggtcaccatcgaccgtgggacgcgtccatcagcacagtctacatggatctgagcggactgacctcgtgacgacacggcatgtattacgtgtggaanaggtacgttggtacggtacgtaccggcgggtntacggaccgacggtacgggg

SEQ ID NO: 99507 - DNA, 530 bp, Homo sapiens
  misc_feature: GYAE6OF02FXMV3.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaatttggtacctgcagaagccagggcagtctccacagctcttgatatattgggttcttagtcgggcctccggggtccctgacaggttcagtggcagtggatcagtcacagtattttacactagaaaatcagcgagggtggaggcgagaagagtgttaggtatttattactgactagtagacaaccttctaactaactgtgtgggacgtcggacgaacgggaccgtaagggtagaaagtacgaagacggtaacgtggtcggactgccacgtacg

SEQ ID NO: 99508 - DNA, 593 bp, Homo sapiens
  misc_feature: GYAE6OF02IS88O.40.81.H04.1.454.CMB.1.raw
tcagtctagcgactcacgaccggtgctcgatttagtagtgtagattcgcgggcggtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaacgccagggcagtctccacacgctctgattatagttggggtttcttaggtccgggtccgtccggggtcccctgacgtaggttcaggtggcaggtgatcagtcactagtattttacactagaaaactcgagcgtagggtggaaggcgaagaaggtagtagttgggtaatttagttactgactagtcgtactaaccttactaactaactgtggtcgggtacggtaccggaccgaaacgggtaaccgaaggtacggaaactacgaacgtacggtaacgttggacggtctccgactaccgtattccgttgttaccttagttaccttccgtaccccg

SEQ ID NO: 99509 - DNA, 614 bp, Homo sapiens
  misc_feature: GYAE6OF02HFP6U.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactctttgaattggtacctgcagaacgccgaggcagtctccacagctcttgattatagttgggttcttagtccgggccgttccggggtccctgacgtaggttcaggtcggctaggtggatcagtcactagttatttacactagaaatcagacgaggggtggaggacaagaagtagttaggttagggtaatttagttacgtgtactatacgacctaaccttactaacgtaacgttggttacggtacgggtaccgggttaccggaccggtaacgggtaaccggtaaacgggttaacggtaaacgttaccgaaacggtaccggtaaacggttgggtaccggtacgtacggtacccgtaaccgttacg

SEQ ID NO: 99510 - DNA, 582 bp, Homo sapiens
  misc_feature: GYAE6OF02GQ4KO.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctgggggctgaggtgaagaagccgtggggcctcggtgaaggtctcctgcaagtatttctggaaacaccctgagcaactactacatacactggatgcggcaggcccctggacgaggggtttgaggtggagtgggggtggatacgaaacccctaccgaggagggtaggacaacgaaaaggtactacggaacagtaacttttacgaaggggtacgagggtcaaccgatacggacccgtggggaccgtccgtaccatcgagccacgagttctacgatggatcgtagacggacggactcgtacctcgtcgacgacgacgcagtgtattacgtgtaggaagacgtacggttggtacggacgtaccgggcgggtcgtacggaccgcggtaccgggg

SEQ ID NO: 99511 - DNA, 542 bp, Homo sapiens
  misc_feature: GYAE6OF02F9K7T.40.81.H04.1.454.CMB.1.raw
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
  modified_base (399)..(399): a, c, t, g, unknown or other
  misc_feature (399)..(399): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttgggttcttatcgggcctccgggtccctgacaggtcagtgcagtggatcagtcacngatttacactagaaatcagcgagggtgagcaganatgtggatttatatgnatgacaacctctaacaactgtagtcggacgtcgggaccgaagggaaccaagggtagaaacgttcgaagacggtaacgtggtacggactggacctaaccgtacgttacgttcgttacctttaccacgtttcccgttacccccgg

SEQ ID NO: 99512 - DNA, 499 bp, Homo sapiens
  misc_feature: GYAE6OF02JAXCJ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtcctgacaggttcagtggcagtggatcagtcacgagattttacactgaaatcagctgggtggaggcagaagatgttgggatttatactgcatgcaacctctaacaaactgtgtggacgtcggccgaagggaccaaggtgaaatcgaaggcgaactggtggctagacc

SEQ ID NO: 99513 - DNA, 544 bp, Homo sapiens
  misc_feature: GYAE6OF02FGZSA.40.81.H04.1.454.CMB.1.raw
  modified_base (242)..(242): a, c, t, g, unknown or other
  misc_feature (242)..(242): n is a, c, g, or t
  modified_base (487)..(487): a, c, t, g, unknown or other
  misc_feature (487)..(487): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagntttctggaaacaccctgagcaactactacatacactggatgcgcagcccctggacaggggtttgaggtggagtgggggtggatccaaccctaccgaggacggtggacgaacaaacgtatcgaacagaactttcgaggggcagggtccaccgatcgaccgtgggaccgcgtccatcgagcacgagtcctacatggactcgtggacgcggactgacctacgtcgacgacacggacagtgtattacgngtaggaagagacggttggtcgcgtaccggcgggacctcgaccgacggtcgggaccgg

SEQ ID NO: 99514 - DNA, 578 bp, Homo sapiens
  misc_feature: GYAE6OF02IB20L.40.81.H04.1.454.CMB.1.raw
  modified_base (337)..(337): a, c, t, g, unknown or other
  misc_feature (337)..(337): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctctgatatagttgggttcttatcgggcctccggggtccctgacaggttcagtggcngtggatcagtcacagtatttacactagaaactcagcgagggtgaggcagaagagtgttgggtatttacttagtgcatcgactaacctactaactaacgtgtaggtacggacggtcggaccgaaagggaccgtaaaggtacggtaattaccgaagtaccggaacgtggttacgggacgttacggtaccgtaaccgtacgttaccgttcgttacctttacggtaccttcccgtttacccccgg

SEQ ID NO: 99515 - DNA, 652 bp, Homo sapiens
  misc_feature: GYAE6OF02H93NR.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctctgggtctctggatccaggtgggatattgtgatgactcagtctccactcctccctcgcccgtcactcctggagacgccggccctccatcctcctgctaggtctagtcagacgccctacctaaaacactaagtgatactacttcttagaattgtacctgacaagaagccgaggctagtcctaccacagtctacgttagtataagttaggtttggggtttcttacggtccggggtcccgttcccgggggttcctaggacgttaggttcaggtcggcgtagtggtactcagtcacgtagttacttttaacagtaagaaactcgtagtcggtagggaggtaggacgtaaaggaaggtagttagggtttagggttaattttaacgtacgtagacgtatacgtacctaacccttaacgtaaactaaacgtgggttaggtacgggaccgggtaaccggtaacggaacgggtaaccgtaagggtaacgtaaacgtacgaaggtaccgtaacggttggtacggtacacgtaacccg

SEQ ID NO: 99516 - DNA, 508 bp, Homo sapiens
  misc_feature: GYAE6OF02FYTN8.40.81.H04.1.454.CMB.1.raw
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (478)..(478): a, c, t, g, unknown or other
  misc_feature (478)..(478): n is a, c, g, or t
  modified_base (501)..(501): a, c, t, g, unknown or other
  misc_feature (501)..(501): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcacatgacctgggacgcgtccatcagcacagtctacatggatcngagcggactgacctcgngacgacacggccagtntattactgtggaagagacggttggnggctaccggcgggtctggaccgngtcgggg

SEQ ID NO: 99517 - DNA, 619 bp, Homo sapiens
  misc_feature: GYAE6OF02G1KSQ.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcaggtggatcgagtcacagtattttacactagaaaatcagcgagggtggaggcagaagatggttagggtatttagttactggactagtcgacctaacctactaaacgtaaacttggtacggtagggtaaccgggtccgggaaccgaaacggggtacccgtaaaggggtaacgggtaaaacgttccggaaacggtacgtaaacggttgggttacggtaaccgttcggacccgtaaccgtacgttacgttacgttacctttacgtaccgtttccttaccccccgg

SEQ ID NO: 99518 - DNA, 506 bp, Homo sapiens
  misc_feature: GYAE6OF02I5439.40.81.H04.1.454.CMB.1.raw
  modified_base (500)..(500): a, c, t, g, unknown or other
  misc_feature (500)..(500): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgaggcctcggtgaaggtctcctgcaagatttctggaaacaccctgagcaactactacatacactggatgcggcaggcccctggacaggggtttgagtggatggggtggatcaaccctacagaggtggcacaaagtatcgacagaactttcagggcagggtcacatgacctgggacgcgtccatcagcacagtctacatggatctgagcggactgacctcgcgacgactacggcagtcgtatacgtgaggtaagagtacgttggtcggacgtaccggngggtcg

SEQ ID NO: 99519 - DNA, 567 bp, Homo sapiens
  misc_feature: GYAE6OF02JA3OO.40.81.H04.1.454.CMB.1.raw
  modified_base (292)..(292): a, c, t, g, unknown or other
  misc_feature (292)..(292): n is a, c, g, or t
  modified_base (396)..(396): a, c, t, g, unknown or other
  misc_feature (396)..(396): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatcctcctgcaggtctagtcagagccctactaaacactaatggatactactctttgaattggtacctgcagaacgccagggcacgtcnccacagctcttgatatagttgggttcttagtcgggcctccgggtccctgactggttcagtcggctagtggatcgagtcacgtagtatttacatagaaatcgagngagggtggaggcaagaagtagttggttaggtatttatcgtgctatcgactaaccttactaaactaaacgtggtagtagggtaccggtaccggaccggaaacgggaaccgtaagggtaacggtaaactaccgaaagacggtaacgtcggtacggtacgtacgtacctaaccg

SEQ ID NO: 99520 - DNA, 552 bp, Homo sapiens
  misc_feature: GYAE6OF02G7DCU.40.81.H04.1.454.CMB.1.raw
  modified_base (438)..(438): a, c, t, g, unknown or other
  misc_feature (438)..(438): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgcaggtctagtcagacgcctacctaaacactaatggatactactctttagaattggtacctgcagaagccgagggcagtcctccacagctctgattatagtttgggttcttagtcgggtccgtccggggtcctggactaggttcaggtgcaggtgatcagtcacagtatttacactagaaatcgagcgagggtggagcaagaagtagtaggtaggtatttatactganagtcactacctactaactaagttggtacggtacgggacggtaccgggacgaagggtaccgtaagggtagaaactcgtaacggacgaacgtcggtaggaccgtacgaccactacg

SEQ ID NO: 99521 - DNA, 627 bp, Homo sapiens
  misc_feature: GYAE6OF02G3S99.40.81.H04.1.454.CMB.1.raw
tcagtctagcgactcacgaccggtgctcgatttagtagtgtagattcgcggggactgatcaaggactcctcagttcaccttctcacaatgaggctccctgctcagctcctggggctgctaatgctctgggtctcgtggatccagtggggatattgtgatgactcattctccactctccctgcccgtcactcctggagacgccggcctccatcctcctgcaggtctagtcagacgcctacctaaacactaatggatacctacttcttagtaattggtacctgcagaacgcgagggcagtcctccacacgctcttgattattagttggggttcttacgtccgggtcccgttccggggtccctggacgtaggttcaggtcgacaggtaggatccccgagtcactagtacttttacaactagaaatcgagacgagggtaggagacgaaggaagtagttggttagggttattttaacttacgtagtactagtcgacctaaccgttactaacgtaaacgttggtagtacgggtacggtaccggaaccggtaaaggggaacccgtaaggggtaacggtaaacgttaccggaaacggtaccggtaaaccgttgggtacggtccgtacggtacccg

SEQ ID NO: 99522 - DNA, 528 bp, Homo sapiens
  misc_feature: GYAE6OF02HFMYU.40.81.H04.1.454.CMB.1.raw
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactccccaggtgcagctggtgcagtctggggctggaggtgaagaagccgtggggcctcggtgaaggtctcctgcaagatttctggaaacaccctgagcaactactacatacactggatgcggcaggcccctggacgtaggggtttgaggtggatggggtgagtcaaccctaccgaggaggtcggcaacaaagtatcgacagtaactttcagggcaggtcacgatgaccgtgggacgcgtcatcagcacagtctacatagatctagngcggactgacctntcgacgacgacgcaagtgtatagtgtaggaaggacgtagttggtcgcgtaccggcgggcctcggaccgacgtcgggacccgg

SEQ ID NO: 99523 - DNA, 504 bp, Homo sapiens
  misc_feature: GYAE6OF02FIB6Z.40.81.H04.1.454.CMB.1.raw
  modified_base (461)..(461): a, c, t, g, unknown or other
  misc_feature (461)..(461): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaacaccctgagcaactactacatacactggatgcggcaggcccctggacaggggtttgagtggatggggtggatcaaccctaccagaggtggcacaaagtatcgacagaactttcagggcagggtcacatgactgggacgcgtccatcagcacagtctacatggatctgagcgggctggacctacgtgacgacgacggccagtgtagttacngtggaagagacgttggtgcgtacgcgggctgcccagtgggccg

SEQ ID NO: 99524 - DNA, 569 bp, Homo sapiens
  misc_feature: GYAE6OF02HKSHW.40.81.H04.1.454.CMB.1.raw
  modified_base (431)..(431): a, c, t, g, unknown or other
  misc_feature (431)..(431): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagcccggcctccatcctcctgcaggtctagtcagagcctacctaaaacactaaatggatactactctttagaattggtacctgcagaagccagggcagtctccacagctcttgatattagttgggtttcttagtccgggtccgttccggggtccctgacgtaggttcaggtggcagtggatcagtcacagtatttacactagaaatcgagcgagggtggaggacaagaagagtaggttgggtatttattacngactatgaccaactactaactaaacgtggtagtggacggtcggaccgaagggaaccgaaggtagaaacgtacgacggacgtaacgtggtacggctacgaccacgtacgtactcggttcttactaccttccttaccccg

SEQ ID NO: 99525 - DNA, 532 bp, Homo sapiens
  misc_feature: GYAE6OF02HZ597.40.81.H04.1.454.CMB.1.raw
  modified_base (351)..(351): a, c, t, g, unknown or other
  misc_feature (351)..(351): n is a, c, g, or t
  modified_base (433)..(433): a, c, t, g, unknown or other
  misc_feature (433)..(433): n is a, c, g, or t
  modified_base (483)..(483): a, c, t, g, unknown or other
  misc_feature (483)..(483): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtggggcctcggtgaaggtctccgtgcaagatttctggaaacaccctgagcaactactacatacactggatgcggcaggcccctggacaggggtttgagtggagtggggtgatcaaccctacgagaggtggcaanaaagtatacgacagtaactttcagggcagggtcaccatcgacctgggacgcgtccagtcagtcacgacgtctacatggatcnggagcggactggacctctcgacgcgacggccatgtattacgtgtggaagnggtacgttgggtggcgtaccgggcgggtcctcggaccgtcgtaccgggg

SEQ ID NO: 99526 - DNA, 552 bp, Homo sapiens
  misc_feature: GYAE6OF02HSEOU.40.81.H04.1.454.CMB.1.raw
  modified_base (530)..(531): a, c, t, g, unknown or other
  misc_feature (530)..(531): n is a, c, g, or t
  modified_base (533)..(533): a, c, t, g, unknown or other
  misc_feature (533)..(533): n is a, c, g, or t
  modified_base (536)..(537): a, c, t, g, unknown or other
  misc_feature (536)..(537): n is a, c, g, or t
  modified_base (539)..(552): a, c, t, g, unknown or other
  misc_feature (539)..(552): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagtatttctggaaacaccctgagcaactactacatacactgatgcgcgacggccccgtggacgtaggggtttgaggtggagtgggggtgactacgaaccctacgaggacggtggacaacgtaaagtacgtacgaacgaaggtaacgtttacgagggaccgtagggtacaaccgagtcggaaccgtgggaccggtcgtaccgaagtcgaacgaccgacgtacgtacctaacgtagtacgggaattcgtaggaacgggtccgggtacgtacgggacgaacggcgacgtagtagnncntgnngnnnnnnnnnnnnnn

SEQ ID NO: 99527 - DNA, 520 bp, Homo sapiens
  misc_feature: GYAE6OF02F5P5U.40.81.H04.1.454.CMB.1.raw
  modified_base (246)..(246): a, c, t, g, unknown or other
  misc_feature (246)..(246): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagagccgtggggcctcggtgaaggtcctcctgcaagntttctggaaacaccctgagcaactactacatacactggatgcggcaggcccctggacaggggtttgagtggatggggtggagtcaaccctacagaggtggcacaaagtatcgacagaactttcagggcagggtcacgatgaccgtgggacgcgtcatcaggcacagtctacagtgatctgagcggatcgactcgtgacgaccacggcagtgtattactggtggaaggtagacggtttggtggcgtaccggcgggcgtcggaccgacgtccgggg

SEQ ID NO: 99528 - DNA, 560 bp, Homo sapiens
  misc_feature: GYAE6OF02IU88F.40.81.H04.1.454.CMB.1.raw
tcagtctagcgactcacgaccggtgctcgatttagtagtgtagattcgcgggcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttcgtggaaaccaccctgagcaaactactacatacacgtggatgcggcacggcccctaggactagggggtttgagtggagtggggtggactcgaacccgtacgaggtaggtcggacaacgaaagtatcgacagtaactttcgagggcgagggtaccaccagtcgaccgtgggacgccgtcacgtcagcacgacgtctacagtggactcgtgaaggcggactcgaccgttcgtacggaccggacgaccgggtaccagttacgttattacctacgggg

SEQ ID NO: 99529 - DNA, 535 bp, Homo sapiens
  misc_feature: GYAE6OF02HL1E9.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccgagggcagtctccacagctcttgattatagttggggttcttacgtcgggtcctccggggtccctggactaggttcagtggcagtggatcgagtcacagtattttacactagaaatcgagcgtgggtggagcagaagagttggttagggtatttattacgtgactagtcgactaacctactaacaaactgtagtggacggtcggaccgaagggaccgaaggtacgaagtcgaagcgtaacgtggtacggctagacc

SEQ ID NO: 99530 - DNA, 831 bp, Homo sapiens
  misc_feature: GYAE6OF02GEJW2.40.81.H04.1.454.CMB.1.raw
  modified_base (130)..(130): a, c, t, g, unknown or other
  misc_feature (130)..(130): n is a, c, g, or t
  modified_base (232)..(232): a, c, t, g, unknown or other
  misc_feature (232)..(232): n is a, c, g, or t
tcagtctagcgactcacgaccggtgctcgattagtagtgtagattcgcggggtgccctgagagcatcaccccagccaacccacatcctgtccctcctagagaactccccctgagacgcctcccgttcccncacccatgacctggacctggaggactcctcttctggtgccagccagcccgcaggacgcccccactcccccgaaggtcgccagcctgggtcgccaggttccgngggtcctggacggttgaacgacggccctgggggccctacgggtgaacggtcctcccgtgccaagatttccgacgggaaccccccctggacgccaaacctcctaccactaccgacgtcggactcgcgggtaccacggtcccccgtgggaaccgtagggttttacggaacgttcgggaacgttcggggggtacgaccttaccccaaaccccgttaccgagggtaacgggtcgacccaaacgtaacgtctacccgaactacggtaacccttcgaggtcccgaacgggtttcccacccgtacgtccgggaaccccgtcgggggtaaccccgtccggttaccccacgttacccgaccgtcccgaaccgtacggttaccctaaccgtacggtaccgggtaacttcccggtacggtaaccggtcccggttaaccgttaccgtaccccgtacctaccgggaacccgtaaccccgacccgggtacccagtttccggttaaaccttacgggttaccgggtaacgggtaaccggtaacggtttacccgggttacggggtcccgggtaccccgtaaccccgggggtccccggggttcctaacccccggggg

SEQ ID NO: 99531 - DNA, 649 bp, Homo sapiens
  misc_feature: GYAE6OF02H9DSS.40.81.H04.1.454.CMB.1.raw
  modified_base (277)..(277): a, c, t, g, unknown or other
  misc_feature (277)..(277): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctcatctcctgcaggtctagtcagacgcctacctaaacactaatggatactactctttgaattggtacctgcagaagcaggcagtctccanagtctcttgattatagttgggttcttagtccgggccgttccggggtccctgacgtaggttcaggtcggctaggtgatcagtacagagtacttttaacactagaaatcgaggacgaggggtaggaggcaaggaagagttggttagggttaatttagttacgtaggtactagtacgacctaaccgtactaaacgtaaacgttgggtacggtacgggtaccgggtaccggaaccggaaacgggtaacccgtaaagggtacggtaaaagtaccgaaacggtaccggtaacgtacgggttacggtaccgtacggtaccctaaccgtacggttccttacggtttacctttaccgtaccgtttccccgttaacccccgg

SEQ ID NO: 99532 - DNA, 678 bp, Homo sapiens
  misc_feature: GYAE6OF02J0M4C.40.81.H04.1.454.CMB.1.raw
tcagtctagcgactcacgaccggtgctcgatttagtagtgtagattcgcgggcgtagacttgtgtttctcgtagtctccctgctcagctcctgggctgctaatgctctgggtctctggatccagtgggatattgtgatgactcagtctccactctccctgccccgtcacctcctggagacgcccggcctccatcctcctgcaggtctagtcagagccctacctaaacactaatggatacctactctttgaattggtacctgcagaagccaggcagtctccacacgctctgatatagttggggttcttagtccggggtcccgttccggggtccctggtaccgtacgggtttcacggtggactaggttggacttcgaagtcaacgagtaattttaccacttagaaaatcgagtacgaggggtaggaggacgaaggaaagtagttggttagggtaattttacgttaacggtgtacgtagttggacctaaacctccgtaaactaaacgttcggttagtaccgggtaccgggtaccgggacccgaaacggggtaacctaaacggggtaataaacggttaccgaaggtaccggtaaacggtcggtacgggtacctaacgggtaccctaacccggaatttccggtacggttacccgtttacgtacccttcccgtttaccccccgg

SEQ ID NO: 99533 - DNA, 608 bp, Homo sapiens
  misc_feature: GYAE6OF02F9Z35.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagagccgtgggcctcggtgaaggtctcctgcaagtatttctaggaaacacccgtgagacaactactacatacactaggatgcggcacggccccgtggacgtaggggtttgagtggagtggggtgataccaaccgtaccgaggtaggtggacaacgaaaagtactcgaacgaagtaactttcgaagggcgtagggtacaccgagtacgaccgtgggacgtcgtaccatcgagcacacgtctacagtcggatcgtagacggtaccggactcgaaccttcgtacgggaacgaccacgggaccctagtcgttacttacgtggttaaggaacggtaggtaccggttgggtacggtaccggtaccgggtacggggtaccgtacggaccgtaccgggtaccgggg

SEQ ID NO: 99534 - DNA, 653 bp, Homo sapiens
  misc_feature: GYAE6OF02G4WPO.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgcccggcctcatctcctgcaggtctagtcagacgcctacctaaacactaatggaattactacttctttagaatttcggtacctgacaaggaacgccgagggcagtcctccacagcttctgatatagttggggttctagtccgggcctccggggtcctggactaggttcaggtggcaggtggatcgagtcaactagtatttacacttagaaactcgaagacgaggggtaggaaggacgaaggtaaagtagttaggtttacgggttaattttacgttacgtagtaccgtaagttaccgtaaccgtaaccgttacttaaaccgtaaacgtttagggttacggtacgggtaccggttaccgggaacccgggtaaacggggtaacccgtaaaggggtacggtaaaacgttccgaaacggtaccggtaaaccgttgggtaaccggttacgtacggtaacccg

SEQ ID NO: 99535 - DNA, 578 bp, Homo sapiens
  misc_feature: GYAE6OF02H5W91.40.81.H04.1.454.CMB.1.raw
  modified_base (519)..(519): a, c, t, g, unknown or other
  misc_feature (519)..(519): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttctggaaaccaccctgagcaactactacatacactggatgcgcacggcccctggacgaggggtttgaggtggagtggggtggatacaaccctacaggaggtcggacaacgaaagtagtacgacaagtaactttcgagggcgagggtaccaaccgtagtcgaaccgtggggaccgtcggtaccctagtacagccaacgagttaccttacgagtggtaactcgttaggacggcggtactcggacctcgtacgaccgacaccggcagtgtattacgngtaggagaggtcggttggtcgcgtaccgggcgggctacggaccgtacggtgggacccgg

SEQ ID NO: 99536 - DNA, 510 bp, Homo sapiens
  misc_feature: GYAE6OF02HOY8L.40.81.H04.1.454.CMB.1.raw
  modified_base (490)..(490): a, c, t, g, unknown or other
  misc_feature (490)..(490): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagtattttacactgaaaatcagcagggtggaggcagagatgttgggatttatactgcatgcaacctctaacaaactgtaggtggacggtcggaccgaagggaccaaaggtggaaatcgaagcgaacgtgtggctgcacntctgttcttctatcctcccg

SEQ ID NO: 99537 - DNA, 564 bp, Homo sapiens
  misc_feature: GYAE6OF02JJKPF.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatcctcctgcaggtctagtcagagcctacctaaaacactaaatggatactactctttgaattggtacctgcagaagccagggcagtctccacagctcttgatattattgggttcttagtcgggcctccggggtccctgacgtggtcagtggcaggtggatcgagtcacagtatttaccaactagaaactcagacgagggtaggaggacaaggaagagttaggttgggtaatttagttacgtgactatgacctacctactaaccaactggtacgtggacggtcggaccgaagggaccgaaggtaggaatacgaagacggtaacgtggtacggctacgacgacctagttccgtacgttactcgtattccctacccg

SEQ ID NO: 99538 - DNA, 370 bp, Homo sapiens
  misc_feature: GYAE6OF02GGWYA.40.81.H04.1.454.CMB.1.raw
  modified_base (364)..(370): a, c, t, g, unknown or other
  misc_feature (364)..(370): n is a, c, g, or t
tcagtctagcgactcacgaccggtgctcgatttagtagtgtagattcgcggggatactactctttgaattggtacctgcagaagccagggcagtctccacagctcttgatatattggggtccttatcgggcctccggggtccctgacaggttcagtggcagtggatcagtcacagattttacactgaaaatcagcagggtggaggcagaagatgttgggatttattactgcatgcaacctctacagactgtgtggacggtcggcaagggaccaaggtggaaatcaagcgaactgtggctgcaccatctgtcttcatctcccgcatctgaatcgctagactgagcggctggcaaggcgacatagnnnnnnn

SEQ ID NO: 99539 - DNA, 597 bp, Homo sapiens
  misc_feature: GYAE6OF02IYJ8F.40.81.H04.1.454.CMB.1.raw
  modified_base (388)..(388): a, c, t, g, unknown or other
  misc_feature (388)..(388): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcagtctccactctccctgcccgtcactcctggagacgccggcctccatctcctgcaggtctagtcagagcctactaaacactaatggatactacgtctttagaattggtacctgcagaacgccaggcagtctccacagctcttgatatagttggggttcttagtcgggcctccggggtcctgactaggttcagtgctaggtgatcagtcacgagtatttacactanaaaagttcaagtcgtaggggtaggacggagaaggtaagtaagtggttacgggtattttaagttacgtagtactagtcgtaccaacccttacgtaaacctaaaacgttcgtaggtacgggaccgggttaccgggaaccggtaaacgggtaaccgaagggttaacggaaaattacgaacggtacggtaacgtaggtacggtcgtagacccg

SEQ ID NO: 99540 - DNA, 511 bp, Homo sapiens
  misc_feature: GYAE6OF02GHMEN.40.81.H04.1.454.CMB.1.raw
  modified_base (505)..(505): a, c, t, g, unknown or other
  misc_feature (505)..(505): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacacccctgagcaactactacatacactggatgcggcaggcccctggacgaggggtttgagtggatggggtggatcaaccctaccagaggtggcacaaagtatcgacagaactttcagggcagggtcaccatgaccgtgggacgcgtccatcagcacagtctacgatggatctgagcggactgacctctgacgacacggcatgtattactgtggaagagtacgttggtcggcgtaccggcgggtntaccgg

SEQ ID NO: 99541 - DNA, 532 bp, Homo sapiens
  misc_feature: GYAE6OF02G8JOO.40.81.H04.1.454.CMB.1.raw
  modified_base (406)..(406): a, c, t, g, unknown or other
  misc_feature (406)..(406): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtcctccacagctcttgatatagtttggggttcttagtcgggcctccggggtccctgactaggttcagtggcagtgatcagtcacgagtattttacactagaaatcagcagggtgaggnagaagatggttggtattttatacgtgtactatcgacctaacctactaaactaaactgtgtacgggacggtccggaccgaaacgggaccaagggtagaaagtgaacgcgaacgtgtcggactgaccg

SEQ ID NO: 99542 - DNA, 572 bp, Homo sapiens
  misc_feature: GYAE6OF02GI3WI.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaaacactaatggatactactctttgaattggtacctgcagaagccagggcagtctccacagctcttgatatagttgggttcttagtcggcctccggggtcctgacaggttcagtgcagtgatcagtcacagtatttacactagaaaactcagtcgtgggtaggaggcaagaagagttggttagggtattttagttactgactagtcgactaaccctacgtaaactaaacgttgtgtacgggaccgggttccggacccggtaaacggggaacccgtaaagggtaaggtaaaccgtacgaaacggaccggtaaacgttgggtacggtacctagaaccc

SEQ ID NO: 99543 - DNA, 558 bp, Homo sapiens
  misc_feature: GYAE6OF02IBVRB.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagagcctcctaaacactaatggatactactctttgaattggtacctgcagaagccagggcagtctccacagctcttgatattagttggggtttcttagtccgggcctccggggtccctgactaggttcagtgcagtggatcagtcacagtatttacactagaaatcgagacgagggtaggaggcagaagtagtaggttaggtatttattactgcagtcgactaacctacctaataaaccgttggtagtacgggtacggtacggaccgtaacgggaccgtaagggtaggaaacgtacgaacgacgtaacgtcggtacggtacgtcggaccacctacg

SEQ ID NO: 99544 - DNA, 556 bp, Homo sapiens
  misc_feature: GYAE6OF02HO4CG.40.81.H04.1.454.CMB.1.raw
  modified_base (303)..(303): a, c, t, g, unknown or other
  misc_feature (303)..(303): n is a, c, g, or t
  modified_base (470)..(470): a, c, t, g, unknown or other
  misc_feature (470)..(470): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagccccactccccaggtgcagctggtgcagtcgtggggctgaggtgaagaagccgtggggcctgggtgaaggtcctccgtgcaagtatttctagggaaaccnccctggacgcaactactacatacactggatcgacggcacggcccctggacgtaggggttgaggtaggagtggggtagactccgaacccgtacgaggaggtcgggacaacgaaagtatacgacagtaacttcgaggacgacgggtacacgagtacgaccgtgggaccncgtaccagtaccacgcaactacgtactacgagtcggtatcgtagcggcgggctcggacgaaggtccgacgacgtaggngnagcngn

SEQ ID NO: 99545 - DNA, 547 bp, Homo sapiens
  misc_feature: GYAE6OF02F95S2.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgacagaagccagggcagtctccacagctcttgatatagttggggttcttagtccgggtcccgtccggggtccctgacgtaggttcagtggcaggtggatcagtcaacagtacttttacactagaaatcagcgagggtggaggacagaagtagtggttaggtatttagttactgctatcgactaactactaacgtaaactggtaggtaggacggtcggacgaacgggaccgaagggtaggaaactacgaagacgtacgtggtacggctcggacctactacg

SEQ ID NO: 99546 - DNA, 498 bp, Homo sapiens
  misc_feature: GYAE6OF02HG6IZ.40.81.H04.1.454.CMB.1.raw
  modified_base (449)..(449): a, c, t, g, unknown or other
  misc_feature (449)..(449): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggttgagtggatggggtgatcaaccctacagaggtggcacaaagtatcgacagaactttcagggcagggtcaccatgacctgggacgcgtccatcagcacagtctacntggatctgagcgggctggtacaggtcgacgagtacggcagngtntntcg

SEQ ID NO: 99547 - DNA, 660 bp, Homo sapiens
  misc_feature: GYAE6OF02IPJ9N.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagtctccactctccctgccccgtcactcctggagacgccggcctccatcctcctgcaggtctagtcagagcctacctaaaacactaatggatacctacttctttgaattggtacctgcagaagccgagggccagtctccacagcctcttgacttatacgttggggttcttagtccgggtccttccggggtcctgactggttcagtcggcgtagtgatcgagtcacgtagtactttaacacgtaagtaaactcgaggtcggttaggggtaggacggtacgaaggtaaggtaagttagggtttacgggttaattttacgttacgtacggtactaacgtacgtaccgtaaccttaccgttaaaccgtaaacgttcggttacgggtacgggtaccgggttaccgggaacccggtaaacggggaaaccgtaacggggtaacggtaaacgtaccggaaacggtaccggtaaacggttacgggtaccggtacgtaccggtaacccg

SEQ ID NO: 99548 - DNA, 578 bp, Homo sapiens
  misc_feature: GYAE6OF02GWTLL.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaaacactaatggatactactctttgaattgtacctgcagaagccagggcagtctcacagctctgatatagttgggtcttagtcggtccgttccgggtacctgtactggttcaggtgcgagtggactcagtcacgagtactttacactagaaactcagcgagggtggaggacaaggaagtagtggttacgggtatttacttacgtagtctaagtcgtaacctaaccttactaacctaaacgtggttacgtacggtacgggtacggaccgaaacgggacccggtaagggtaaggtaaactaacgaaggtacgtaacggtacgtacggtacgtaggtaccaacccg

SEQ ID NO: 99549 - DNA, 618 bp, Homo sapiens
  misc_feature: GYAE6OF02G6N89.40.81.H04.1.454.CMB.1.raw
  modified_base (226)..(226): a, c, t, g, unknown or other
  misc_feature (226)..(226): n is a, c, g, or t
  modified_base (352)..(352): a, c, t, g, unknown or other
  misc_feature (352)..(352): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctggngaaggtctcctgcaagatttctaggaaacaccctgagcaactactacatacactggatgcggcacggcccctggacgtaggggtttgaggtggagtggggtggatccaacctacgagaggtgcaanaaagtatcgaacaagtaactttcgagggcagggtcacgagtcgaccgtgggacgcgtaccatcgacgccaacgtacgtactaacagtacggactagtggacgtcgggacttcggacctaggtacggaaccgacgaacccgggcctaagtacgtaacgttaccgtaggtaacggaacggtaacggttagggttacgggtacggtaccggttacccggggtcgggtaccgttaccggaccggtaccgggtaccggggtaaccccgggg

SEQ ID NO: 99550 - DNA, 559 bp, Homo sapiens
  misc_feature: GYAE6OF02GKFER.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactgatgcggcacggcccctggacgaggggtttgaggtggagtggggtagatcgaacccgtacgacgaggtaggtcgacgaaacgtaagtacgacgaagtaacgttacgtagggacgacggtacgaccacgtacgaccgtacggacggcgtccacgtacacgacgacacgtactacacgtagatacgtgaggtacggcgtacggtaccgtacgacggaccgacgacgaccgatacgtatagtacg

SEQ ID NO: 99551 - DNA, 563 bp, Homo sapiens
  misc_feature: GYAE6OF02J2ZHA.40.81.H04.1.454.CMB.1.raw
  modified_base (259)..(259): a, c, t, g, unknown or other
  misc_feature (259)..(259): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtctccgtgcaagtatttctggaaacnccctgagcaactactacatacactggatgcggcaggcccctggacgtaggggtttgagtggagtgggggtggatcaacccgtaccgaaggaggtgcaacgaaagtatcgaacagaactttacgagggtacgagggtcaccatgaaccgtgggaaccgcgtccgatcgacgcacagtctacagtggaatcgagtaggacggactacgaccttacgtagaccggtacacggtccattcgattacgtgtacggaagtacgtacggtggttcggcgtaccggcgggacgtcgacgacgtcgggaccgg

SEQ ID NO: 99552 - DNA, 833 bp, Homo sapiens
  misc_feature: GYAE6OF02J30GJ.40.81.H04.1.454.CMB.1.raw
tcagtctagcgactcacgaccggtgctcgatttagtagtgtagattcgcgggggagcatcacccagcaaccacatctgtcctctagagaatcccctgagagctcccgttcctcaccatggactggacctggaggatcctcttcgttggtggcagcagccgcaggacgcccactcccgaggtgcagctggtcgctagtcgtggggctggaggtgaacgacgccgtggggcctgggtagacggtctccgtgactaagtactttcgacggaaccaccgtgacgactaactactacgatacgacgtggactcggccgtcgaccggtacccgtagggtacggtaaggggtttcgaaggttcgggtacgggttacggggtacgtaactaaccccgtaaacccggttaccggaagggtaacgggttacggaaccgtaaacgtaaacggttacgtaaccggtaacgtaacggttaccgtttacgggaccgggtactacggggtacccaaccggtagtaccggacccggtagggtaccgtacccgtaccgtaacgtaccgacggtaacccaatacggttaccgttaagaacgttcgggaacctagggtacggtaccgggtacggtaaccgttcccggtaaaccgtttaaccgaccgggtaaaccctaccgggtaaacccgtgttaaacggttaccggtttaacgttaaccggtccgggtaaaagggtaccggttaagggtttaacccggggtcggttaaccggtacccgggtaaaccgggtccccgggggtaattaaccccgggtaaccggtacccgggggtttaccggtaaacccccgggg

SEQ ID NO: 99553 - DNA, 558 bp, Homo sapiens
  misc_feature: GYAE6OF02IOUSR.40.81.H04.1.454.CMB.1.raw
  modified_base (239)..(239): a, c, t, g, unknown or other
  misc_feature (239)..(239): n is a, c, g, or t
  modified_base (344)..(344): a, c, t, g, unknown or other
  misc_feature (344)..(344): n is a, c, g, or t
  modified_base (406)..(406): a, c, t, g, unknown or other
  misc_feature (406)..(406): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagagcctcctaaanactaatggatactactcttgaattggtacctgcagaagccagggcagtctccacagctcttgatattagttggggttcttatcgggtcctccggggtccctgacnggttcagtggcagtggatcagtcactagtatttacactagtaaatcagcgagggtggagganaggaacgagttggttgggtaatttattacgtgtactatgactaacctacgtaactaaacgttgtacgtaggtacggtaccgggaccgaagggtaacccgaagggtaggtaactacgaacgtacggtaacgttaggtacggccgtagtacccg

SEQ ID NO: 99554 - DNA, 540 bp, Homo sapiens
  misc_feature: GYAE6OF02IDM0H.40.81.H04.1.454.CMB.1.raw
  modified_base (286)..(286): a, c, t, g, unknown or other
  misc_feature (286)..(286): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttcnggaaacaccctgagcaactactacatacactggatgcggcacggcccctggacaggggttgagtggagtggggtgatcaaccctacagaggtgacacaaagtatacgacagtaactttcgagggcagggtacaaccgatcggaccgtgggacgccgttccataccgagacacagtcctaacagtcggatcgtacggaggtcgggactacggaccgtacgtcgtaacgacgtaacggcctatgttactacgtagg

SEQ ID NO: 99555 - DNA, 591 bp, Homo sapiens
  misc_feature: GYAE6OF02JIYT3.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcagtctccactctccctgcccgtcactcctggagacgccggcctccatcctcctgcaggtctagtcagacgcctacctaaacactaatggatactacttcttgaattggtacctgcagaacgccgagggcagtctccacgagcttctagattattagttggggttcttagtccgggtccgttccggggtccctagaccgtaggttcaggtggacaggtggactcgagtaccacgtagttactttacagtaacgaaatcgagcgtaggggtaggaggacgtaaggaagtagttgggttaggttatttagttacgtgacgtagtcgtacctaaccttacgtaacctaagttcggtaggtcgggtacggtaccggacgtaaacgggacgtaagggtacgaactacgaacggtacgaagtgacggtctagacc

SEQ ID NO: 99556 - DNA, 573 bp, Homo sapiens
  misc_feature: GYAE6OF02GR3EU.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatagttgggttcttagtcgggccgtccgggtccctgacgaggttcagtggctaggtgatcagtcacagtatttacactagaaatcagcgagggtggaggacagaagtagtggttagggtatttagttactgtcatagactaacctactaacaaacttggtaggtagggaccggttcgggaccgaacggggaaccgaaagggtaggaaagtacgaacggacgtaacggtcggtaggtcgtacgacctaccgattccgttgttacgttactacgttcccttaccccg

SEQ ID NO: 99557 - DNA, 520 bp, Homo sapiens
  misc_feature: GYAE6OF02F5W02.40.81.H04.1.454.CMB.1.raw
  modified_base (497)..(497): a, c, t, g, unknown or other
  misc_feature (497)..(497): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacacccctgagcaactactacatacactggatgcggcacggcccctggacaggggttgagtggagtgggtggatcaaccctaccagaggtggcacaaagtatcgacagactttcgagggcagggtcacatgaccgtgggacgcgtccatcagcacagtactacatggatcgtagagcggtatcgaccgtctcgacgacgacggcatagtattacgtaggtaggagtagtcggttggnggtcgtaccgggcgggctaccgg

SEQ ID NO: 99558 - DNA, 687 bp, Homo sapiens
  misc_feature: GYAE6OF02H6K9U.40.81.H04.1.454.CMB.1.raw
  modified_base (315)..(315): a, c, t, g, unknown or other
  misc_feature (315)..(315): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagtctccactctccctgcccgtcactccgtggagacgccggcctccatctcctgcaggtctagtcagagccctacctaaaacactaaagtggaattactacttctttagaagtttggtaccctgcaagaagcccgagggctacgtcctaccacngcttcttagataagttagtttaggggttcttacggtccggggtcccgtcccggggttcctacggacgtagggtttcacggttggccgtaggttaggacgttcaagttccaacgtaagttaactttttaacaacgtttaaacgaaaattacgacggtacggtagggggtagggaagggaccggtaaaggtaaagtaaggtttaggtttaggggttaattttaacgtttactgtactagtacgacctaaccgtaccgttaaactaaacgtagttaggtacgggtaccgggtaccggaacccggaagggaacccggtaagggtaacgtaaacgtaccgtaaggacggtaacgtagggtcgtaccgtagtaacccg

SEQ ID NO: 99559 - DNA, 633 bp, Homo sapiens
  misc_feature: GYAE6OF02JA7PZ.40.81.H04.1.454.CMB.1.raw
  modified_base (405)..(405): a, c, t, g, unknown or other
  misc_feature (405)..(405): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagacggcctccatctcctgcaggtctagtcagacgcctactaaaacactaatggatactactcttgaattgtacctgacagaagccagggtcagtctccacagctcttagatatagttggggttactagtccgggtccgtccggggtaccctgtacgacggtttcaggtggctaaggtcgatcgaacgtcaacgtagtactttaacgactaagaaaactcgaacgngagggtagaggacgaaggaagagttggtagggtaatttacgtactagcgtatacggactaaccgtactaactaaacgtggttacgtacgggacgggttaccggaaccgaaacgggtaacccggaaagggtaaggaaaacgtacgtaacgacgaaccgttgggtaacggtcgtaacggaccgaacctaacgtcgttacgttaccgtacttacgtcccgtttaaccccgg

SEQ ID NO: 99560 - DNA, 669 bp, Homo sapiens
  misc_feature: GYAE6OF02JV6ZJ.40.81.H04.1.454.CMB.1.raw
  modified_base (150)..(150): a, c, t, g, unknown or other
  misc_feature (150)..(150): n is a, c, g, or t
tcagtctagcgactcacgaccggtgctcgatttagtagtgtagattcgcggggtgatcaggactcctcagttcaccttctcacaatgaggctccctgctctagctcctgggctgctaatgctctggtctctggatccagtgggatattgngatgactcagtctccactcctccctgcccgtcactcctggagacgccgcctccatcctcctgctaggtctacgtcagacgcctacctaaacacttaagtggactactgtcttacgtttgtaagttcggtacctgcaagaacgccgagggacagtcctccacgagtctcttagaacttagttagtttggggttacttacggtccgggtacccgttcccggggttacctaggaaccgtagggtttaccgaggtcggacgtacgttaggacttacgacgttacgacgtaggttaacttttaccgaacttaacgtaaaactccgtaaagtacggtaggggtaggaacggacgaaaggtaagtagttagggttaaggttattttacgttacgttcgtactacgtacgaactaacccgttacttaaacaacgttagtacgtacggtacgggtacgaacggaacggaacgtaaggtaacgtaacgtacgaacggtaccggaagttcggtacgttacgacgtaaccg

SEQ ID NO: 99561 - DNA, 584 bp, Homo sapiens
  misc_feature: GYAE6OF02HI6Z3.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtggggatattgtgatgactcagtctccactctccctgcccgtcactcctggagagccggcctccatcctcctgcaggtctagtcagacgcctacctaaacactaatggattaacctactctttagaattggtaccctgcagaacgccgaagggcaggtcctacccacagtcttcgttgattagttagttcggggtttacttagtccgggtccttcccggggtccctaggtactaggtttcgaggtggactagtgagtcagtcacagtatttacactagaaatcagacgagggtggagcgtaagagtagttgttaggtactttagttactgtacgtagtcgtactaaccttacgtaactaacgtggtacgtcgggtacggtacggaccggaagggaaccgtaaggtagaactacgaggtacgacgtggtacgtcgtagtacccg

SEQ ID NO: 99562 - DNA, 524 bp, Homo sapiens
  misc_feature: GYAE6OF02F6LRL.40.81.H04.1.454.CMB.1.raw
  modified_base (476)..(476): a, c, t, g, unknown or other
  misc_feature (476)..(476): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgaggtggagtggggtgatcaaccctacgagaggtggacaacgaaagtatcgaacagtaactttcgagggcgagggtcaccgatgacctgggacgcgtaccatcagcacagtctacatggatcgtgaggcggactgacctacgcgacgacacggcatagtntactggtagtaagagtacggttggtcggcgtaccgggtcgggctacgg

SEQ ID NO: 99563 - DNA, 783 bp, Homo sapiens
  misc_feature: GYAE6OF02HOTS2.40.81.H04.1.454.CMB.1.raw
tcagtctagcgactcacgaccggtgctcgatttagtagtgtagattcgcgggggaggcatcacccagcaaccacatctgtcctctagagaatccctgagagctccgttcctcaccatggactggacctggaggatcctcttcttggtggcagcagccgcaggagcccactcccaggtgcagctggtgcgagtcgtgggggctggaggtgaagaagccgtggggcctacgggtgaacgggtctccgtgcaaggactttctggaaaccaccgtagagacaacgtactacatacactggactgcgacacggcccgtaggaccgtaggggtttgaggtggaggtgggtaggagtaccgaaccgtacgaggaaggtcggacaacgaaagtagtacgaacgtaacgtaacgtttacgacgggtacgacggggtacctaacgagtacggtaccgtacgggaccggtaccggtccgtaacgtaccgacggtacccgtaacggaaccgttaccgttaaccgtaacgtacggggtaactaccgtacgggtacggtccgggtaaccggttaccggtaccccgttacggttaaccggaacccggtaaacccgttaccggggaaccccttaaagggttaaccgtttaacggtttaaccggttaacgggttacggtaaacggggtaacggttaacggggtttacgggtaacgggttacccgggtaaccggggtccggggggttaaaccgtacccggggtaacccggttacccggggtacccggggggtaacccgggg

SEQ ID NO: 99564 - DNA, 623 bp, Homo sapiens
  misc_feature: GYAE6OF02HXQWO.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagcccggcctccatctcctgccaggtctagtcagagcctacctaaacactaatggatactactctttgaattggtacctgcagaagccagggcagtctccacagctcttgattagtattggggttcttagtccgggtcctccggggtccctgacaggttcagtggcagtggatcagtacacagtatttacactagaaatcagcgagggtcgagacgaagaagagtggtttagggatttacgttactgtactagtgacctaaaccctctaaccgaaactggtagtacgggtaccgggttaccggaccgaaaggggtaacccgaaagggtacggaaaataccgaaggaccgaaaccggttggtaccgggtacgtaccggtacccgtaaccctaacgtttaccgttagttttacccctttacgttaccttacccgtttaccccccgg

SEQ ID NO: 99565 - DNA, 519 bp, Homo sapiens
  misc_feature: GYAE6OF02G3IEW.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctcctaaaacactaatggatactactctttgaattggtacctgcagaagccagggcagtctccacagctcttgatatagttggggttcttagtccgggtcctccggggtccctgactaggttcagtggcaggtgatcagtcacagtatttacactagaaaatcaagcgagggtggaggacgaagaagagttggttagggtatttagtactgcatgactaactctaacaactgtgtacggacgtcggacgaaggacgaaggtagaatcgaagcgaatggtaggctgcactacg

SEQ ID NO: 99566 - DNA, 711 bp, Homo sapiens
  misc_feature: GYAE6OF02I7UAS.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactctttagaattcggtacctgcagaacgccgaggggctacgtcctccaacgagtcttcttagaattagttagtttgggggtttcttacggtccgggtccgttcccgggggtccctggacgtagggtttcaggtcggcgtaggtggactcgagtacactagttaacttttaacaacgtaagaaaactcgaacgacggtaaggggtacggaaggacgaaaggtaagtacgtttagggtttacggggttaatttttaacgttaacgtagtacgttacgtacgtaaccctaaacccgttaccttaaaaccggtaaaccgtttgggttacgggttaccggggtaccggggttaccgggaacccgggtaaacggggtaacccggtaaaacggggttaacggtaaaaccgtacggaaacgggtaccggtaaccggttaggtaccggtacggtaccgtaacccg

SEQ ID NO: 99567 - DNA, 637 bp, Homo sapiens
  misc_feature: GYAE6OF02H2R5L.40.81.H04.1.454.CMB.1.raw
tcagtctagcgactcacgaccggtgctcgatttagtagtgtagattcgcggggagtcaggactcctcagttcaccttctcacaatgaggctccctgctcagctccgtggggctgctaatgctctgggtctctggatccaggtggggatattgtgatgactcagtctccactcctccctcgcccgtcactcctggagagcccggcctccactcctcctgcaggtctagcagagcctactaaacactaatggatactactcttgtaattggtacctgtcagaagacaggcgagtctccacagctcttgatatattgggttcgttagtcggccgtccggggtccgtcgacgacggtcgtagttggcgactggggggggtatacgagtcaacgaagtatttaactactagtaaaatactagacgtaacgggtaggaggacgagaagaagtaggttagggtaagtttaattagtacgtgtacgtaggactaacctactaacctaaacttaggtagtacgggtacgggttacggacccgggtaaacgggaaccggtaaacggggtaaacgggtaaacggtaacggttaaaccggaacgtaaacggttacgggtacggtacggtttcggacctaccgttaaacg

SEQ ID NO: 99568 - DNA, 516 bp, Homo sapiens
  misc_feature: GYAE6OF02HRXK9.40.81.H04.1.454.CMB.1.raw
  modified_base (411)..(411): a, c, t, g, unknown or other
  misc_feature (411)..(411): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttagtcgggcctccggggtccctgactaggttcagtggcagtggatcagtcacagtattttacactagaaatcagcagggtggagcagaagatgttggatttatatgctangtccaacctatacaactgtagtgggaccggtcggacaagggaccaaggagtaaatcgaagcgaagtcgtaggctaggcaccgatctgtcttacattcctaccccg

SEQ ID NO: 99569 - DNA, 374 bp, Homo sapiens
  misc_feature: GYAE6OF02FHR3K.40.81.H04.1.454.CMB.1.raw
  modified_base (240)..(240): a, c, t, g, unknown or other
  misc_feature (240)..(240): n is a, c, g, or t
  modified_base (361)..(361): a, c, t, g, unknown or other
  misc_feature (361)..(361): n is a, c, g, or t
  modified_base (366)..(374): a, c, t, g, unknown or other
  misc_feature (366)..(374): n is a, c, g, or t
tcagtctagcgactcacgaccggtgctcgatttagtagtgtagattcgcggggatactactctttgaattggtacctgcagaagccagggcagtctccacagctcttgatatattggggttcttatcgggcctccgggtccctgacaggttcagtggcagtggatcagtcacagattttacactgaaaatcagcagggtggaggcagaagatgttgggatttattactgcatgcaacctntacaaactgtgtggacggtcggccaagggaccaaggtggaaatcaaagcgaactgtgctgcaccatctgtcttcatcttcccgcatctgaatcgctagactgagcgggctggcaaggcganatagnnnnnnnnn

SEQ ID NO: 99570 - DNA, 536 bp, Homo sapiens
  misc_feature: GYAE6OF02FPYLO.40.81.H04.1.454.CMB.1.raw
tcagtctagcgactcacgaccggtgctcgatttagtagtgtagattcgcggggcgtagactttgtgtttctcgtagtctcccgtgctcgagctcctggggctgctaatgctctgggtctctggatccagtggggatattgtgatgactcagtctccactctccctgcccgtcacctcctggagagccggcctccatcctcctgcaggtctagtcaggagcctacctaaaacactaatggaatactactctttgaattggtacctgcagaagccagggcagtctccacagctcttgatatattggggttcttagtcgggcctccggggtccctgcaggttcagtgcagtggatcagtcacagtattttacactagaaatcagcgagggtggaggcagaagtatggttgggtatttatacgtgactatcgacaacctctaacaaatgtggtaggacggtcggaccgaagggacaaggtgaagtcgagacgaacgtggtcggactcgacaccattctgttctacgtacttcccgtcccg

SEQ ID NO: 99571 - DNA, 556 bp, Homo sapiens
  misc_feature: GYAE6OF02GQ8BJ.40.81.H04.1.454.CMB.1.raw
  modified_base (436)..(436): a, c, t, g, unknown or other
  misc_feature (436)..(436): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagcctggggcctcggtgaaggtctcctgcaagatttctggaaacaccctgagacaactactacatacactggatgcggcacggcccctggacgtaggggtttgaggtggagtggggtgatcaacctaccgagaggtgcaagaaagtatcgaacagtaactttcgagggacagggtacacgatcggacctggggaccgccgtacgatcgagacacgagtacctanatcggatcgtagagtcggactgaccgtagtcgacgaacgtacggactagtcgtatcgtaggagaaggagtaccgttggacggtccgtaacgggcgggtacctggaccgtggtaaccgggg

SEQ ID NO: 99572 - DNA, 668 bp, Homo sapiens
  misc_feature: GYAE6OF02JBBAC.40.81.H04.1.454.CMB.1.raw
tcagtctagcgactcacgaccggtgctcgatttagtagtgtagattcgcgggggagagccatcacccagccgtaaccacatctgtcctctagagaatcccctgagagctccgttccgtcaccatcggactggacctggacggatcctccttcttggtggcagcacgccgcacggagcccactcccaggtgcgagcgtggtgcagtctggggctgaggtgaagagccgtggggcctcgggtgaaggtctcctgcaagatttcaggaaacaccctgagcaactactacatacactggatgcggcacggcccctgggacgtaggggtttgacggtgggacgtgggggtcggacttccgaacccgtaaccgaggagggtacggacgaacgaaaaggtagtacggaactaacggtaacgtttcgaacggggtcgacggggttaccaaccgtagtacggaccgtggggaccgccggtcctaagtcgtaacgcgaacgtcgttacgtaacgtagtagggacttcgtagggacggtccgggacctcgggtaccgtacggtacggaacgtaaccggtacggccagttacgtattacgtaggtggtaacgagggtacgttagggtaccggttacggtaccgggcgggtacctacggtaaccggtcgtaacccgggggg

SEQ ID NO: 99573 - DNA, 555 bp, Homo sapiens
  misc_feature: GYAE6OF02HA2T6.40.81.H04.1.454.CMB.1.raw
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctccgtgcaaggtatttcgtaggaaaccaccctgagacaactactacataaactggatgcggcgacggccccgtggaccgtaggggtttgaggtgggagttgggggtaggactaccaaaccccgtaccgaggacggtggacaacaaagtatacgacacgtaactttcgaggcgagggtcacgagtgaccgtggacgcgtcatcagcacagctanatgatntgacgcggactcgacctgacgacacgcgcatgtactacgtagngaagnggacgttggcgtacgtaccggcggcgtacgaccgtcgtacgggacccgtaacggg

SEQ ID NO: 99574 - DNA, 560 bp, Homo sapiens
  misc_feature: GYAE6OF02HP5EA.40.81.H04.1.454.CMB.1.raw
  modified_base (252)..(252): a, c, t, g, unknown or other
  misc_feature (252)..(252): n is a, c, g, or t
  modified_base (426)..(426): a, c, t, g, unknown or other
  misc_feature (426)..(426): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagcgtggggcctcggtgaaggtctcctgcaagntttctggaaacacctgagcaactactacatacactgatgcggcagcccctggacgtagggttgagtggagtggggtgatacaacccgtacagaggtggacaacgaaagtatacgactagtacttcgaggcgaggtcacgatcggacgtgggacgcgtcagtcagcacgatacanatggtactcgagacgacgtacgtacgacctcgtacggaacgacgtaccgctagttcgtaacgttaccgttaggtaacggtaagtacgtacgggttacgggtacgtccggttaaccgggcgggtaccgtaccggg

SEQ ID NO: 99575 - DNA, 582 bp, Homo sapiens
  misc_feature: GYAE6OF02H4WQN.40.81.H04.1.454.CMB.1.raw
  modified_base (416)..(416): a, c, t, g, unknown or other
  misc_feature (416)..(416): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagagccctactaaacactaatggatactactcttgaattggtacctgacagaagccgagggcagtcctccacagtctcttgattagttagttggggttcttagtcgggtcccgttccggggtccctgactaggttcaggtcggcaggtcgatcgagtcacagtatttacatagaaatcagcgagggtaggaggnaaggaagagttaggttaggtaattttaagtactagtactagtacgacctaaccttactaactaacgttggtaggtacgggtacgggtaccggaccgaacgggtaccgaaagggtacgtaaagtacgtaaagaccggtaacgtggtacggcgtacgaccgtactacg

SEQ ID NO: 99576 - DNA, 717 bp, Homo sapiens
  misc_feature: GYAE6OF02IC1WZ.40.81.H04.1.454.CMB.1.raw
  modified_base (586)..(586): a, c, t, g, unknown or other
  misc_feature (586)..(586): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatagttgtgatgactcagtctccactctccctgcccgtcacctccgtggagcgtcccggcctaccatcctcctgacaggtctagtcagtagccctacctaaaacgactaagtaggaactaactacttctttagaaatttgggtaacctggacaacggaaacgcccgaagggcctaacgttccaccacacgtccttactttggaattagtttaggtttcgggggtttacttaacggtccgggggtcccgtttcccgggggtaccccttggtaacgtacgggttttcggacggtcggggactaagggtaggtacttacgagggttccaaacgtaggtttaacttttaacgaaccgttaaaggaaaacttacgaaggtacggtaaggggtagggaagaacggaaagtaagtaggtaggtttacggtaatttaacgtttacngtactagtacgtacaacccgttacttaacaaacgttcgttagtacgggacggttacggaccggtaaacgggaaccgttaagggaagtaaacgtcgaaacggacgtaacgttaggacggtactacggtaacc

SEQ ID NO: 99577 - DNA, 521 bp, Homo sapiens
  misc_feature: GYAE6OF02I7X1V.40.81.H04.1.454.CMB.1.raw
  modified_base (362)..(362): a, c, t, g, unknown or other
  misc_feature (362)..(362): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (456)..(456): a, c, t, g, unknown or other
  misc_feature (456)..(456): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtgggcctcggtgaaggtctcctgcaagtattctaggaacaccctgacgcaactactacatacactggatgcggcacggcccctggactaggggttgaggtggagtggggnggatccaacctaccgaggaggtggacaacaaagtanacganaacgtaacttcgagggcagggtcaccgatcggacccgtgggaaccgccgtcancgagcacagtctacatgatactgacgcggactcgactcgcgacgacgcggccgatgtactagtgg

SEQ ID NO: 99578 - DNA, 570 bp, Homo sapiens
  misc_feature: GYAE6OF02IC08J.40.81.H04.1.454.CMB.1.raw
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagaagccgtggggcctcgggtgaaggtctcctgcaagatttcnggaaaccnccgtgacgcaactactacatacactggatgcggcacggcccctaggacgtaggggttgaggtggagtggggtaggactaccgaaccctaccgaggtacggtcggacaacgaaagtactacgaacagtaactttcgaagggtcgacgggtacaccgagtcgaccgtgggacgtccgtacacgtacacgacacgtagtactaacgagtacggtatcgtggaacgtcggactacgaccgtcgacgacgacgacggccgtagtacgtacttacgtacgg

SEQ ID NO: 99579 - DNA, 536 bp, Homo sapiens
  misc_feature: GYAE6OF02GIS2O.40.81.H04.1.454.CMB.1.raw
  modified_base (244)..(244): a, c, t, g, unknown or other
  misc_feature (244)..(244): n is a, c, g, or t
  modified_base (352)..(352): a, c, t, g, unknown or other
  misc_feature (352)..(352): n is a, c, g, or t
  modified_base (467)..(467): a, c, t, g, unknown or other
  misc_feature (467)..(467): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagntttctggaaacaccctgagcaactactacatacactggatgcggcaggcccctggacaggggtttgagtggagtggggtgatcaacctaccagaggtgcacaaagtancgacagaactttcgagggcagggtcacgatgaccgtgggacgcgtcatcagcacagtctacatgatctagagcggactggacctcgtacgacgaacacggcagtcgtagttacgnggttggaagtaggtacgttaggtcggtacgtaccgggccgggtacgtacggtacccgtaggtaccgggg

SEQ ID NO: 99580 - DNA, 607 bp, Homo sapiens
  misc_feature: GYAE6OF02JAD8E.40.81.H04.1.454.CMB.1.raw
tcagtctagcgactcacgaccggtgctcgatttagtagtgtagattcgcgggggagccatcacccagcaaccacatctgtccgtctagagaatcccctgagagctccgttcctcaccatggactcggacctggaggatcctcttcttggtggcagcaagccgcaggagcccactcccaggtgcagctggtgcagtctggggctgaggtgagagcctggggcctcggtgaaggtctccgtgcaagatttcgtgaaacaccctgacgcaacctactacatacactcggatagcggcaggcccctggacgtaggggtttgacgtggaagtggggtggtatcaaccctacacggaggtcggacaacgaaagtacttcgaacgaggtaaccttttcgacgggacacggggtcacgattcgaaccgtgggacgcgtacgagtcacgacacaggttccaacgtagtacgggacttcgacggtagggcgggaaccgtggtaccctacggtacgaaccgtacgaaccggacctagtacgtacttaccgtagtccggaagtacggtacggtacgtggtaccgtacgggcggtctacggacgacggtcgggaacccgg

SEQ ID NO: 99581 - DNA, 684 bp, Homo sapiens
  misc_feature: GYAE6OF02HT20Q.40.81.H04.1.454.CMB.1.raw
  modified_base (402)..(402): a, c, t, g, unknown or other
  misc_feature (402)..(402): n is a, c, g, or t
tcagtctagcgactcacgaccggtgctcgatttagtagtgtagattcgcgggcacgaccggtgctcgatttagtagtgtagattcgcgggggagagcatcacccagcaaccacatctgtcctctagagaatcccctgagagctccgttcctcaccatggactggacctggaggatcctcttcgttggtggcagcgagccgcaggacgcccacctcccaggtgcagctggtgcgagtcgtggggctggaggtgaagaaggccgtggggcctcggtggaaggtctccgtgcaagtattcgtaggaaacacccgtgacgactaacgtactactactactacgtagggatcggcggccgacggccccgtgggtaacggtggggtttacgaggtgggaggtcggggnggtactaaccgtaaccccgtaacgaggtacgggtacggacgaaacgtaaacgtagttaccgaactaagttaaccgtttacggacgggtccgaaggggttaccaaccgtagtacgtaccggttacgggaccgtccggttaccctaagtaccgtacggtaccaacgtacgttacctaaacgtacgtcggtacgtcgtagggacggtacggtcctacggtacccgttaacggaccgaccggtaccgaccgggtaccctaagttaccggtttagtaccggttaggg

SEQ ID NO: 99582 - DNA, 614 bp, Homo sapiens
  misc_feature: GYAE6OF02I01MB.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgccaggtctagtcagacgcctacctaaacactaatggaatactactctttgaattggtacctgcagaagccgagggcagtctccacagctctgatattagttgggttcttagtccgggtcccgttccggggtccctggacgtacgggttccaggttggactaggtggactccgagtccacgtagttacgttttacaactagaaaatcagcgagggtggaggacgagaagtagttggttagggtatttacgttagtagactagtcgacctaaccgttactaacgtaacgttggtacggtacgggtacgggtacggaccgaacgggtaaccggtaaagggtaggaaacgttaccggaaacggacggtacggttacggtacggtacctaccggtaccgtaccgtacg

SEQ ID NO: 99583 - DNA, 662 bp, Homo sapiens
  misc_feature: GYAE6OF02JJZVR.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtgggcctcggtgaaggtctcctgacaagatttctaggaaacacctgagcaactacacatacactggatgcgacgacggcccctggacgtagggttgaggtggagtggggtgacgtacgaacccgtaccgaggaggtggacaacgtaaaaggtatacggaacgtaagtaacgtttcggaaggggcgtacgggtacaaccgagtacggtaaccggtggggtaaccgcccgttaccgagttaccgaacggacccgtaaacgtcgttacctaacgtagttacgggtaacttacgacgggtacggcggtaacctcggtaccgtcgacggaacgtaaccgaccggactagtacgttacttacgtaaggtagggtaaagtcgggttaacggttcgggtcggaacccggtaccggggtcgggtaccgtacggtacccggtacgggtaccggggg

SEQ ID NO: 99584 - DNA, 653 bp, Homo sapiens
  misc_feature: GYAE6OF02H11XU.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactcctccctgcccgtcacctcctggagacgcccggcctccatcctcctgcgaggtctagtcagacgccctactaaacacttaatggaacttacctacttcttgaattcggtacctgcaagaacgccgaggctagtcctcacgagtctcttgatagttagttgggttcttagtcgggtccctccgggtcctgactaggtcagttgactagtgactcgagtcaactagttaactttacacgttaaacgtaaactcgagtacggaggggtacgggaacgacgtaaaggtaaagttagtttagggttttaaggttaatttttaacgttacgtcgtaacgtagtaccgttacctaacccttaacgttaaaccgttaaacggttgttagggtaccgggtacgggtaccggtaccggaaacgggtaaccggtaaggggtaagtaaactacggaacggtaccggtaagttggtacggtcgtacggtaaccc

SEQ ID NO: 99585 - DNA, 655 bp, Homo sapiens
  misc_feature: GYAE6OF02GOHIF.40.81.H04.1.454.CMB.1.raw
  modified_base (444)..(444): a, c, t, g, unknown or other
  misc_feature (444)..(444): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatgttgtgatgactcagtctccactctccctgcccgtcactcctggagacgccggcctccatctcctgcaggtctagtcaagacgcctacctaaaacactaatggatactacttctttagaattcggtacctgacagaacgccgagggcagtctccacagctcttagattattaggtttcggggtttacttaggtccggggtcccgttcccggggttccctaggtacgtacggttcgtacggtggactagggtagtactacagtacactagttaactttacaactaagaaatcgagacggaggggtagagganaaggagtagttaggttaggttatttatacgtagacctatacgtacctaaccgttactaaaccgtaacgttggtacggtacgggtaccgtaccgggtaacgaacggggaaaccgtaagggtaagaacgtacgaacgtacgtaacggttggtcgtacctgaacccgtactacgttccggttacttaccgtttacgtacccttccgttaccccg

SEQ ID NO: 99586 - DNA, 588 bp, Homo sapiens
  misc_feature: GYAE6OF02ICQQU.40.81.H04.1.454.CMB.1.raw
  modified_base (415)..(415): a, c, t, g, unknown or other
  misc_feature (415)..(415): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagagcctacctaaacactaatggatactactcttgaattggtactgcagagccgaggcagtctccacagctctgattattagttgggtttcttagtccgggtccgtccggggtccctggactaggttcaggtggcgaggtggtatcgagtacacgtagtattttacactagaaactcagcgtagggtggaggngaaggaagtagttggttaggtatttagtacgtgactatacgtactaaccgttacgtaactaaacgttgtacggtacgggtacggtaccgggaccgaacgggaacccgtaagggtaacggaaacgtacgaacgaccggtaacgtcggtacggtcgtacggtaccgaccgtaccg

SEQ ID NO: 99587 - DNA, 646 bp, Homo sapiens
  misc_feature: GYAE6OF02JB8JR.40.81.H04.1.454.CMB.1.raw
  modified_base (294)..(294): a, c, t, g, unknown or other
  misc_feature (294)..(294): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtggggatattgtgatgactcattctccactctccctgcccgtcactcctggagacgccggcctccatctcctgcaggtctagtcagacgcctactaaacactaatgatactacttcttagaattggtacctgcagagccgaggcagtctccanacgctcttgattatagttggggttcttagtccgggtccgttccggggtcctaggaccgtaggttcaggtcggctaggtcggactacgtacgtacgaactacgtttaaactttttaccaacgtttaaggaaaaacttcgaacggtacggtaagggggttaacgggaacggtacgaaaggtaaaggtagtttagggttaagggttaacttttaattacgtgactacgtacgaccttaaccgtactaaacgtaacgttggtgttacgggacgtaccgggacggaaacggggaaccgtaaagggttacggaaacttaacggaacggacgttacgtagggtacggtactaggtaccg

SEQ ID NO: 99588 - DNA, 628 bp, Homo sapiens
  misc_feature: GYAE6OF02HT4KL.40.81.H04.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctcctgcccgtcactccgtggagngccggcctcatctcctgcaggtctagtcagacgcctacctaaacactaatggatactacttctttagtaattggtacctgacgaagaacgccgagggctagtcctccacngtctcgttgatattaggtttgggttcttagtccgggccgtcccgggtcctgacgtggttcaggtggacgaggtgatcgagtcacgtagttactttacaactagaaatcgagtcggtgggtaggaggacgaaggaagtaggttaggttaggttattttagttactgtactagtacgacctaaccgttacttaaacgtaaacgttaggtacgggttacgggaccgggtaccgggaaccggtaaacggggaaaccgtaaagggtaacggtaaacgtacggtaaacggtaccgggtaacgttgggtacggtaccgtacggtacccg

SEQ ID NO: 99589 - DNA, 579 bp, Homo sapiens
  misc_feature: GYAE6OF02FLPJP.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatcctcctgcaggtctagtcagacgccctacctaaacactaatggatactactctttgaattggtacctgcagaacgccgaggcagtcctccacagctcttgatattagttgggttcttagtcgggccgtccggggtccctgacgtaggttcaggtggctaggtggatcgagtcacgagtactttacactagaaatcgagcgagggtggaggacgaaggagtagttggttaggtaatttatagtcgtatagtagacctaaccttactaactaacgttggtacgtacgggtacggtccggaccgtaacgggaccgtaaagggtacggtaaactacgaacggacgtaacgttcggtacggtactacggacctacgtacg

SEQ ID NO: 99590 - DNA, 692 bp, Homo sapiens
  misc_feature: GYAE6OF02HQ5Y3.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatcctcctgcaggtctagtcagacgccctacctaaacactaatggaacttactacttcttagtaattcggtacctgacaggaacgcccgagggcacgtcctccacgacgtccttcgttagtattagttaggtttggggttcttacggtccgggtcccgttcccggggtccctgacgtaggttcgaggtcggcaggtgtatcagtcagtaagttactttacaactaagtaaactcgaaggtcggaaggggtagggaggaacgaaagggtaaagtaggtttagggtttagggttattttaacgttacttcggtactagtacgtaacctaaccgttaacttaaccgtaaaccgttgggtacgggtaccgggtaccgggtacgggtaaccgggaaacggggtaaaccgtaaacggggtaaacggtaaacgtaaccggaaacggtacggtaaacggttcgggtacggtacggtaccggtaccgtaccgttaccg

SEQ ID NO: 99591 - DNA, 580 bp, Homo sapiens
  misc_feature: GYAE6OF02HIL9H.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttagaattggtacctgcagaagccagggcagtctaccacagtctcttgatatagttggggttcttagtccgggcccgttccggggtccctgactaggttcagtggcgtagtggatcgagtcacagtattttacactagaaatcagcgagggtgaggacagaagagtgttagggtatttagttactacgtctaagtcgacctaacctactaactaacgtgtagggtacggacggttcggacccgtaagggaaccgtaaagggacgtaagtacgaacgacgaacgtcggtaggaccgtgaccaacctatccgtgttacttacctacgttcccgttaccccg

SEQ ID NO: 99592 - DNA, 663 bp, Homo sapiens
  misc_feature: GYAE6OF02GB7NL.40.81.H04.1.454.CMB.1.raw
  modified_base (269)..(269): a, c, t, g, unknown or other
  misc_feature (269)..(269): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtggggcctggtgaaggtctcctgcaagatttctggaaacaccctgancaactactacatacactggatgcggcacggccccgtggacgtaggggtttgagtggagtggggtgactaccaacccgtacgaggaggtcggacgaacgtaaaagtacgtacggaactaggtaaactttcgaagggaccgtacgggtaccaccgtagtacggaacccggtggggaccgtccggtaccctagtccgaacggaccacgtaacgttcctaaacgtattacgggaacttcggtaggtaccgggacggtaccgtacggtacccgtacggcgtaaccgacgaacccgggtctaacgttacggttaatttaccggtaggtaacgggtaacggtaacggttacgggtttcgggtacggggtacccttaccgggggccgggtaccgttaccggg

SEQ ID NO: 99593 - DNA, 624 bp, Homo sapiens
  misc_feature: GYAE6OF02IGY87.40.81.H04.1.454.CMB.1.raw
tcagtctagcgactcacgaccggtgctcgatttagtagtgtagattcgcgggggactgatcaggactcctcagttcaccttctcacaatgaggctccctgctcagctcctggggctgctaatgctctgggtctctggatcagtggggatattgtgatgactcagtctccactctccctgcccgtcactcctggagacgccggcctcactctcctgcaggtctagtcagacgcctacctaaaacactaatggactactacttcttagattggtacctgcagaacgccgagggcagtctccacagcttcttgaatattagttcggggttcttacgtccggggtccgttcccggggtcctggactggttcgagtggcagtggatcgagtcaactagtaacttttacacgtaagtaaaatcgaagtcgtagggtaggacggacgaagaagtagttacggttagggtaattttattacgtgtactagtacgacctaaccgtacgtaaacgtaaacgtggttaggtacgggtacgggtaccggaaccgggtaaacgggtaacccgtaaagggtaacggtaaacgtacgaaacggtacggtaaacgttgggtacggtcctacggtaacccg

SEQ ID NO: 99594 - DNA, 534 bp, Homo sapiens
  misc_feature: GYAE6OF02IZTYM.40.81.H04.1.454.CMB.1.raw
  modified_base (263)..(263): a, c, t, g, unknown or other
  misc_feature (263)..(263): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
  modified_base (529)..(529): a, c, t, g, unknown or other
  misc_feature (529)..(529): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatcctcctgcaggtctagtcagcgcctacctaaacactaatgatactacttcttanaagttggtactgcagaacgccgagggcagtcctccacagctcttgatattagttggggtttcttagtccgggtcccgttcccggggtcctacgaccgtaggttcgagtggcaggtggatcagtcanagttatttacactaagaaatgagcgagggtggagnaagagatgttagtattattatganatcgactaactactactaacgtgtagtggacggtcggacgacggaacaaggtagaacgtagaacgtacgaacgtggagcgngtacg

SEQ ID NO: 99595 - DNA, 700 bp, Homo sapiens
  misc_feature: GYAE6OF02IRZ8D.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcgttggtggcagcacgccgcgaggcgcccactcccaggtgcagctggtgcagtcgtgggctggaggtgaagaagccgtgggcctcggtagaaggttctccgtgacgaagtactttcgtagggaaaacctacccgtaggaacgacctaaactaactaactaactaacacgtaggaagtcggacggacgacggcccccgtagggaacggtagggggtttgaggtacgggtaggtgggggtagtaactaccgtaaacccgtacgaagggtacgggtggacaaacgtaaaacgtacgtacgaacgtaagtaacgtttacgacgggtaccgagggtaccaaccgtagtacggtaaccgtacggggtaccgcccgttaccgactaccgacgaccgtaacgtacgttacctaacgtagtacgggtaacttcgtagggtaaccggacggtaaccgtcggtaccgttaccgtacggtaaccggaaccgtaaccggaccgttaaggttacgtttaacgttacgtaacggg

SEQ ID NO: 99596 - DNA, 602 bp, Homo sapiens
  misc_feature: GYAE6OF02HJAWX.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaaccaccctgagacaactactacatacactggatgcggcacggccccgtggacgtagggtttgagtggagtggggtgatacgaacctacgagaggtggacacgaaagtatacgaacgaagtaactttacgaggggacacgggtacaaccgtaagtacggaccgtaggggaccgccggttaccaacgtacaaggaccaacgaacgtacctaaccagtagggtaactcgtaggacggcgggactaggaccgtaacggaccggtaaccaacgtaaccggatacgtagtactagtcgtaggaagtcgacgttaggcggacgtacggacgggtcgtacggaaccgtcgagggtaccg

SEQ ID NO: 99597 - DNA, 560 bp, Homo sapiens
  misc_feature: GYAE6OF02GXC1M.40.81.H04.1.454.CMB.1.raw
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (543)..(545): a, c, t, g, unknown or other
  misc_feature (543)..(545): n is a, c, g, or t
  modified_base (547)..(547): a, c, t, g, unknown or other
  misc_feature (547)..(547): n is a, c, g, or t
  modified_base (549)..(551): a, c, t, g, unknown or other
  misc_feature (549)..(551): n is a, c, g, or t
  modified_base (553)..(560): a, c, t, g, unknown or other
  misc_feature (553)..(560): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactccccaggtgcagctggtgcagtcgtggggctgaggtgaagaagccgtggggcctcggtgaaggtctcctgcaagtatttcgtaggaaaccaccctgagacaactactacatacactggatggcggcacggccccgtggacgtggggtttgaggtgggagtggggtgactaccgaaccctacgaggaggtggacacgaaagtacgtacgacgagtaactttagagggacgtacgggtccaacgtagtcggtaaccgtacggggaccgtcgtaccgagtaccgagaccacgacgtactacgtagtcggacttcgacggagggccgggtacgtacgggacgtaacgggccggacgaacgttgacgagngngngngnnngngnnngnnnnnnnn

SEQ ID NO: 99598 - DNA, 576 bp, Homo sapiens
  misc_feature: GYAE6OF02HPT8M.40.81.H04.1.454.CMB.1.raw
tcagtctagcgactcacgaccggtgctcgatttagtagtgtagattcgcgggggagagcatcacccagcaaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtgggcctcggtgaaggtctcctgcaagtatttctggaaacaccctgagcaactactacatacactggatgcggcaggcccctggacaggggtttgagtgggagtggggtggatcaacccgtacgagaggtggacacaaagtatcgacagtaactttcgagggcgagggtcaccagtcgaccgtgggacgccgtcatcagcacagtctacagttggatctaggagccggactcggaaccctcgtacgaccgacgacggccagtgtacttagtaggtacggaaggtaacggtacgggtttcgggtgggtacccggttaccggggccggggtaccgtacggacccgtaccgggtaccgggggg

SEQ ID NO: 99599 - DNA, 647 bp, Homo sapiens
  misc_feature: GYAE6OF02IJ9EF.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactccccgaggtcgcagctggtgcagtcgtggggctggaggtagaagaagccgtggggcctcggtgaaggtctcctgcaagtatttcgtaggaaacacctgacgcaactacacataacacgtaggatggcgcgacggcccctgggacgtagggtttgaggtggtagtggggtggtactccgtaaacccaccgtaaggaggtcgacaacgtaaagtcgtacgaacaacgtaacgtttagacgggcgacgggtacactagtcgacgtacgggacgccgactacgtcacgtacacgtacgtcttaacgtatacggtactacgtcgacggtccggaccgttgacccgtcgttacggaccgacgaaccggtcaagttaccgtattaccgtaggtacgggtaagtacgggttacggttacgggtaggtcccggttaccggggccgggtccgttacggaacccggtaccgggtcggggtaacccgg

SEQ ID NO: 99600 - DNA, 472 bp, Homo sapiens
  misc_feature: GYAE6OF02JJXL2.40.81.H04.1.454.CMB.1.raw
  modified_base (244)..(244): a, c, t, g, unknown or other
  misc_feature (244)..(244): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (457)..(459): a, c, t, g, unknown or other
  misc_feature (457)..(459): n is a, c, g, or t
  modified_base (461)..(472): a, c, t, g, unknown or other
  misc_feature (461)..(472): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagntttctggaaacaccctgagcaactactacatacactggatgcggcaggccccctggacacggggtttgagtggagtggggtggatcaacccgtaccagaggtggcacaaagtatcgacagaactttcgagggcagggtcaccgatcgacctgggacgcgtccatcgagcacagtctacatggatctgagcgggctggcagggcncatangnannngnnnnnnnnnnnn

SEQ ID NO: 99601 - DNA, 546 bp, Homo sapiens
  misc_feature: GYAE6OF02FJ8V2.40.81.H04.1.454.CMB.1.raw
  modified_base (242)..(242): a, c, t, g, unknown or other
  misc_feature (242)..(242): n is a, c, g, or t
  modified_base (402)..(402): a, c, t, g, unknown or other
  misc_feature (402)..(402): n is a, c, g, or t
  modified_base (437)..(437): a, c, t, g, unknown or other
  misc_feature (437)..(437): n is a, c, g, or t
  modified_base (482)..(482): a, c, t, g, unknown or other
  misc_feature (482)..(482): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagntttctggaaacaccctgagcaactactacatacactggatgcggcaggcccctggactaggggtttgagtggatgggggtggatacaaccctaccgaggaggtggacacaaagtactcgacagaactttcgaggggcagggtcaccatgacctggggacnccggtccatcagacacagtctaacagttggattcngacgcgggactcggacctgtacgaccgagacggcatgtattacgnggtaggaagacgtacggtggtaggccgtacgggcgggtcttacggaccgtacgtcgggtacccg

SEQ ID NO: 99602 - DNA, 595 bp, Homo sapiens
  misc_feature: GYAE6OF02IMOY2.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctggtgaacggtctcctgacaagtatttcgacggaaacctacccgtgacgacaactactacatacacgtggatgcggcacggcccgtaggacgtggggttgaggtggagtggggtacgactaccgaacccgtaccgaggacggtcggacaacgtaaagtacgtacggaacgtagtaaccgtttacggacgggtacgtacgggtccaaccgtagtaccgaccgtcgggacctccgtcacgtcacgctacgagtacctagagtcgatcgtaggacgtccggtactaccggtaccgtcgtaccggacgaccgcggacctagttcgtacgttagtacgg

SEQ ID NO: 99603 - DNA, 575 bp, Homo sapiens
  misc_feature: GYAE6OF02FXUKC.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaagggtctccgtgcaagtatttcgtggaaacaccctgagcaactactacatacactggatgcgcgaggcccctggacgtaggggttgaggtggagtggggtggactacaaccctacgaggacggtggcaacaagtatacgacagaacgtttcagggcgagggtcaccgatcgaccgtgggacgcgtccatcgacgacacacgtactacagtcggaatcgtaggacggcggtacgtcggacctcgtacgaccgacgacgtcctagtacgtacttacgtggtacggagacggtggttcggtacggtccgtacgggcgggtccgtacggaccgtaggtccggggtaacccgg

SEQ ID NO: 99604 - DNA, 568 bp, Homo sapiens
  misc_feature: GYAE6OF02IU5JC.40.81.H04.1.454.CMB.1.raw
  modified_base (244)..(244): a, c, t, g, unknown or other
  misc_feature (244)..(244): n is a, c, g, or t
  modified_base (530)..(530): a, c, t, g, unknown or other
  misc_feature (530)..(530): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtggggcctcggtgaaggtctcctgcaagntttctggaaacaccctgagcaactactacatacactggatgcggcacggccccgtggacgtaggggtttgaggtggagtggggtggactaccaacccgtaccaggaggtggacactaaagatcgaacagtaactttacgagggcgacgggtacaccgagtcgaccgcgggacgacgtcactcgagaccacgacgtctacatggactcgtggacggcggtacgtcgtaccgacgcgacgacgtacggccagttacgacttacgtagtaggagtcggtacggttaggnggtaccgtccggcggtccggacgtacgtcggtaccggg

SEQ ID NO: 99605 - DNA, 698 bp, Homo sapiens
  misc_feature: GYAE6OF02F5IVW.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtgggggatattgtgatgactcagtctccactctccctgcccgtcactcctggagagccggcctccatctcctgcaggtctagtcagagcctacctaaacactaatggatactactctttagaattggtactgcaagaacgccgagggcagtctaccacagcttcttagatatgtttggggttcttagtccgggccgtcccggggtccctgacgtaggttcaggtggacgtaggtggactcgagtacaacgtagttaattttacaacgttaagtaaaacgtcgtaagacggtaaggggtggaacgggacgaagggtaaggtagttaggggttagggttaagttttaacgttacgttaggtactagttacgtaacccttaaccctacctaaaccgtaaacgttggtacggtacgggtaccggggtaccggaaccggaaacggggaaccgtaaagggtaacggtaaacgtacgaacggtaaccggtaacggttgggtacgggtacgtaccggaaccgtaacccgttacggtttccgttacggttcccttacgttaccgttccccgtttaccccgg

SEQ ID NO: 99606 - DNA, 580 bp, Homo sapiens
  misc_feature: GYAE6OF02IMBP0.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagccctcctaaaacactaatggatactactctttagaattggtacctgcagaagccagggcagtctccacagctcttgatatagttggggttcttagtcgggccgtccggggtccctgacgtaggttcagtggcgtagtgatcgagtcacagtatttacatagaaaatcgagcgaggggtggaaggcgaagaagagttggttagggtattttacgttatgacatgactaacctactaactaacgtggtacggtacgggacgggtccggacgaaacggggaccaaagggtacgaaatacgaacgacgtaacgtggtacggcctcgaccaaccgtacgttcgttcgttccttactacttcccgttaccccg

SEQ ID NO: 99607 - DNA, 640 bp, Homo sapiens
  misc_feature: GYAE6OF02HHS2P.40.81.H04.1.454.CMB.1.raw
  modified_base (616)..(616): a, c, t, g, unknown or other
  misc_feature (616)..(616): n is a, c, g, or t
  modified_base (635)..(635): a, c, t, g, unknown or other
  misc_feature (635)..(635): n is a, c, g, or t
tcagtctagcgactcacgaccggtgctcgatttagtagtgtagattcgcgggggagcatcacccagcaaccacatctgtcctctagagaatcccctgagagctccgttctcaccatggactggacctggaggatcctcttcttggtggcagcagccgcaggagcccactcccaggtgcagctggtgcagtcgtgggctggaggtgaagagccgtggggcctcgggtagaacggtctccgtgactaagtatttcgtacggaaaacctacccgtaggacgacctaaactacttaacgaataccgacgttggaatcggcgacgacggtccccgtaggacggtaggggtttgaacggtggtaggtggggtagactaccgaaacccgtacgaggacggtgacaacgaaagtacgacgaacgtaagtaactttcggaacgggacgtacggggtacaaccgtaagtccggaccggtacggggactacccggtacacgtacaacgccaacgtagtacctaacgtagtacgtacttcgaggagggtccggacgtacgggaccgtaaggggaccgtaactaacgggttaccacgtacgactagtacggacaaggctagcgtaacgngacgtcggcgtgacgcganagcgg

SEQ ID NO: 99608 - DNA, 555 bp, Homo sapiens
  misc_feature: GYAE6OF02HTULL.40.81.H04.1.454.CMB.1.raw
  modified_base (294)..(294): a, c, t, g, unknown or other
  misc_feature (294)..(294): n is a, c, g, or t
  modified_base (380)..(380): a, c, t, g, unknown or other
  misc_feature (380)..(380): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtgggcctcggtagaaggtctcctgcaagatttctggaaacnccctgagcaactacacatacactggatgcggcaggcccctggacgtaggggttgaggtggagtggggtgatccaaccctaccaggnggtagacaacgaaagtagtcgaacgagtaaactttcgaagggcacgggtacgaaccgtagtaggaccgtggggaccgccggtaccagtccaggtaccaacgtacgttactaccgaagtcggactcgtaggtacggcggggtctacgggacgaacggcgacgacgtagnngncnng

SEQ ID NO: 99609 - DNA, 682 bp, Homo sapiens
  misc_feature: GYAE6OF02JBK2B.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgccctacctaaacactaatggatactactcttgaattggtacctgcagaacgccagggcagtctccacagctcttgattagtagtttcggggttcttacgtccgggtccgttcccggggtcccttggaccgtagggtttccagggttcggaccgaggtgggtaacttcgaacggttcaaccgtaggttaacttttaaccaacttaagtaaaaacttcgaacgtaccggtaaggggtagggaacgggtacgaaggtaaaggttaagttagggtttaggggttaattttaacgtttacgtggtactagttacgtaccctaaccgttacctaaacgtaaaccgttggttacggtacgggtaccgggtaccgggaccgtaacggggtaacccgaaagggttaacggaaacgttacggaacggtaccgtaacgtggtacggtacgtcggacctaaccgtacg

SEQ ID NO: 99610 - DNA, 577 bp, Homo sapiens
  misc_feature: GYAE6OF02G8Q2C.40.81.H04.1.454.CMB.1.raw
tcagtctagcgactcacgaccggtgctcgatttagtagtgtagattcgcgggggtaggcatcacccagcaaccacatctgtcctctagagaatcccctgagagctccgttcctcgaccatggactggacctggaggatcctcttcttggtggcagcagccgcaggagccccactcccaggtcgcagctggtgcagtctggggctgaggtgaagagcctggggcctcggtgaaggtctcctgcaagatttctggaaacaccctgagcaactactacatacactggatgcggcaggcccctggacagggtttgagttggagtggggtggagtccaaccctacgaggaggtggacacgaaagtatcgaacgagaactttcgagggtctaggggtaccaccgtatgaccgttgggaaccgcggtccgagtcagcacagtctacagtggatcgtgacgcggactcgacctctagacgaccaacggtccaagtcgtaacgttacgtcggtagggaagtaacggtacgttgggtacgtaccgttaccgggcgggtacctccggaccctacggtcgggtacccgg

SEQ ID NO: 99611 - DNA, 726 bp, Homo sapiens
  misc_feature: GYAE6OF02G9J9F.40.81.H04.1.454.CMB.1.raw
  modified_base (282)..(282): a, c, t, g, unknown or other
  misc_feature (282)..(282): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactcctccctcgcccgtcactccgtggagacggcccgcctccatcctcctgcaggtctagtcagacgcctacctaaacactaatggatactacttcttagtaattcggtaccngacagaacgccgaggacagtcctccacacgtcttcgtagtattagttagtttcggggttctttacggtccgggggtcccgttcccgggggtaccctaggtacggtacggtttacgagggtcggtacgaggttcggactacgtacgtacgaacgtaagtttaactttaaccgaactaagtaaaacgtcgaacggacgggtaacgggggtaggaacgggtacgaaaaggtaagttaacggttaggggttaagggtttaaactttttaaggtaacgttcgggtaccttagttaccgaacccttaaccgttacgtaaaaccgttaacgttggggtaccggtacgggtacccggggtaaccggtaaccggtaaaaccggggtaacgtaagggggttaacgaaaacgttccgaaacgtacggtaagttacgggtacgacgtacgtacccg

SEQ ID NO: 99612 - DNA, 568 bp, Homo sapiens
  misc_feature: GYAE6OF02JONKR.40.81.H04.1.454.CMB.1.raw
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
  modified_base (560)..(561): a, c, t, g, unknown or other
  misc_feature (560)..(561): n is a, c, g, or t
  modified_base (564)..(565): a, c, t, g, unknown or other
  misc_feature (564)..(565): n is a, c, g, or t
  modified_base (567)..(567): a, c, t, g, unknown or other
  misc_feature (567)..(567): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcgaggagcccactcccaggtgcagctggtgcagtcgtggggctgaggtgaagagccgtggggcctcgggtgaaggtcctccgtgacaagtattttcaggaaaccacccgtgagcaactactacatacactggatgcgcaggcccctggcgagggtttgagtggagtcggggtgatccgaaccctcgacggaggtggaccaacgaaaggtactacggaaccagtaaacctttcgaaggggtcgacgggttacaaccgagtacgtaccgtgggaaccgtcgtccagtccgagaccgtacacgtacactagtcggtataccgtggacggccgggtcgtaggaccgaacggggaccgtacgaaccgttaacgggnacgngngngcgcgngcgacgcgagcgcgcgnngcnngng

SEQ ID NO: 99613 - DNA, 696 bp, Homo sapiens
  misc_feature: GYAE6OF02HEH2N.40.81.H04.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagtctagcgactcacgaccggtgctcgatttagtagtgtagattcgcggggactgatcaggactccctcagttcaccttctcacaatgaggcctccctgctcagctccgtggggctgctaatgctcgtgggtctcgtggactccgaggtggggattattgtgatgactcagtcctccactcctccctgcccgtcactccgnggagcgcccgcctcatcctcctgcagtctagtcagcncctacaaacatagtgactactacttcttagaattcggtacctgacaagaacgccgagggcacgtccaccacgacgtcttcgttagaactttagttaggttttcggggttacttacgggtcccgggtccccggttcccggggtccctaggtaaccgttaggtttcgaggtcggacgtaggtcgatacgagtacacgtagtttactttaacaacgttaaagtaaacgttcgaacgggacgggtaggggtacgggacggaacgaaaggtaaggttaggttaggggtttaggtttaattttaacgttacgtagacgttacgtacgtaacccgtaaccttaacgtaaacgtaacgttgggtacgggtacgggtaccgggtaccggaaccgggaaacgggtaaccggtaagggtaacgtaacgtacggaacggacgttaacggtgggtacggctaccgtacc

SEQ ID NO: 99614 - DNA, 649 bp, Homo sapiens
  misc_feature: GYAE6OF02GNPPC.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtgggctgaggtgaagaacgccgtgggcctcggtagaaggtctccgtgacaagtatttcgtaggaaaccacccgtgagcaaactactacatacactggatgcggcgacggcccctggacgtaggggtttgaggtggagtggggtgactacaacccgtacgaggaggtggacaacgaagtacgtcgaacgagtaacgtttcgacgggacgaggtaccaaccgtagtacgaccggtacgggacgtccgtaccgacgtaccgacggtaccaaccgtacgttaccttaacgtagttacggacttcgtacggacgggaccgggtacgtacggtaacccgtaggtacgtaccgaacgtacggactacgtacgttacttaggtcgtaggaagtacggtaacggttcgggacggttacggccgggtacgggtcgtacggtacccgtacgggtcgggtaacccggg

SEQ ID NO: 99615 - DNA, 596 bp, Homo sapiens
  misc_feature: GYAE6OF02GO9Q3.40.81.H04.1.454.CMB.1.raw
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagtctagcgactcacgaccggtgctcgatttagtagtgtagattcgcgggggaggcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaaggaagctggggcctcggtgaaggtctcctgcagattctgaaacgaccctgagcaactactacatacactggatgcggcaggccctggaccaggggtttgagtggatggggtggatcgaacctaccagagtgcacaagtatcgacagactttnaggcagggtcaccatagacgtggacgcggtcngtcagactacngtactcaagtggatacgtgacggacggaacgtggtaccctacgttacggaaccgacgaaccggcccgtaagttacgtagtttaccgtagggttcgggaaaacggtacggtaacgggtttggggtacgggtaccgttaaccgggttaccgggggcgttaacggaccccggtacggttacggggaaccccgggg

SEQ ID NO: 99616 - DNA, 647 bp, Homo sapiens
  misc_feature: GYAE6OF02F17QZ.40.81.H04.1.454.CMB.1.raw
  modified_base (390)..(390): a, c, t, g, unknown or other
  misc_feature (390)..(390): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctctgcaggtctagtcagacgcctacctaaacactaatggataacttacttcttttgaatttcggtaacctgacaagaacgccgagggcacgtcctaccacagtcttcttagattaattaggtttggggtttacttacggtccgggtcccgttccggggtcctgacgtaggttcaggtcgngtagtgatcgagtcaactagttaactttaacgactaagaaaattcagtacgtggggtacggaggcgaaaggaagtaagttggtttagggttattttaacgtacgtacgactagtaccgtactaaccgttactaaacgtaaacgttcggtacggttgggaccgggtacgggacccggtaaaacgggaaccgtaaacgggttaaggaaaactaccggaaaggtaccgttaaaccgtggtaccggtacgtacgtaacccg

SEQ ID NO: 99617 - DNA, 604 bp, Homo sapiens
  misc_feature: GYAE6OF02IITS0.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagagccgtggggcctcggtgaaggtctcctgcaaagtatttcgtaggaaaaccaccctagacgacaactactacataacacgtggatgcggcgacggcccctggacgaggggtttgaggtggagtggggtgactaccaaccctacgaggaggtcggacaacaaagtactacgaacaacgtaaactttcgagggacgtaacgggtaccaccagtacggaccgttagggacgccgtaccactcaacgacacgtagtacctagtagtagggattccgtaggacgacgggtacgtcgaccgtacggtacgaccgtacgacggtacagtcgtaactacgtggtacggaagacggtacggttcggtggtacccgtacgggtcgggactaccgg

SEQ ID NO: 99618 - DNA, 566 bp, Homo sapiens
  misc_feature: GYAE6OF02GWOJ6.40.81.H04.1.454.CMB.1.raw
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactacttctttagaattggtacctgcagaacgccgagggcagtctccacagtctcttgatatagttggggttcttagtcgggccgtccggggtcctgactaggttcaggtggcgagtgatcgagtcactagtactttacactagaaatnagcgtgggngacggcgaagagtagttggttaggtaatttagtacgtgactagtcgactaacccttataaccaaattggtaggttacgggacgggtcggaccggaagggaccgtaaagggtacggaaacgtacgaaggccggtaagttcgggaggtccgtagacccg

SEQ ID NO: 99619 - DNA, 585 bp, Homo sapiens
  misc_feature: GYAE6OF02HPGK7.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacttggaggatcctcttcttggtggcagcagccgcaggagcccactcccaggtgcagctggtgcagtctggggctggaggtgaagaagccgtggggcctcggtgaaggtctccgtgcaagtatttctaggaaaccacccgtgacgacaactactacataacactggatgcggcacggcccctggacgtaggggtttgaggtggagtggggtagacgtaccaacccgtacgaggaggtacggacgaacgaaagtacgtacgaacagtaacgtttacgacgggacgacggtcaccgtagtacgtaccgtcgggacgtcgtaccgagtaccacgcacgacgttactacgacgtagactcgtagacggacggtactcgtaccgtacgtaccggacgaacgacggtaccagtacgtactaggtacgg

SEQ ID NO: 99620 - DNA, 613 bp, Homo sapiens
  misc_feature: GYAE6OF02HR6V8.40.81.H04.1.454.CMB.1.raw
tcagtctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactacttcttagaattcggtacctgcagaagccgaggcagtcctaccacagctcttgattagtagtttgggtttacttagtccggggtcccgtccggggtccctggactggttcgaggtcggctaggtggatcgagtacacgtagttactttacactaagaaaatcagcggagggtaggaggacgaaggaagtagttggttagggttatttaagttactgactatcgacctaaccttactaaaccgtaacgttggtacggttacgggtacgggtaccgggaccgtaacggggtaaccgtaagggtaacggtaaacgtaacgtaaggaccgtaacggttggtacggtacgtacgaccgtacctacg

SEQ ID NO: 99621 - DNA, 546 bp, Homo sapiens
  misc_feature: GYAE6OF02GNWG0.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccaggcagtctccacagctcttgatatattggggttcttagtcgggccgtccggggtccctgactaggttcagtggcagtggatcagtcacagtattttacactagaaatcagcgagggtggaggcaagaagagttggttgggtattttatactgctatgacaactctaacaactgtagtggacggtcggacgaacgggacaaggtagaaatcaagcgaacgtggtacggtcgtacgacctaccgtattacggttcgtcctttactaccttcccgttaccccgg

SEQ ID NO: 99622 - DNA, 660 bp, Homo sapiens
  misc_feature: GYAE6OF02I1YXA.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtgggcctcggtgaaggtctccgtgcaagtattctggaaacaccctgagcaactactacatacactggatgcggcacggcccctggaccgaggggtttgagtggagtggggtgatcaaccctacgaggacggtggcaacaaagtactacgacagaactttcgagggtcgacgggtccaacgtagtgacccgtaggggaccgtccgtccgatccgaaggaccaaccgtacgttaccgtaaccgtagttacggacttccgtggaacggtcccgggtattccggtaccctcgttacggaaccggtaccgtaaccggaccgtaagttacggtttaacttacgttagggtacggaaacggtaacgggttaccgggtttggggtacggtcccggtacccggggtcggggtaccgttaccgggaccccgtacggggtccgggggtaaccccggg

SEQ ID NO: 99623 - DNA, 602 bp, Homo sapiens
  misc_feature: GYAE6OF02IJH4O.40.81.H04.1.454.CMB.1.raw
  modified_base (488)..(488): a, c, t, g, unknown or other
  misc_feature (488)..(488): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggttctcctgcaagatttctggaaaccacctgagcaactactacatacactggatgcggcgacggcccctggacgtaggggttgaggtgggagtggggtaggtacgtacaacccgtacgacggaggtcggacaacgaaagtatcgaacaacgtaactttacgagggacgaggtacacgagtcgacgtagggacgtccgtacacgtacgacgacacgacgtactaacagtggacttcgagacggcggaacgtgacctcncgacgaccacggactagtgttacttagtaggtaggtaaggtacggtaggttagggtcggaccgttaccggggcggggtactcgggtaacccgtacgggtacggggtaacccggg

SEQ ID NO: 99624 - DNA, 659 bp, Homo sapiens
  misc_feature: GYAE6OF02G8F5S.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatcctcctgcaggtctagtcagacgcctacctaaacactaatggatactactctttgaattgtactgcagaacgccgagggcacgtcctccacagtcttctgattattagtttggggtttacttacgtccggggtcccgtcccggggtccctgacgtaggtttcaggtggcgaggtggtactcgtagtcaacgtaagttaacttttaccgtaacgtaagtaaaacgttcgtaagtcggtggggtagggacggacgaaggaagtagttggttagggttaatttaagttagtcgactagtacgacctaaccttacctaaacgtaaacgttaggtacggtacgggtaccgggtaccgggtaacccggaaacggggtaacccggtaaagggtaacgggtaaactaccggtaaacggtaccggtaacggttacggtacgggtaccgtcggtaacccg

SEQ ID NO: 99625 - DNA, 780 bp, Homo sapiens
  misc_feature: GYAE6OF02HS01D.40.81.H04.1.454.CMB.1.raw
  modified_base (715)..(715): a, c, t, g, unknown or other
  misc_feature (715)..(715): n is a, c, g, or t
  modified_base (756)..(756): a, c, t, g, unknown or other
  misc_feature (756)..(756): n is a, c, g, or t
  modified_base (766)..(766): a, c, t, g, unknown or other
  misc_feature (766)..(766): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgacaggagcccactcccaggtgcagctggtgcagtctgggggctggagggtagaaaggaagtcccgtcgggggcctcgggtggaaaggtccttaccgtggactaaaggtacttttacgacgggtaaaaccctaccccgttaggacgtaccaaaaccttaacttaacctaataaccacgttcgggaactcggccggtccgaaaccgggcccccggtagggaaccggttagggggtttttaggaacgggttggggtaaggttagggggggtacggtaacgtaacccgtaaacccccgttaacgaaacgggttaggaccggggactaaaacgtaaaacggttagtaaccgaactaaaggtaaccgttttaccgaacgggggtacgtacggggttaacaacccgttaacgtacgtaacccgggtaacgggggtacccgtaacccgtaccgtattaccgaacgttaaccgacctaacggttacctaaacgtgtagggtaccttacgacgtacgggcggtaaccgtacgacctcgtagaccgagacgactattacgtattacgnggtaacggagtacggtagtcggtaggcctacgggcgggacnggtaacccgnggtagggaacccgg

SEQ ID NO: 99626 - DNA, 586 bp, Homo sapiens
  misc_feature: GYAE6OF02II76N.40.81.H04.1.454.CMB.1.raw
  modified_base (288)..(288): a, c, t, g, unknown or other
  misc_feature (288)..(288): n is a, c, g, or t
tcagtctagcgactcacgaccggtgctcgatttagtagtgtagattcgcgggcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctcggtgcagtctggggctgaggtgaagaagccgtggggcctggtgaaggtctcctgcaagatttcnggaaacaccctgagacaactactacatacactggatgcggcacggcccctgggacgtagggggtttgaggtgggagtgggggtggaattaccgaaacccgtaccgagggagggtaggacgaacgaaaggtagtacgaacgagtaaaccgtttacggaaggggcgacgggtccaaccgtagtcggaccgtaggggaccgccgtcgactacgagaccacgacgtctaacagtcggaatcgtagaggcggactacgaccttacgacgacggacgaccggcctagttcgtagttacgtaggg

SEQ ID NO: 99627 - DNA, 757 bp, Homo sapiens
  misc_feature: GYAE6OF02GBALF.40.81.H04.1.454.CMB.1.raw
  modified_base (258)..(258): a, c, t, g, unknown or other
  misc_feature (258)..(258): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtgggcctcggtgaggtctcctgcaagtatttcgtaggaaaccnccctgagcaactactacatacactggatggcggcacggcccctggacgtaggggtttgaggtggagtggggtagacgtaccgaacccgtacgaggaggtcggacaacgtaaagtagtacgaactaacggtaactttacgacgggtacgtacggggtaccaaccgtagtacggacccgttacggggaaccgtccggtaccctacgtaccgacggacccgtaaccgtaacgttaccgttaaccgtaacgttacgggaacgttaccgtacgggtaacgggtacccggggttaacgtacggggttaaccccttacgggtaccgggaaacccgtaaccgggtacccgggtacccgtaggtttaccgggttaaccgttttacgtaacggggttaacgggtaaacggttacgggttaaaccggtttcgggttaaccgggaccgggttttacccgggacccgggggttacttacccggggtaacccgttacgggttaacccgggggg

SEQ ID NO: 99628 - DNA, 774 bp, Homo sapiens
  misc_feature: GYAE6OF02IGQH5.40.81.H04.1.454.CMB.1.raw
  modified_base (156)..(156): a, c, t, g, unknown or other
  misc_feature (156)..(156): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (456)..(456): a, c, t, g, unknown or other
  misc_feature (456)..(456): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattggngatgactcagtctccactctccctgcccgtcactccgtggagacgtccggcctaccactcctcgcacggtccgtatccagagaccctcctaaacctaccgtaaatggtaactactaccttaccgttnttaacgtttggtacccttagtcacgtaanaccgtacgggntacgttcctaccctaccgaacgtccgttacgttataccgttaagtaccgttttagggttccgtttacgttccgggtccggttccccggggttaccctacggggtaccttacggggttacgtcgggttaacggnggtacggttacgacgttacgtacgttacaggttaattacgtttacgtaacgtaacgtaaacgtactaacggacgttagggtacgggtacggtacggtaaggacgttaacgttaacggggttaggttaacgtttttaacgtagtttaacggtcgtaacgttacgaccgttaaccgtaccttaaacgtaacgttacggtggttacggggtacggtacccgggaacggtaccggaacggggtttaaacgacgggtttaaacgaacggtaacgttaccgggtaacgtcgggttaacgggtcgttaacccggtataaccccgg

SEQ ID NO: 99629 - DNA, 654 bp, Homo sapiens
  misc_feature: GYAE6OF02H3DCJ.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtcgcagtcgtggggctggaggtgaagaacgccgtggggcctcgggtgaaggtctccgtgcaagtatttcgtaggaaccaccctgacgacaacctactaacataccagtggatgcggcgacggccccgtggacggtggggtttgaggtgggtaggtggggtgactacccgaacccgtacgaggtacggtggacaacgtaaaggtactacgaacgaagtaactttcggacgggtacgaagggtccaaccgtagtacggtacccggtacggggaaccgtccgtaacacgtacgagacacgtagtacctaagtgtacgtgtacgtggaacggccgtacgtaggaaccgtcggtaacgaccgtacgaccggtactagttgttacgttcgagggtacgtaaggtacgggtaggtacgggtaccgtacgggaccggtacgggccgtaacccggtccgggtaccgggtacccggg

SEQ ID NO: 99630 - DNA, 570 bp, Homo sapiens
  misc_feature: GYAE6OF02GNXP4.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagtctccactctccctgcccgtcactcctggagacgccggcctccatctcctgcaggtctagtcagacgcctcctaaacactaatggatactactctttagaattggtacctgcagaagccagggcagtctccacagctcttgatatagttggggttcttagtcgggtccgtccgggtccctgacaggttcagtggcagtgactcagtcacagtacttttacactagaaaatcgaagacgagggtggaggacgaagaagagtaggttgggtaattttagttactgactatacgacctaaccttctaacaaacgttgtacggtgggtacgggtccggaccggaaacgggaaccgtaaagggtacggaaacgtacgaacggacggtaaccgttggtaggtcgtagtacccg

SEQ ID NO: 99631 - DNA, 547 bp, Homo sapiens
  misc_feature: GYAE6OF02H98JZ.40.81.H04.1.454.CMB.1.raw
  modified_base (258)..(258): a, c, t, g, unknown or other
  misc_feature (258)..(258): n is a, c, g, or t
  modified_base (442)..(442): a, c, t, g, unknown or other
  misc_feature (442)..(442): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcgggtgaaggtctcctgcaagatttcnggaaacaccctgagcaactactacatacacgtggatgcggcacggcccctggacgtaggggtttgaggtggagtggggtaggatcaaccctaccgaggacggtaggacacaaagtatacgacagtaactttcgagggcagggtcacgatcggacgtgggacgcgtccatcgagcacagtctacngtaggatctaggagcggactcgacctgcgacgacgacggcctagtagtacgttcgtaggtaggaagtaggtacgttgggtcggacggtaccggcgggctaccggg

SEQ ID NO: 99632 - DNA, 575 bp, Homo sapiens
  misc_feature: GYAE6OF02IKD22.40.81.H04.1.454.CMB.1.raw
  modified_base (292)..(292): a, c, t, g, unknown or other
  misc_feature (292)..(292): n is a, c, g, or t
  modified_base (509)..(509): a, c, t, g, unknown or other
  misc_feature (509)..(509): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctctgcaagatttcaggaacncccgtgagcaactactacatacactgatgcgcacggccctggacgtagggttgaggtggagtggggtgagtaccaaccctacgaggagggtacggacaacgaaagtataccgaacgagtaaccgtttacgagggtacgtagggtaccaacgtagtcgaccgtcgggaccgccgtaccagtaccgacgacacgtacgtacaacgacgtcggacttcgngacgcggactcggtaccgtccgtacgaccgaccgaccggaccgtagtacgttacgttacgtacggg

SEQ ID NO: 99633 - DNA, 519 bp, Homo sapiens
  misc_feature: GYAE6OF02FMV5Q.40.81.H04.1.454.CMB.1.raw
  modified_base (461)..(461): a, c, t, g, unknown or other
  misc_feature (461)..(461): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagccccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctacgtgacgacgacgccatgtattacngtaggaagacgacggttggtggcgtaccggcggggtcctggacccacgtggggacccg

SEQ ID NO: 99634 - DNA, 626 bp, Homo sapiens
  misc_feature: GYAE6OF02JEP9U.40.81.H04.1.454.CMB.1.raw
  modified_base (593)..(593): a, c, t, g, unknown or other
  misc_feature (593)..(593): n is a, c, g, or t
  modified_base (600)..(600): a, c, t, g, unknown or other
  misc_feature (600)..(600): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
  modified_base (608)..(609): a, c, t, g, unknown or other
  misc_feature (608)..(609): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgacaagtattctaggaaacctaccctgagacaactactacatacacgtggatgcggcgacggccccgtggacgtagggtttgagtggagtggggtggataccgaacccgtacgaggaggtggacaacgaaagttacgtacgacgtaaggtaactttacggaacggggtcgtaacggggttaccgaaccgtaacgtacggtaacccggtacggggaaccggtccggtacccgtacgtaccgaacgtaccgaaccgtaaccgttacgtaaccgtagttacggtacgtaccgttaggacgggtcgggtacggtacgggtaaccggtaacgggaccggtactagggggtaatacgcgagngtacganagnngngnngngcngagngcgngnng

SEQ ID NO: 99635 - DNA, 742 bp, Homo sapiens
  misc_feature: GYAE6OF02ILFBQ.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactcctccctcgcccgtcactcctggagacgccggcctccatctcctgcaggtctagtcagacgtcctacctaaaacactaagtgattactacttctttagaatttcggtacctgacaaggaacgcccgaggggacctacggttcctaccaacacgtccttcgttagtacttagttaggttttcggggttacttacggtccgggtcccggttccggggtccctaggaacgtcggttacgaggtcgggacgagggttgactacgtacggtacctaacgtaagtttaacttttaaccgaacgttaacgtaaaactcgaaggtacggtaaggggggtacggaagggaccgaaagggttaaacggttaggtttacgggtttaagggtttaacttttaaacgttaacgtcggtaacgtaacgtccggtaacccttaaacccgttaaccttaaacgtaaaccgtttggtacggggttacgggtaccgggtaccgaaccgggtaacggggtaaccggtaaacgggtacggtaaaacgtacgaacggtaccggaacgttggtacggacgtacgaccctaaccg

SEQ ID NO: 99636 - DNA, 579 bp, Homo sapiens
  misc_feature: GYAE6OF02GS27Q.40.81.H04.1.454.CMB.1.raw
  modified_base (243)..(243): a, c, t, g, unknown or other
  misc_feature (243)..(243): n is a, c, g, or t
  modified_base (358)..(358): a, c, t, g, unknown or other
  misc_feature (358)..(358): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagntttctggaaacaccctgagcaactactacatacactgatgcggcaggcccctggacgaggggtttgaggtggagtggggtggatccaacctaccgagagggtggacacgaaagtntcggaacagtaactttgagggcgacgggtcaccgagtcgaccgtgggacctcgtaccagtcagcacacgtcaccagtggatctagggacgcggtacgtcgaccgtacgtacggaccgtaaccgacggacagtagtacgttacgcggtagggaatagggtaccgttgggtcggacccggttaccgggccggggtactacgggtaccggtacggtaccggggg

SEQ ID NO: 99637 - DNA, 651 bp, Homo sapiens
  misc_feature: GYAE6OF02F1JBO.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccaggtggggatattgtgatgactcagtctccactctccctgccccgtcactcctggagacgcccggcctccatcctcctgcaggtctagtcagagccctacctaaacactaagtggattacctacttctttagaatttcggtacctgcaagaacgccgaagggcagtcctccacgagtccttacttagattacttaggtttcggggtttacttacggtccggggtcccgttcccggggtcccttaggacgtaggttccaggtcggctaggtggatcgagtacacgtagtacttttacaactagaaactcgaggcgtaggggagggtacggtacaaggtaaggtagttaggttagggttaacttttacgttaacgtcggtactacgtacgtaccctaaacccgttactaacctaaacgttgttacggtacgggtaccgggtaccggacgtaacgggtaacgtaacgggtaaggtaaacagaacgtacgtaaacgtggacggacgtacgaccacgtac

SEQ ID NO: 99638 - DNA, 713 bp, Homo sapiens
  misc_feature: GYAE6OF02F99GH.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagagcctggggctcggtgaaggtctcgtgcaagtatttcgtaggaaaccacccgtgacgactaactactaacatacacgtggatgcggcgacggcccgtgggaccgtaggggtttcgaggtggtacggtgggggtagaagtacccgtaaacccgtaccgaagggtacgggtacgggaccgaaacgtaaaacggttacgtaccggaacgtaaggttaaaccgttttacggaaggggtaccgtaaacggggttaccaaacccgaagttaccgggtaacccgtcgggggtaacccgtaccggtaccctacgtaccgaacgtaccgtaacctaagggttaccctaaacgacgttacgggaacttcgttaccggacggtacccgggtaacgttaccggtacccgttaccgttacggaacccgggaccgtacccgggtaccttaagggtacggttttaacgttacgttaacgggg

SEQ ID NO: 99639 - DNA, 597 bp, Homo sapiens
  misc_feature: GYAE6OF02GN8YV.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggggcctcgggtgaaggtctcctgcaagatttctggaacaccctgagcaactactacatacactggatgcggcacggccccgtggacgtaggggttgaggtgggagtgggggtggataccgaacccgtaccgaggagggtggacaacaaagtatacgacagtaactttacgagggcgagggtaccacgagtcgaccgtcgggaccgtccggtaccacgtcgacgcaaccgagttacctactagtaggactcgtagacggcggacgtcgacctacgtagaccgacgtaccggactagtcgttacttacgtaggtagggaacggtacggtaggttcggtgtacggtccgggacgggtccgtacggaccgtacggtaccgggg

SEQ ID NO: 99640 - DNA, 574 bp, Homo sapiens
  misc_feature: GYAE6OF02JH06F.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcgggtgaaggtctcctgcaagatttctggaaacaccctgagcaactacacatacactgatgcggcacggccctggacgaggggtttgaggtggagtggggtggatcgaacctacgaggagggtcggacaacgaaagtacgtacgacgaacgtaactttcgagggtcgtacggggtacaaccgtagtcgaccgtcgggacgtccggtaccagtcgagccaacgagttctacagtcgatcgtagacggcggtacgtcgacctgtcgacgacgacgacagtgtatacgtggtaggaagaggtacggttggtacggcgtaccgggccgggtatacggaccgtacggtaccgggg

SEQ ID NO: 99641 - DNA, 623 bp, Homo sapiens
  misc_feature: GYAE6OF02IXBO7.40.81.H04.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
  modified_base (284)..(284): a, c, t, g, unknown or other
  misc_feature (284)..(284): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcnggggctgaggtgaagaagctggggcctcggtgaaggtcncctgcagtattctaggaaacaccgtgagcaactactacatacactgatgcgnacggccctggacgtggggttacgagtcggagtcggggtagacttccgaaaccctaccgaggaggtggccaaagtaaacgtcgttccgaaaccgtaagtaaaccgtttacgacggggtacgaaggggttacccaacgacgttacgaacccggttgggaaccgcgtacccgagtaccgacggacctaacgacgtccgttaactagttacggtatacgtggtacggccggtaactcgacgttcgtacgacgtacgaacggctagacgttctagtacgtggaacgtacgtacggttcggtacggccgttacgggccggttacgcgacgacgttcgggaacccg

SEQ ID NO: 99642 - DNA, 503 bp, Homo sapiens
  misc_feature: GYAE6OF02HBLGG.40.81.H04.1.454.CMB.1.raw
  modified_base (412)..(412): a, c, t, g, unknown or other
  misc_feature (412)..(412): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtgatcaaccctacagaggtggcacaaagtatcgacagaactttcgaagggcagggtcacatgactgggacgcgtcatcagcacngtcacatggatcgtagagcggactgacctgcgacgacacgcatgtattacgtgtaggaagagtacgttgggtcgcgtacggcgggtatcgg

SEQ ID NO: 99643 - DNA, 700 bp, Homo sapiens
  misc_feature: GYAE6OF02GX1G6.40.81.H04.1.454.CMB.1.raw
  modified_base (293)..(293): a, c, t, g, unknown or other
  misc_feature (293)..(293): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgccctacctaaacactaatggatactactcttgaattggtactgacagacgccaggcagtctaccacngctctgatatagtttgggttcttacgtccggtccgtccggggtcctgactaggttcaggtggcgtaggtgatcgagtacacgtagtacttttacactaagtaaactcgaacggtacggtaaggggtagggaacgggaccgaaaggtaaacggttaggttttaggggtttaaggggtttaaactttttaacggtttaaccgttaggtaaccgttaacgttaccggtaaacccctttaaaccccgttaaccgttaaaccgttaaaaccggtttcgggtttacgggttaaccggggtaacccggggttaccgggaacccgggtaaacggggtaacccgtaaaggggtaacggtaaaacgtaacggaaacggtaccggtaacggttggacggtcctacgacctaccgtacg

SEQ ID NO: 99644 - DNA, 634 bp, Homo sapiens
  misc_feature: GYAE6OF02G5JFD.40.81.H04.1.454.CMB.1.raw
  modified_base (303)..(303): a, c, t, g, unknown or other
  misc_feature (303)..(303): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactccccaggtgcagctggtgcagtcgtggggctggaggtgaagagccgtggggcctcggtgaacggtcctccgtgcaagtatttcgtaggaaaccnccctgacgacaactactacatacacgtgatgcggcacggccctgggacgtggggttgaggtgggtaggtggggtaggtactaccgaacccgtaccgagggtaggtacgggacaactaaaggtactaaccgaagaacggttaaaccgtttacggaaggggtaccgacgggtaccgaaccgtagtacggaccgtacgggaccgtcctccgaacgtccgacgacaacgtacgttaccgtaacgtagtagacttacggtaggtacggtcgggtaacgtccggtaaccgtaccggacgtaaccgaccggtacgacctaggtacgttactacgtagg

SEQ ID NO: 99645 - DNA, 870 bp, Homo sapiens
  misc_feature: GYAE6OF02I3BVP.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagatttctaggaaaccaccctgagcaactactacatacactggatgcggcgacggccccgtgggacgtaggggtttgagggtgggaggtgggggtaggacgtaccgaaaccccgttaccgaggacgggtcggacaaccgtaaaggtacgtaccggaacgtaacggtaaaccgttttcggaacgggggtaccgtaacgggggttacccaacccgtaacgtaccgggtaaccccggtttacgggggaacccgggttaccccgggttaccccgtaaacggttcccgaaaacggggaccctaaaacccgtaaccgggttaacctttaaaacccggtaaacgggtttacgggtaaaccgtttaccggttaacgggaaacccggggtaccggggtaaacccggtttaccgggtaacccccggtttacccgggtaaccgggtaacccggtaaacccgggaaaccgggtacccgtaacggttaccgggtttttaaacgttaccgtttaacggggttaacgggaaacggggttacggggttaaacggggttcggggttaccgggtacccgggttacccggggtaccgggggtccgttaacccggggtaccccgaccggggttaccggggaaccccgggg

SEQ ID NO: 99646 - DNA, 548 bp, Homo sapiens
  misc_feature: GYAE6OF02GCYIK.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcgggtgaaggtctccgtgcaagatttcgtggaaaccaccctgagcaactactacatacactggatgcggcaggcccctggacgtaggggtttgaggtggagtggggtggagtcaaccctacgagaggtggcaacaaagtatacgacaagtaacttcgagggcgaggtcacgactgaccgtgggacgcgtaccatcagcacacgtctacagtgactcgtggacggcggactacgacctacgtcgacgacgacggactagtagtatacgttgaggtaacgagtacggttcggtcggtaccgtacgggtcgggcgtacgg

SEQ ID NO: 99647 - DNA, 725 bp, Homo sapiens
  misc_feature: GYAE6OF02J14EH.40.81.H04.1.454.CMB.1.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccaggtgcagcgtggtcgcagtcgtgggctggaggtgaagagccgtgggcctcgggtgaaggtctccgtgacagntttcgnggaaaccncctgagcaactactaacataccacgtgatcgcggcgacggaccccgtggacgtacgggggtttagagggttggaggttggggtggtactaccgaacccgttaccggaaggtgggtacgacgaacgtaaaacgtacgtaccggaactaacgttaaccttaccgtaggggaccgtaacggggtttccaaacccggtagtaccggtaacccggttcggggaaccgtcccggtaacgaacgttcccgaagtacccgtaagtacgttacccgtaagtacgttacggtacgtacgtcggaacgtccggtaacctacgggtaaccctcgttacgggaacctaccggaccgaccgttacgtaggttacgtaacgtttagggtaacgggacgtaacggtacgggtttacggcgggttaaccgttacccggggaaccgggtccgtaccggtaccgttccgggtaacccgggg

SEQ ID NO: 99648 - DNA, 559 bp, Homo sapiens
  misc_feature: GYAE6OF02GTOB1.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagtattctaggaaacaccctgacgcaactactacatacactgatgcgcacgcccgtggacgtaggggtttgaggtggagtggggtgataccgaaccctacgagagggtcggacaacgaaaagtacacgaacgagtaaactttgagggacagggtacaccgtatcgaccgtggggaccgcgtaccgactacgacgccaacacgtactaactagtacggactgtgacggacgggtactacggacctacggtacgaccgacgacggaccagtcgtatacgtagg

SEQ ID NO: 99649 - DNA, 604 bp, Homo sapiens
  misc_feature: GYAE6OF02GP2QL.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgcaggtctagtcagacgcctacctaaacactaatggatactactctttagaattggtacctgacagaagccgagggcagtcctccacacgcttcttagaattagttaggttggggtttacttacgtccggggtacccgttccgggggtccctaggtacgtagggtttcaggtcggcgtaggtgatcgagtcaacgtagtaactttacacttaagtaaatcaggtcgtgggtaggaggacgaaggaagtagttcggttagggttatttagttacgtgactacgtcgacctaacttactaactaaacgtgtaggtcgggtaccggtcggacgaacgggaacgtaagggtaggtaaacgtagaaggtacgaagttcggtaggtacgtgtaccg

SEQ ID NO: 99650 - DNA, 525 bp, Homo sapiens
  misc_feature: GYAE6OF02GGJ6P.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctccacagctcttgatatattgggttcttatcgggcctccgggtccctgacaggttcagtggcagtggatcagtcacagtattttacactagaaactcagcgagggtggaggcaagaagattggttagggtatttagtactgacatgactaacctctaacaaactggtgtaggtacggtcggaccgaagggaccgaaaggtagaaatcaagcgaactgtcggctgcactatctgtcttcacttcctaccccg

SEQ ID NO: 99651 - DNA, 516 bp, Homo sapiens
  misc_feature: GYAE6OF02IT32Q.40.81.H04.1.454.CMB.1.raw
  modified_base (471)..(471): a, c, t, g, unknown or other
  misc_feature (471)..(471): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctctgcaagatttctggaacaccctgagcaactactacatacactggatgcggcaggcccctggacaggggtttgaggtggagtggggtggagtcaacccgtaccgagaggtggacacaaagtatcgacagaactttcgaggcagggtcaccagtgaccgtgggacgcgtcatcagcacgagtcacagtgatctgaggcgactgacctcgtgaacgacgacgcatgtatactgtaggaagngaggtggtggcgtaccggcgggcgtcgaccgtaggtcgggaccgg

SEQ ID NO: 99652 - DNA, 642 bp, Homo sapiens
  misc_feature: GYAE6OF02IDRMB.40.81.H04.1.454.CMB.1.raw
  modified_base (567)..(567): a, c, t, g, unknown or other
  misc_feature (567)..(567): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccgaggtgcagctggtgcagtcgtggggctggaggtgaagaagccgtggggccgtcgggtagaaggtctccgtgacgaagtatttcgacggaaacaccctgacgacaactactacactacatggatcgcgacgacgccaggacgtagggttgacggtggagtggggtagacttaccaacccgtacgaggacggttcggactaaacgaaaggtacgtacgaacgtagtaactttcggaagggccgtaacgggtacaaccgtaagtcgtaacggtcggggaacgcgttactacgacgaacgtacaacgagttacgtaacgagtaggacttcgaggacgtacgggacttacgaccgttagaccgaacgaccggacggaacttgtaagtacgttacncgggtaagtaaggcgttaacggttgggacgtacggtaaccggcgggttacctaccggtacgtaccgggtaccggg

SEQ ID NO: 99653 - DNA, 830 bp, Homo sapiens
  misc_feature: GYAE6OF02JLYGX.40.81.H04.1.454.CMB.1.raw
tcagtctagcgactcacgaccggtgctcgatttagtagtgtagattcgcggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtggggcctcggtggaaggtctccgtgcaagtatttcgtaggaaaccacctgacgcaactactacatacactggatagcgcaggcccctaggacgtaggggttgaggtcggaggtggggtgggactaccgaaccctaccgaaggtacggtaggaccgtaaacgaaaaggttacgtaccggaacgtaaacgggtaaaccgttttaccgaagggggtaccgtaacggggtacctaaaccccgtaagttaccgggtaacccggtttacggggggaaccgtaccgggttaaccctaaccggttcccgaacgggtacccgtaaccggttaaccggttacccgttaacgtaaacgggttacggttaacggttccccgggttaaagggtaaccgggtaccccgggggtaaacgttttaccggaacccggttttacgggtaaacccgggtaacccgaaaccgggttaacccgggtacccgtttaaggggtcccggttttaaaacggtttaaccggtcgggttaaaacccgggaagggttaaccggttacggggttttacggttaaacccggggtcccggtttaacccggggtaccgggggttacgtaaaccccggggg

SEQ ID NO: 99654 - DNA, 523 bp, Homo sapiens
  misc_feature: GYAE6OF02GM6AR.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcacatgacctgggacgtcgccatcagcacagtctacatggatcgtgacgcgggactggacctaggtcgacgacgacggcagtgtacgtacgtggtaggaagtaggacggttggcggtcgtaccggcgggctcggaccgcgtacgggg

SEQ ID NO: 99655 - DNA, 823 bp, Homo sapiens
  misc_feature: GYAE6OF02JL0J0.40.81.H04.1.454.CMB.1.raw
tcagtctagcgactcacgaccggtgctcgatttagtagtgtagattcgcgggcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagcgtggtagcacggtccgtggggctggaggtagaaaggaacggccgtcgggggcctcgggtagaacggtctccgtggactaagtacttttcgtacggaaacctaccccgtggaacgacctaaaccgtacctaacgtactaacctacgtagggaattcggaccggtacgtaccggaccccgttaggggaaccggttaggggggtttacggaagggtttcgggtaacggggttggggggttaagggtaaccgttaacccgggtaaaacccccgttaacccggtagggtaaccgggggttacgggtaacgtaaaccgttaaaaacgggttaccgtttaaacccggaaaccggtaaacgggtttaaaccggttttacgggaacgggggttaaccggtaaaccggggttaaccgtaaacccggtaaggttacccggtaacccgggtttaccggggaccgttacccgggtacgtaaaccgttaccgtaacgtaccgtaacgttacgtaccgttaaccgtacgtaacggtactacggtacgggtacggtaccggggacgtcgggaactacgggtacgcgaacggtacggtctaagtcgttagtcgtaagg

SEQ ID NO: 99656 - DNA, 559 bp, Homo sapiens
  misc_feature: GYAE6OF02H8M3J.40.81.H04.1.454.CMB.1.raw
  modified_base (225)..(225): a, c, t, g, unknown or other
  misc_feature (225)..(225): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccaggtggggatattgtgatgactcagtctccactctccctgcccgtcactcctggagagccggcctccatctcctgcaggtctagtcagngcctctaaacactaatggatactactcttgaattggacctgcagaagccagggcagtctccacagctctgatatagtttgggttcttagtccgggtccgtccggggtccctgactaggtcagtggcaggtggatcagtcactaggttactttacactagaaatcagacgagggtggacggcgagaagtagttggttaggtatttagttactgactagtacgacctaaccttactacaaacgttggtacggtcgggtaccggtcgaccgaaggggtaccgtaagggtacgaaagtaccgaacgcggtaacgtgggtaccgtagtccgacacgtac

SEQ ID NO: 99657 - DNA, 615 bp, Homo sapiens
  misc_feature: GYAE6OF02ISG4I.40.81.H04.1.454.CMB.1.raw
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
  modified_base (326)..(326): a, c, t, g, unknown or other
  misc_feature (326)..(326): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatccttcttcttggtggcagcagccgcaggacgcccacctcccgaggtgcagctggtgcagtcgtggggctgnggtagaagagccgtgggcctcggngagtctctgcaagtattactaggaaaccacccgtgacgcaactactacatacactggatcggcgcgacggtccccgtagggacgtaggggttgnggtgggaggttggggtggacgtaccaaaccgtaccgtaggacggcggacaacgaaagtacgtacgacgtaacgtaactttacggaggtacgacggtacacgtagacgtaccggtgggacgtcgtaccacgtcgagcctaacgtgtacctacgtagtcgtacttagagtcggcgactcgccgtacgtcgaccgaacggaccgacgtagttacgttattacgtggtaaggtaaggcgttacggtcggtaggtcccggtacggccgggagtaccgaccggtaggtacccggg

SEQ ID NO: 99658 - DNA, 578 bp, Homo sapiens
  misc_feature: GYAE6OF02HSWDL.40.81.H04.1.454.CMB.1.raw
  modified_base (443)..(443): a, c, t, g, unknown or other
  misc_feature (443)..(443): n is a, c, g, or t
  modified_base (493)..(493): a, c, t, g, unknown or other
  misc_feature (493)..(493): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagcctggggcctcggtgaaggtctcctgcaagtatttctggaaacaccctgagcaaactactacatacactggatgcggcaggcccctgggacgtaggggtttgagtgggagtgggggtggataccgaaccctaccgagaggtcggacaacgaaagtatcgaacaagtaactttacgagggacgagggtcaccgatcgaccgtgggacgcgtccatcagcactagtacttaangtggtactcgtagacggcggtatcggacctacgcgaccgacgtaccgganattgtattacgtggtagaaggtacggtacggttggtcgggccgtaccgggtcgggacttcggaaccctagggcgggtaacccggg

SEQ ID NO: 99659 - DNA, 613 bp, Homo sapiens
  misc_feature: GYAE6OF02F3OND.40.81.H04.1.454.CMB.1.raw
tcagtctagcgactcacgaccggtgctcgatttagtagtgtagattcgcgggcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactccccaggtgcagcgtggtgcagtcgtggggctggaggtgaagaagccgtggggcctcgggtaggaaggtctccgtgacaagtatttcgaggaaaccaccgtgacgcaactactacatacatggatgcgcgacgcccgtggacgtaggggttgaggtggtaggtggggtaggacgtacgaaccctacgaggaggtcggacaacgaagtacgtacgaactaacgtaacttcgagggacgacgggtctaaccgagtacggaccgtcggggaccgtaccggtaccgtagtacctaacggccaacgtacgtactacgtagtacgactcgtaggacggtacggtcgtaccgtaccgtaccgtacggaccgtaccggaccggaccgtagtacggttactacgttacggg

SEQ ID NO: 99660 - DNA, 823 bp, Homo sapiens
  misc_feature: GYAE6OF02GX1YE.40.81.H04.1.454.CMB.1.raw
  modified_base (216)..(216): a, c, t, g, unknown or other
  misc_feature (216)..(216): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagacgccggcctccatcctcctgcaggtctagtcagacncctactaaacactaatgatactatcttagattgtacctgacagaacgccgaggtacacgtctaccacagtcttacttgaattagttagtttcggggtttcttacggtccgggtcccggttcccggggttccctaggtaaccgtacgggtttaccgacggttcgggaccgtaagggtacgggtacttacgtacggttaccaaacgtacggtttaactttttaacgaaacgttaacgtaaaaacgtcgtaaacggtcgggtaacgggggtacgggtaaagggacgtaaagggtaaagggttagtttaggggtttacgggtttaaatttttaacgttacgttacggaaccgtttaagttacccggtaaaccttaaacccgttaactaaaccggtaaaacgttttcgggtaacggggttacggggttaacccggggttaaccgggaaacccgggtaaacgggggtaaacccggtaaacggggttaaacggtaaacgtaacccggtaaggtaaccgggtaacggttacgggttacggcccttaacggtaacccgtaacgttcgtttaccggttaccgttaccgtttaccctaccggtttaccccgtaccccg

SEQ ID NO: 99661 - DNA, 649 bp, Homo sapiens
  misc_feature: GYAE6OF02GRTST.40.81.H04.1.454.CMB.1.raw
  modified_base (336)..(336): a, c, t, g, unknown or other
  misc_feature (336)..(336): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactccccaggtgcagctggtcgcagtcgtggggctggaggtgaagagccgtggggcctcggtgaaggtctcctgctaagtatttcgaggaaccacccgtgacgacaactacacatacacgtgatgcggcncggccctggacgtaggggttgaggtggaggtggggtacgactaccgaaccctacgaggaggtcgacgaacgtaaagtacgacgtaacgacgttaacgtttacgacgggtaccggtaacgggtacccaaccgtagttccggaaccggtacggggacccgtaccggttacccagtaccacggtacccgaccgtaacgttacctaacaggttacgacgttacgtacggaaccggtaccggtaacctacggtacccgttaaggtacggaaccgtaccggaccggtaccttaaggttacgttaagttacggtaacggg

SEQ ID NO: 99662 - DNA, 545 bp, Homo sapiens
  misc_feature: GYAE6OF02HK4RO.40.81.H04.1.454.CMB.1.raw
  modified_base (282)..(282): a, c, t, g, unknown or other
  misc_feature (282)..(282): n is a, c, g, or t
tcagtctagcgactcacgaccggtgctcgatttagtagtgtagattcgcgggcgtagactttgtgtttctcgtagtctccctgctcagctccgtggggctgctaatgctctgggtctctggatccagtggggatattgtgatgactcagtctccactctccctgccccgtcactcctggagagccggcctccatctcctgcaggtctagtcagagccctcctaaacactaatggatactactctttgaattggtacctgcagaagccagggcagtctccacngctcttgatatagttggggttcttagtcgggcctccggggtccctgacaggttcagtgcagtggatcagtcacgagtattttacactagaaatcagcgagggtggaggcagaagagtgttagggtatttatactgcagtgactaacctctaactaacgtgtggtcggaccggttcggaccgaaggggaccgtaaggtagaacgtcgacgtcgaacgtggtacgctggccaccgtagtcttcggtccttacacttccgtacccg

SEQ ID NO: 99663 - DNA, 626 bp, Homo sapiens
  misc_feature: GYAE6OF02H460F.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagcccggcctccatctcctgcaggtctagtcagacgccctacctaaacactaatggatactactctttgaattggtacctgcagagccagggcagtctccacagctcttgattattagttggggttcttagtcggggtcccgttccggggtcccctagacgtaggttcgaggtggcgaggtggatcagtcacagtattttacactagaaatcgaagcgagggtaggaggacgaagaagtagttggttagggtattttagttactgactatgaccgtaaccttactaaacctaaacgttggttacggacgggtaccggggtaccggaacccggtaacggggaacccgtaagggtaaaggaacgtaccgaagaccggtaacggtgggtcggacgtacgacccgaccgtacttccgtacgtttaccttacgtaccttcccgttacccccg

SEQ ID NO: 99664 - DNA, 880 bp, Homo sapiens
  misc_feature: GYAE6OF02GN1CM.40.81.H04.1.454.CMB.1.raw
  modified_base (171)..(171): a, c, t, g, unknown or other
  misc_feature (171)..(171): n is a, c, g, or t
  modified_base (847)..(847): a, c, t, g, unknown or other
  misc_feature (847)..(847): n is a, c, g, or t
tcagtctagcgactcacgaccggtgctcgatttagtagtgtagattcgcgggggtggcccgtgagagcatcacccagcaaccacatctgtcctctagagaatcccctgagagctccgttcctcaccactggactggacctggaggatcctcttcttggtgacagcagccgnaggacgccctactcccgagggtgcagcgtgggtcgcaagtcctgggggcctgaggtgaaagaggccgtgggggcctcgggagaacgggtctccgtggaccgaacgtagtttcgtcggaaaaccgtaccgtacgacggactaaaacgtaccgtaacaacgtacgtaactcggtaactcggacggacccaacgggtacccccgtagggacccggtaaggggggttttacgaacgggttaggggtacggttagggggaccgggttaagttaccccgaaaacccgttcccgggaaagggtaacggggttaccgggtaacggaaaccggttaaaaacggtacggtaccgggtaaaccgtaaaccgggtaaacttttaaccgggaacggggtaccgtaacggggttaccaaacccgtaaggttaccgggtaccggttaggggaacccggtaccggtaccgttacgaaccgtaaggaccgaaacccgtaaccgggttacctaaaccgggtattaacccggggtatttaacccgggcggtaaaccgggtccggggttaaacccgtacgggggttaaacccttcgggaaaccgggtaacccgttaacccgggaccggttacaaccggtcggttaaactttcggacccggttaaggaccgtaaaccggttggttaccgggggttanaacccggtttccggggaggtaccgttaacccgg

SEQ ID NO: 99665 - DNA, 816 bp, Homo sapiens
  misc_feature: GYAE6OF02H0PJ6.40.81.H04.1.454.CMB.1.raw
tcagtctagcgactcacgaccggtgctcgatttagtagtgtagattcgcgggggactgatcaggactcctcagttcaccttctcacaatgaggctccctgctcagctcctggggctgctaatgctctgggtctctggatccaggtggggatattgtgatgactcattctccactctcccctgcccgtctactccgtggacgacggccggcctccatcctcctgactaggtcctagtcaaggacgtccctaacctaaaacaactaaagtacggaattaacctacttctttagtaaagttcggtacctgacaaaggaacgccgaggggactacggttaccctccaacgacgtccttacgttaggtaattaacgtttaggtttcgggggtttacccttttaacggtacccgggggtcccgtttccccgggggttacccctaggtaaccggtacggggtttacgaacgggttacgggaccgtaagggtaggaaccttacgacggttaaccgtaacgtaagttaactttttaaccaaacgttaaacgtaaaaacgttaccgaaacggtacgggtaaagggggttacgggaaacgggtaacgtaaacgggtaaaggtaacgtttagggtttaagggttaacgttttaacgttaacgtacgtaaccgtagtaccgtaacccgtaaaccttaacgttaaaccgtaaacggttacggtacgggtacgggttaccgggtaccggaaccggtaaacgggtaaccgttaaggggtaacgtaaacgtaacgaacggtacggtaacgtacggtacgtacgtacgtaaccg

SEQ ID NO: 99666 - DNA, 722 bp, Homo sapiens
  misc_feature: GYAE6OF02H5OTB.40.81.H04.1.454.CMB.1.raw
  modified_base (235)..(235): a, c, t, g, unknown or other
  misc_feature (235)..(235): n is a, c, g, or t
  modified_base (318)..(318): a, c, t, g, unknown or other
  misc_feature (318)..(318): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccaggtggggatattgtgatgactcagtctccactcctccctcgcccgtcaccttcctggagacgcccggcctccatctcctgcaggtctagtcagacncctacctaaaacactaataggataactacttctttagaattcggtaacctgacagaacgacgaggacagtcctacatacgctntagatatagttgggttacttaggccggtccgtaaccgggtcctaggacgtggttacgaggtcggtacgtggtacgtactcgtacgtacaacgtagtttaactttaccgaagttaaagaaactcgaacggtacggtaagggggtacggaaaggtacgaaaaggtaacggttaagtttggggtttaaggttaagtttttaaacgtacggttaggtaaccttaagtaacgtacccgtaaaccgtttaactaaaaccgtaacggttaggttaacgggtaccggggtaaccgggtacccggaaccggggtaaaccgggtaaaccggtaaaggggtaaccggtaaaaccgttacgaaacgggaccggttaaacgtccgggtagggtacccttacggaacccttaaaccgg

SEQ ID NO: 99667 - DNA, 683 bp, Homo sapiens
  misc_feature: GYAE6OF02GZKXJ.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatcctcctgcaggtctagtcagacgcctacctaaacactaagtggatactactctttagaattggtacctgcagaacgccaggcagtctccacagctcgtgattattagttggggttcttacgtccgggtcccgtccggggtccctggacgtaggttcgaggtggacgaggtggtatacgagtacaactagttaacttttaccacgtaagaaaactcgaagtacggaggggtaggaaggacgaaggtaacgtaggttaggttagggtaattttaacgttacgttcgtactacgttactaccgtaaaccttacctaacctaaacgtggttacggtacggggtaccgggtaccggaacggtaaacgggggtaaccggtaaagggtaacggaaacgtaccgggtaacggtaccgaacggttcggtacggtaccgtaggacccgtaacgtacgttaccgttcgttacccttaccgtaccgttccccgttaaccccgg

SEQ ID NO: 99668 - DNA, 773 bp, Homo sapiens
  misc_feature: GYAE6OF02HXHV0.40.81.H04.1.454.CMB.1.raw
  modified_base (231)..(231): a, c, t, g, unknown or other
  misc_feature (231)..(231): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagttctccactctcctgcccgtcactcctggagacgccggtcctcatctcctgcacggtctagtcagacnccctacctaaacactaatggaacttactacttcttagtaacttcgtacctgactaagaacgaccgagggactacgtcctaccacgtacgtcctttcgtacgtaagttaggttacgttttacgggggtttactttacggtcccgggggttaccccgtttccccggggggttcccctaggtaaccgggttacgggtttaccggtaacggttcgggggacgtaacgggttagggtaaccttacgtaaccggtaccgtaacgttaacgtttaaacgtttttaaacgtaaaccgttaaaggtaaaaacgttacgaacggtacgggtaagggggtagggaacggtaacgaaggtaacggtaggtttacgggttaggttaagtttacgtttagtagtactacgtacgaaccgtaacctaaccgtaaaccgttaacgtacgggttacgggtacgggtacggtaccgggtaaccggtaaacgggaaccggtaaagggtacgtaaacgtaacggaagtaccgttaacgtagggtacgtccgtaccgtaaccg

SEQ ID NO: 99669 - DNA, 532 bp, Homo sapiens
  misc_feature: GYAE6OF02F5GJQ.40.81.H04.1.454.CMB.1.raw
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgaattggtacctgcagaagccagggcagtctaccacagtctcgttgatattagttggggttcttagtccgggccgttcccggggtccctgactaggttcaggtggcagtcggatcgagtcagagtatttacatagaaatcagcgagggtgagcagagtagtggttaggtatttatactgtnatgacctaactctaanaactggtcgtgacggtcgacgaagggaactaaggagaactcgaagacgaacgtggngacgtgaccaactntcgtctctcgtctcctacccg

SEQ ID NO: 99670 - DNA, 694 bp, Homo sapiens
  misc_feature: GYAE6OF02GNA5S.40.81.H04.1.454.CMB.1.raw
  modified_base (303)..(303): a, c, t, g, unknown or other
  misc_feature (303)..(303): n is a, c, g, or t
tcagtctagcgactcacgaccggtgctcgatttagtagtgtagattcgcggggatcaggactcctcagttcaccttctcacaatgaggctccctgctcagctcctggggctgttaatgctctgggtctctggatccagtggggatattgtgatgactcagtctccactctccctcgcccgtcactcctggagacgccggcctccatctcctgcgtaggtctagtcagacgtccctacctaaacactaatggactactacttctttagaattcggtacctgcagacgccgaggcagtcctccancgctcttgattatgttcgggttcttacgtccgggtcccgttccggggtccctaggtaccgtaggtttcgaggtcgggtacgtaggtcggactacgtacgtacaacgtaagtttaacttttaacaacgttaaagtaaaactcgaacggtacgggtaaggggtacgggaacggtacgaaggaaaggttaggttagggtttagggttaattttaacgtacgtgtacgtacgttacgaacccttaacctaccgttaaacgtaacgtttggtacgggttaccgggaccggttaccgggaaccggtaacgggaaccgtaaggggttaacgtaaacgtacggaaacgtaccggtaagttacgggtacggtaccgttacggacccgtactacgttaccg

SEQ ID NO: 99671 - DNA, 752 bp, Homo sapiens
  misc_feature: GYAE6OF02JWZJA.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtggggcctcgggtgaaggtctccgtgcaagtattctggaaaccaccctgagcaactactacatacactggatcggcggcgacggccccgtaggaccgtaggggtttgaggttcgggaagtggggtggtaactccgaaacccgttaccgaggtaggtcgggacctaaacgtaaaggtaacgtacggaaccgtaacggtaaccgttttaaccgggaagggaccggtaacggggtacgtaacccgtagttaccggaacccggtacggggtaacccggtccggttacccgaagtaccgtaacgacctaacggtaacgttaccgtaaccgtagttaacgggtacttacggtacgggtacggtacggtaacccgttcggtaacccgttacggtaccggtaaacccgacgtacccggtacgtacgttacgtaacgtttacgtagggtaacggggtaaaccttacggggtaacgtttcggggtacggtacccggtaacccggggttccgggtaccggtaccggtacccggtaccggtaccggggg

SEQ ID NO: 99672 - DNA, 637 bp, Homo sapiens
  misc_feature: GYAE6OF02G8MHJ.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtgaaggtcctccgtgacaagtatttcgaggaaaccacccgtgacgacaactactacatacactggatggcggcgacggcccgtggacggtaggggtttgaggtggtaggtggggtgacgtaccgaacccgtacgaggaggtggacaacgaaagtcacgacaagtacgttcgagggcgacggtcaccgagtcggaccgtgggaccgtccgtacacgtcgacgtaccacgtacgtactacgtagtcgtactcgtaggacgacggtacgtacgtacgtcgacggtacgaaccgccggtacctaagttcgttaacgttacgtaggtagggtaacgtacgggttacggttcggacggtaccggtacccggggcgggttccgtccggaacccggtacgggtccggggtaacccggg

SEQ ID NO: 99673 - DNA, 557 bp, Homo sapiens
  misc_feature: GYAE6OF02G0NM5.40.81.H04.1.454.CMB.1.raw
  modified_base (344)..(344): a, c, t, g, unknown or other
  misc_feature (344)..(344): n is a, c, g, or t
tcagtctagcgactcacgaccggtgctcgatttagtagtgtagattcgcgggggagcatcacccagcaaccacatctgtcctctagagaatccctgagagctccgttcctcaccatggactggacctggaaggatcctcttcttggtggcagcagccgcaggagcccactcccaggtgcagctggtgcagtctggggctgaggtgaagaagcctggggccctcggtgaaggtctcctgccaagatttctaggaacaccctgagcaactactacatacactggatgcggcaggcccctggacaggggtttgagtggagtggggtgatcaacctacacgagtgcanaagtatcgacagaactttcgacggcaggtccaacagtcgaccgtgggacgccgtcatcagacacacgtctacagtggatcgtgagcggactcggacctcgacgtacgacgtaacggccaagtcgtaattacgtaggtacggaagtacggtacggttggtacggtccgttaccggccgggtacgtaccggtaccgtacggtaggggtaccccgg

SEQ ID NO: 99674 - DNA, 653 bp, Homo sapiens
  misc_feature: GYAE6OF02FOWFB.40.81.H04.1.454.CMB.1.raw
  modified_base (304)..(304): a, c, t, g, unknown or other
  misc_feature (304)..(304): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgcccggcctccatcctcctgcgaggtctagtcagacgccctacctaaacactaatggaatactacttctttgaatttcggtacctgacaaggaacgccgagggcacgtccnccacagtctcgttgattatagttttcgggttcttagtccgggccgttccggggtccctgacgtacggttcgaggtcggcaggtggtatcgacgtcgaacgtagttaacttttacgaactaagaaaactcgaagcggaggggtaggacgagaagaagttagtggttaggttatttagttactgtacagttacggacctaaccttaccgtaaactaaacgttggttacgggtcgggtaacccgggtaccggtaaccgggaacggggtaacccggtaaggggttaaccggtaaaagtaccgaaacggtaacggtaacgttgggtacggtaccctacggacctaccgtaccgg

SEQ ID NO: 99675 - DNA, 715 bp, Homo sapiens
  misc_feature: GYAE6OF02HSJ80.40.81.H04.1.454.CMB.1.raw
  modified_base (256)..(256): a, c, t, g, unknown or other
  misc_feature (256)..(256): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctctgcaagtattctaggaaaccncctgagcaactactacatacactggatggccggcgacggtccccgtaggacgtaggggtttgaggtggtaggtggggtgtactaccaacccgtacgaggacggtacggacaacgaagtacgtacgaacgacgttaacgtttacggagggtcgacgggtcacgtagtacgtacccggtacggggaccgtcgtaccgattaccgacgccaacgtacgttactaacgtagtcggtacttacgtaggaaccggtccgggtaacgtccggtaaccctacggttacgggaaccgtaaccgtacccgggtactaacggtttacgttaccgttacgttgggtaacgggtaaacgggttaccggttaacgggtttcggggtaccgggtaccccggttacccgggggtaccggggtaccgtttaacccggggacccggtttaaccgggggccggggttaaaccccgggg

SEQ ID NO: 99676 - DNA, 586 bp, Homo sapiens
  misc_feature: GYAE6OF02F9FCT.40.81.H04.1.454.CMB.1.raw
  modified_base (246)..(246): a, c, t, g, unknown or other
  misc_feature (246)..(246): n is a, c, g, or t
  modified_base (357)..(357): a, c, t, g, unknown or other
  misc_feature (357)..(357): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagagccgtggggcctcggtgaaggtctcctgcaagtntttctggaaaccaccctgagcaactactacatacactggatgcggcaggcccctggacgagggggtttgaggtggagtggggtggatccaaccctaccagagggtggcaanaaagtatacgacagaactttcgagggcgagggtcacctatacggaccgtgggacgcgtaccagtcagtcacacgtctacacgtaggatcgtggagtccggacgtacgtacctcgtacggacgaccgaccggcctagtcgtacttacgtagggtacggaaggtaggtaacgggttcggtcgggaccttacccggggacgggtccgtacggtacccgacggtacccggggg

SEQ ID NO: 99677 - DNA, 650 bp, Homo sapiens
  misc_feature: GYAE6OF02G6XWN.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtggggcctcggtagaaggtctcctgacaagtatttctaggaaacaccctgacgacaactactacatacactaggatgcggcgacggccccgtggacgtaggggttgaggtggagtggggtgactaccgaacccgtacgaggaggtggacaacgaaagtagacgacgaagtaactttcggaacgggtacgacgggtacaacgtagtacggaccgtaggggaccgccgtaccgagtacgacgactaacgtagttacctacgtagtacggactcgtaggacggaccggtacgtacgaccgtcgtacgaccgtaccgaccggtacctagttacgtacgttagtaggtacggaaggtacggtacgggttacgggtacggtaccggtacccggggtacgggtaccgtacggtacccggtaccgggtaccggggaacccggg

SEQ ID NO: 99678 - DNA, 689 bp, Homo sapiens
  misc_feature: GYAE6OF02IIU6L.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctggtgaaggtctccgtgcaagtatttcgtacggaaaaccacccgtagacgacaaactacctaacaactaaccacgtaggatggccggcgacggtcccccgtggaccgtaggggtttgaggtgggaggtgggggtagacgtacaaaccccgtacgaggagggtcgggactaacgaaagtacgacgacgagtaacgtttacgagggcgaacgggtccaccgtagtacggaccgtacggggaccgtccgtaccaacgtacgacggaccaacgtacggttacctaacgtagttcggaacttcgtacgggtacggtaccggtacgtaccgtaaccgtccggacggtaaccgaccgaaccggtcctaagttcgtattacggtggtaacggaacggaacggttccgggttaggtaccggtaccggttaccggggcggggtacccgtacggtacccggtacggtacccggggg

SEQ ID NO: 99679 - DNA, 582 bp, Homo sapiens
  misc_feature: GYAE6OF02HVJ2W.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaaagaagccgtggggcctcggtgaaggtcctcctgcaagatttctggaaacacccgtgagacaaactactaacatacactggatgcggcacggcccctggacgtagggtttgagtggagtggggtgatccgaaccctacgagaggtgacaacaaagtagtacgaacagtaactttcgagggcgaagggtccaaccgagtacggaccgttggggaccgtcgtaccagtaccagccacgagtcctaacagtcggtaatcgtgacggacggactcgacctcgagaccgacgacggactatgtacttacgtaggtaggaagtagtacggttggtcggtacgtaccgggcgggtactacggacccgacggtcgggacccgg

SEQ ID NO: 99680 - DNA, 607 bp, Homo sapiens
  misc_feature: GYAE6OF02FY1MV.40.81.H04.1.454.CMB.1.raw
  modified_base (369)..(369): a, c, t, g, unknown or other
  misc_feature (369)..(369): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagtatttcgtaggaaacaccctgagcaactactacatacactggatgcggcacggcccctggacgtaggggtttcgaggtggagtggggtggacttccaacccgtaccaggaggtgacacgaaagtacncgaacagtaacgtttcgaagggcgaggtaccaacgtagtacgaccgtgggaccgcgtaccagtcagaccacgtacgtcctaacgagttcggactcgtcgacggcggaccgtacggacctacgtacggaccgacgaccggactagtcgtacttacgtaggtacggtaagtacggtcgggttggtacggtaccggtaccgggcgggtaccgtaggacccggtacggtcgggtaacccggg

SEQ ID NO: 99681 - DNA, 579 bp, Homo sapiens
  misc_feature: GYAE6OF02HDSR3.40.81.H04.1.454.CMB.1.raw
  modified_base (408)..(408): a, c, t, g, unknown or other
  misc_feature (408)..(408): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagcccggcctccatctcctgcaggtctagtcagagcctacctaaacactaatggatactactctttgaattggtactgcagaacgccagggcagtcctccacacgctcttgatattagttggggttcttagtcgggcccgttcccggggtcctgactaggttcaggtggcagtggatcgagtcacgagtacttttacgactagaaaatcgagngtagggtggaggcgaaggaagtattaggttagggtatttagttactgacatgactaacctctaactaaacttggtgtacgggtaccggtcggtaaccggaaggggtaaccgtaaagggtaggaaacgttacggaaacggtacggaacgttggtacgggtacgtgtaacccg

SEQ ID NO: 99682 - DNA, 707 bp, Homo sapiens
  misc_feature: GYAE6OF02H4M8X.40.81.H04.1.454.CMB.1.raw
tcagtctagcgactcacgaccggtgctcgatttagtagtgtagattcgcgggggtgccctgagagcatcacccagcaacacatctgtcctctagagaatcccctgagagctccgttcctcaccatggactggacctggaggatcctcttcttggtggcagcagccgcaggagcccactcccaggtgcagctggtgcagtcgtggggctggaggtagaagaagccgtggggcctcgggtgaaggtctcgtgcaagatttcgaggaacacctagagcaaactactacaatacactaggatgcggcacggccctggacgtaggggttgaggtggagtggggtagtagtaccgaacccgtacgaggaggtacggacgaacgaaagtacgtaacgaacgtaacggtaaccgtttacggaacggggtacgtaacgggtccgaaacccggtagtacggtaacccgggttagggaacccggtccggtaccctaagtacccgaagccgaacgtacgttaccgtaacgtacgtacgggtactacgtacggtacggaccggtaacgtacgtacccgttaacggtacggtaacccggtaacgaacccgggtaccgtacgtttacggttaacgttaccgttaagggtaacggtaaacggtaggttaccggttacgggtaccggtaccggttaccggggtcccggggtattaaccccgggg

SEQ ID NO: 99683 - DNA, 798 bp, Homo sapiens
  misc_feature: GYAE6OF02JQJQR.40.81.H04.1.454.CMB.1.raw
  modified_base (402)..(402): a, c, t, g, unknown or other
  misc_feature (402)..(402): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcaggccgcaggacgccccactccccgaagggtgaccgagtccgtgggtgacctaggtccggtggggctggaggttgaagagcccgtgggggacctcggtgacggttcctccgtggactaaaggtctttcgtacgggaaaccctacccctaggtacgacctaaccttaacctagaaccttaccgacgtagggtactcggaccggaccgtaacgggtcccccctaggggtaacgttaccgggggggtttntaagggtaccgggtagggtttaggggggaggttaaccgttacccgtaaaccccggtaaccgttaagggaaggggtcggtaacccgaagttaaacggttacgtaaccggacgtaaacggttaaaccgttttcgggaacgggaccgtaccggggttacctaaccgacgttacggtaaccggtacggggcccggtaccgtaccgtaccgtaccgaacgaccctaaccgacgttacgttaacgtacgtacggtagttacgcggttaacggacggtaccgtaccgtaccgttaccggcgtaccggaccgacggtacgacggtatacggttatacggtaacgtaaggaacggtcggtcggttagccggttaacggcggtacgtcggaccgttaaggcccggg

SEQ ID NO: 99684 - DNA, 654 bp, Homo sapiens
  misc_feature: GYAE6OF02HM074.40.81.H04.1.454.CMB.1.raw
  modified_base (613)..(613): a, c, t, g, unknown or other
  misc_feature (613)..(613): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagccctacctaaacactaatggatactacttctttgaattggtacctgcagaagccgaggcagtcctccacagtcttcttgattattagttggggttcttagtccgggtcccgttcccggggtccctggacgtaggttcaggtcggcgaggtggatcgagtcacgtagttactttaacacgtaagaaactcgagcgtaggggtaggaggacgaagaagtagttggttagggtaattttagtacgtgactagtcgtacctaacctactaaaccgtaacttggtacgggtacgggtaaccgggtaccgggaaccgtaaaccggggtaaccggtaaagggtaacgggtaaacgttacggaacggtaccggtaacggtttcggacggtacgtacgaccgtaccgtnttaccgtcgttaccgttaccttaccgttccccgttaccccg

SEQ ID NO: 99685 - DNA, 741 bp, Homo sapiens
  misc_feature: GYAE6OF02FX46X.40.81.H04.1.454.CMB.1.raw
tcagtctagcgactcacgaccggtgctcgatttagtagtgtagattcgcggggatcaggactcctcagttcaccttctcacaatgaggctccctgctcagctcctgggctgctaatgctctgggtctctggatccagtggggatattgtgatgactcagtctccactctccctgcccgtcactcctggagagccggcctccatctcctgcaggtctagtcagacgcctacctaaacactaatggatactactctttgaattggtacctgcagacgccaggcagtctccacagcctcgttgatacttagtttcggggttcttaagtccgggtccgttcccgggggttccctggaacctacgggttcgtaaggttcgggaccgtaggttacgggaacttcgtaacggttaccgaaccgtaagttaacgtttttaaccaaccgttaaggtaaaaacttccggaaggtacgtaacgggggttagggacggaccgaaggtaaacggtaaggttggtttacgggtaattttaacgttaccgttagacgtacgtacgtaccgtaacccgttactaaaccttaaaacggttcgttacgggtacgggtaaccggggttaccgggtaacccggtaacggggtaaacccggtaaaggggttaaccggtaaaaacgttaccggtaaaacggtacccggttaaacggttcgggttaaaccgggtccgtacggttacccgaacccgtttaaccgg

SEQ ID NO: 99686 - DNA, 652 bp, Homo sapiens
  misc_feature: GYAE6OF02HVMB9.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagacgccggcctcatctcctgcaggtctagtcagacgcctactaaacactaatggtactactactctttagaattggtacctgacaagacgcgaggcagtctccacagtctcttacgattaagttagtttcggggttcttacgtccgggtacccgtccgggtccctagacgtacggttcgaggtcgacgtagtacggtatacgacgtacaactagtaacttttacaacttaagaaaactcgaaggcggtaaggggtaggaggaacgaagaagtagttaggttaggtactttagttaacgtacgtactatcgaacctaaacctctaaacgtaattacggtacggtacgggtacggtaaccgggaccgtaacgggaaccgtaaagggaacgtaaagaacgaacgtacgaacggtaggtaccggtcgtaacgtccgaaccgtacttacgtacgttactacgtactacccgttaccccg

SEQ ID NO: 99687 - DNA, 748 bp, Homo sapiens
  misc_feature: GYAE6OF02GK34T.40.81.H04.1.454.CMB.1.raw
tcagtctagcgactcacgaccggtgctcgatttagtagtgtagattcgcggggtgatcaggactcctcagttcaccttctcacaatgaggctccctgctcagctccgtggggctgctaatgctctgggtctctggatccaggtggggatattgtgatgactcagtctccactcctccctgcccgtcacctccgtgggagacggcccggcctaccatcctcctgcaggtctagtcaggacgccctacctaaaacactaagtggacttacttacttctttagaatttcggtacctgacaagaacgccgagggctacgtcctaccacacgtccttcgttagaattagttaggtttcggggtttactttacggtccggggtccccggttcccggggttccctggtaccgttacgggtttccgaggttacgggacgtaagggttcgggaacttaccgtaacggtacccaacgtaaggtttaacctttttaaaccgaacgttaaacgtaaaacgtacggacggtacgggtaacggggtaggggaacggacgaaagggtaaaggttacggttagggtttagggttaaactttttacgtaacgttcgacgtacgtcgtaaccgtaaccgttaactaaaccgtaaacgttggtacggttacgggtaccgggtaccgggaaccggtaacgggtaacggtaagggtaggtaaacgtacgaacggtacgtaacggtcggtacggtcgtacgacctaaccg

SEQ ID NO: 99688 - DNA, 589 bp, Homo sapiens
  misc_feature: GYAE6OF02G8L0S.40.81.H04.1.454.CMB.1.raw
  modified_base (245)..(245): a, c, t, g, unknown or other
  misc_feature (245)..(245): n is a, c, g, or t
  modified_base (363)..(363): a, c, t, g, unknown or other
  misc_feature (363)..(363): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccacctcccaggtgcagcgtggtgcagtctggggctggaggtgaagagccgtgggcctggagaagtctcctgacaagtntttctaggaaaccaccgtgacgacaactactacatacactgatggccgcacggccctggagtgggttgagtggagtggggtgactaccgaacctacgaggtaggtgacaacgaaagtnacgacagtacttgacggcagggtccacgagtacgtacgtacgggaccgtccgtcactacgacgaccacgactacgtacgtagtgactcgagacggacgtacacgtcctagcgtaacgacgtccgacgtatacgttagttacgtaggtacggtaaggtacggtaggttcggtacggtccggtaccgggccgggtcgtaaccggccggtacggtaccggggtaacccg

SEQ ID NO: 99689 - DNA, 659 bp, Homo sapiens
  misc_feature: GYAE6OF02I455X.40.81.H04.1.454.CMB.1.raw
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (417)..(417): a, c, t, g, unknown or other
  misc_feature (417)..(417): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactccccaggtcgcagctggtgcagtcgtgggctggaggtgaagaacgccgtggggcctcggtgaacggtctcctgacaagtntttcgaggaaaccnccgtgacgacaactactacataacacgtggatggaccggcgtaccggcccgtagggacgtaggggttgaggtggaggtggggtacgacgtaccgaacccgtacgaggtacgggnggacaacgtaaagtacgtacgaacgaagtaactttacggagggtacgtacgggtacaaccgtagtacggtacccgtacgggacccgtaccggtacccgtataccggagtaccgtaaccgtacgtaccgttaacgtacggtacgtaacgtccggtacggaacggtccgggtaccgttacgacccggtaacgtacggaaccgaccggtaccggaccttaggtaaccggttagttaccgtacggg

SEQ ID NO: 99690 - DNA, 650 bp, Homo sapiens
  misc_feature: GYAE6OF02JF2QC.40.81.H04.1.454.CMB.1.raw
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagacncctacctaaacactaatgatactactcttanaattcgtactgcagaacgccaggcacgtctccacagctcttgattattagttggggtttcttaggtccgggtcccgtccggggttccctgaccgtaggttcaggtcgcgagtggatcgagtccactagtactttacactaagaaactcagacgagggtggacggacgtaagaacggtgttagggttacggttaattttagttacgttgacttagtacgtaacctaaccgttacgtaaaccgtaaacgttgggtacggttacggggtaccggttacgggaacccggtaaaacggggtacccggaaaaggggttaacggaaaacggtttaaccggaaacgggttaccgggttaaacccggttcgggtaacgggttaccctacggtaacccg

SEQ ID NO: 99691 - DNA, 557 bp, Homo sapiens
  misc_feature: GYAE6OF02FZXZH.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagagccggcctccatctcctgcaggtctagtcagacgcctacctaaacactaatggatactactctttgaattcggtacctgacagaacgccgagggcagtctccacagctcttagatattagttggggttacttagtccggggtccgttcccggggtccctgacgtaggttcgtagtggctaggtggatacgagtcacgtagtaattttacactagtaaatcagcgagggtggagagaagaagtagtgttaggtatttagtactgatatacgactaacctactaactaactgtgtaggacgtcggaccgaacgggtaaccgaaggtagaactacgaagaccgtacgtggtacggcgtagaccg

SEQ ID NO: 99692 - DNA, 492 bp, Homo sapiens
  misc_feature: GYAE6OF02GDS56.40.81.H04.1.454.CMB.1.raw
  modified_base (434)..(434): a, c, t, g, unknown or other
  misc_feature (434)..(434): n is a, c, g, or t
  modified_base (451)..(451): a, c, t, g, unknown or other
  misc_feature (451)..(451): n is a, c, g, or t
  modified_base (474)..(478): a, c, t, g, unknown or other
  misc_feature (474)..(478): n is a, c, g, or t
  modified_base (480)..(492): a, c, t, g, unknown or other
  misc_feature (480)..(492): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcgggtgaaggtctcctgcaagtatttctaggaaacaccctagagcaactactacatacactggatggcggcacggcccctgggacgtaggggtttgaggtgggagtgggggtggactccaaccctaccgaggacggtggacaacgaaagtatacgacgaagtaactttcgagggcgaggtcacgatcgacgtgggacgcgtccatcagcacngtctacagtgatcgagngcggcgtaggcaggcgacagtgnnnnngnnnnnnnnnnnnn

SEQ ID NO: 99693 - DNA, 572 bp, Homo sapiens
  misc_feature: GYAE6OF02GI9VQ.40.81.H04.1.454.CMB.1.raw
  modified_base (422)..(422): a, c, t, g, unknown or other
  misc_feature (422)..(422): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactctttagaattggtacctgcagaagccgagggcagtcctccacagtctcttgatattagtttggggttcttacgtccgggcccgttcccggggtcctggtacgtggtttacgaggtcggactaggtggacttcgagtcagtagtacttttacactagaaatcgagngagggtggagacgtaaggagagttaggttaggtatttagttacgtgactagtcgactacctactaactaacgtgtagtacggtacggtacggaccggaaaggtacgaaggtacgtaacgtacgaaggacgtaagtggtcggtactgaccg

SEQ ID NO: 99694 - DNA, 680 bp, Homo sapiens
  misc_feature: GYAE6OF02HHMRW.40.81.H04.1.454.CMB.1.raw
  modified_base (298)..(298): a, c, t, g, unknown or other
  misc_feature (298)..(298): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcagtctccactcctccctgcccgtcacctccgtggagacggcccggcctcctatcctcctacgcaggttctagtcaggacgcctactaaacactaagtgaattactattctttagaattggacctgacaaggaacncgaggctacgtctccacgagtcctacgttgaattatttaggtttcggggtttacttaccgggtccggggtcccgtttcccgggggtaccctaggtacgtacggtttaccgaggtggaccgtagggtggtaactccgaaggtccaacgttaagttaaccgtttttaacaaaccgttaagtaaaacttccgaacggttcggttacggggtaggacggtaacggtaaaggtaaggtagtttgggttaggttaatttactttacgagacctagtacgacctaaccgtagtaaaccgtagtgttcggtacgggaccggtacggaccggtaaaggacggtaaagggtagaaagtcgtaacggagtaagtcggttaggccgtataaccg

SEQ ID NO: 99695 - DNA, 691 bp, Homo sapiens
  misc_feature: GYAE6OF02JFELZ.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggtctcttcttggtggcagcagccgcgaggagcccgactcccgaggtcgcgacgctggtgcaggttcgtggggcgtggaggtgaaaggaacgccgtcggggccgtcggtaggaacggtctccgtgacgaagtatttccgtacggtaaaccgaccctgacgacctaactaccgtactaatacgaacgtacggagtcggcggaccgtaccgggccccgtacgggtacggtaacggggttttaggaggttgggtacgggttacgggggtacggtaacgtacccgtaaaccccgtaacgaggtacgggtcgacaaccgtaaagtacgttacgaacgtaacgtacttacggaggtacggacggtacacgtacgtacgtaccggtcggaaccgtcgtacctaacgtcacggacgaacgtagtaccgtaagtgtaccggtagtccgttacggagttccgggtacgtaccggtaacgtacggtaccggaacgtaccggtacggaccgtagtacgtacgtacgtgtacgg

SEQ ID NO: 99696 - DNA, 657 bp, Homo sapiens
  misc_feature: GYAE6OF02IVMQO.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagcccgcagggagccccactccccgaggtcgcagctggtgcagtcgtggggctggaggtgaagaagccgtggggcctcggtgaaggtctccgtgacaaggtattttcgtagggaaacctacccgtggaagacctaaaccgtacctaacgataccgaccgttaggaagttggacggtcgaccggtcccgtgggacgtaggggtttcgaggtggagttgggggtagacgtccgaaacccgtccgaaggtacggcggacgaacgaaagtacgtacgtactaacgtaacgtttcggaagggtcgaacggtccaacgtacgcggtacccgtacgggacgccggtccagtaccgacgcacgtacggtactacgtaggtagtacgttcgtacgtacgggacggtaccgtaccgtaacccggtacgtccgaccggacctaccggaccgtacgtacggtttacgtacgtacggg

SEQ ID NO: 99697 - DNA, 660 bp, Homo sapiens
  misc_feature: GYAE6OF02GCN6H.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagacgcccggcctccatctcctgcaggtctagtcagacgcctacctaaacactaatggatactactctttgaattggtacctgcagaacgccgagggcagtcctaccacacgtctcttgatattagttggggttcttaggtccgggtcccgttccgggggtccctgacgtaggtttcgaggtggacgtaggtggactacgtagtacaagtagttaacttttactaactaagtaaaactcgaagtcggttggggtagggaggacgaaggtaagtagttgggttaggttattttagttacgtggtactagtacgtacctaaccttactaaacgtaaacgttggttacgggtacgggtaccgggtaccgggaaccggtaaacggggtaaccggtaaaggggttaacggtaaaacgttaccggaaacggtaccggtaaaccggttcgggtacgggtaccgtagtaaccccg

SEQ ID NO: 99698 - DNA, 558 bp, Homo sapiens
  misc_feature: GYAE6OF02GO19L.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttcaggaaaccaccctgagacaactactacactacacgtgatgcggcacggcccctggacgtaggggttgaggtggagtgggggtagactcaaccctacgaggtaggtggacaacgaaagtcacgaacaggtaacttcgagggtcacgggtccacagtcgaccgtgggactcgtacataccagcacgacgttacctacgagtacggattcgtaggacgcgggacctcggtacctcgtacggaacgacgtacggacctacgtgttacgttacgtaggg

SEQ ID NO: 99699 - DNA, 745 bp, Homo sapiens
  misc_feature: GYAE6OF02HPABF.40.81.H04.1.454.CMB.1.raw
  modified_base (228)..(228): a, c, t, g, unknown or other
  misc_feature (228)..(228): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatctcctgcaggtctagtcaggacncctacaacataatggactactacttcttagtagttacgtacctgactagaacgccgacggactagtcctaccacgacgtcttacgtagtaattacgttaggtttcgggtttacttaacggtccggggtacccgttccgggggttaccctaggaaccgttacggggttactacgggttacggtaccgtagggttacggtaacttacggtacgttaccgtaaacgttaacggtttaaaccttttttaaccgaaacgtttaaacgtaaaaaccgttcgtaaacgggtaccggtaagggggtaacggggtaaccggaaggtaaacggtaaacggttaaggtttcggggtttaagggttttaaactttaaccggtttacgtacggttactaacgttaccgtaaccgtaaccttaacgtaaacgttaacgttcggtaacgtcgggtaccgtacggtacggaacggtaacggaaggtacgaaacgtacgaacggacgtacgtggcgtacgtacgactacgtacg

SEQ ID NO: 99700 - DNA, 688 bp, Homo sapiens
  misc_feature: GYAE6OF02J1N5D.40.81.H04.1.454.CMB.1.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
  modified_base (585)..(585): a, c, t, g, unknown or other
  misc_feature (585)..(585): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtcgcagctggtgcagtcgtggggctggaggtgaaagagccgtggggcctcgggngaaggtcctctgcaagtntttcgtagaacacctgagcaactactcatancgtgatacgcggacacggcccgtggacgtaggggtttcgaggtaggaggtggggtagacgtacaacccgtacgaggaggtcggacgtaacgaaacgtagtaccgaacgagtaactttccggagggtaccgtaggtaccgtaccgtaggtccgtacggtaacgggccgacccgggtacacgttacgacgtacgaccgtacgtacgtacctaggtcggtaactcgtagggaacggcgggtacgtaccgacccgttacgcgggtaacccgaacgtacccggtacgtacttaccggttaggtttaacccngggtttaggaaccgggttaagttcgggtttacggggacgtccgggttaacccgggtcgggaccggttaccggaaccgttaccggggtaccgggtaaccccggg

SEQ ID NO: 99701 - DNA, 572 bp, Homo sapiens
  misc_feature: GYAE6OF02FRN73.40.81.H04.1.454.CMB.1.raw
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (378)..(378): a, c, t, g, unknown or other
  misc_feature (378)..(378): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtagaagaagccgtggggcctgggtgaaggtctcctgcaagatttcgaggaaaccncccgtgacgccaaactactanactacacgtgatcggcgcgacggcccgtaggacgtaggggttgaggtggacgttggggngactaccaacccgtacgacggtaggtcggacgaacaaaggtatacggaacaacgtacttggagggcgaggtccacagtcggaccgtgggacctccgtaccgaatcgacgcaacgtcgtacctaagatggtactctaggcgtacggctacggaccgtcgtacgacgtaccgccgactagtacgttagtcgtaggg

SEQ ID NO: 99702 - DNA, 561 bp, Homo sapiens
  misc_feature: GYAE6OF02IRHBX.40.81.H04.1.454.CMB.1.raw
  modified_base (231)..(231): a, c, t, g, unknown or other
  misc_feature (231)..(231): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaaacactaanggatactactctttagaattggtacctgacagaagccaggcagtctccacagctcttagattatagttggggttcttagtccgggcctccggggtccctgacgtaggttcagtggctagtggatcagtcanagtatttacatagaaatnagcgagggtaggaggacgaagaagagtggttagggtatttattacngactanagactaacctactaactaaagtgtagtacggacggtacggaccgaacggacgaaaggacgtaatacgagacgtaacgtggtacggcgtcgactaccgtatcgtagttccttacgtactccgttaccccg

SEQ ID NO: 99703 - DNA, 808 bp, Homo sapiens
  misc_feature: GYAE6OF02GQ9IV.40.81.H04.1.454.CMB.1.raw
  modified_base (795)..(795): a, c, t, g, unknown or other
  misc_feature (795)..(795): n is a, c, g, or t
tcagtctagcgactcacgaccggtgctcgatttagtagtgtagattcgcggggtgccctgagagcatcacccagcaaccacgatctgtcctctagagaatcccctgagagctccgttcctcaccatggactggacctggaggactcctcttcttggtggcagcagccgcaggacgccgactccaggtgcagctggtgcagtcgtgggctggaggtgaagacgccgtagggccgtggtagaaggtctccgtgaccaaggtacttttcgtagggaaaccaccccgttggaacgtacgaaaccttaacgtaacgtaactttaaccaaccgtaggaccgtacggtaccgggccgtaaccgggtccccgtacggtaaccgggtaacggggtttacggtaacgggttcgggtaaacggttcgggggtaacggtaacggtttaacccgaaaccccggttaaaccggaacggttaacgggggttacggaacgttaaacgtaaaaacgggtttacggtaaacccggtaacgtaacggttaaacccgttttacggaaccgggtacggtaaacggggttaccaacccgttaagttccggaaccggtcggggtaaccgtacggtaccctaagtacgtacggacctaacggtacgtacgtaactaggtacggaacttcgttagaccggtacggtacgtttaccggacgttacggtacgttaaccgacggtaccgtaccgtagtacgggttaacttacgtagggtacggtaacgtaccgtaacggttcggtacggtaccgtacccgggnggtacccgtacgg

SEQ ID NO: 99704 - DNA, 582 bp, Homo sapiens
  misc_feature: GYAE6OF02IMOES.40.81.H04.1.454.CMB.1.raw
  modified_base (181)..(181): a, c, t, g, unknown or other
  misc_feature (181)..(181): n is a, c, g, or t
  modified_base (441)..(441): a, c, t, g, unknown or other
  misc_feature (441)..(441): n is a, c, g, or t
tcagtctagcgactcacgaccggtgctcgatttagtagtgtagattcgcggggcgtagactttgtgtttctcgtagtctccctgctcagctcctggggctgctaatgctctgggtctctggatccagtggggatattgtgatgactcagtctccactctccctgcccgtcactcctggagngccggcctccatctccctgcaggtctagtcacgagcctacctaaacactaatggatactactctttagattggtacctgcagaagccgagggcagtctccacagctcttgatattagttgggttcttacgtccggtccgtccgggtccctagacgtaggttcaggtggctagtggatcgaagtcatagtacttttacacttaagaaatctagcgtagggtaggaggacaagagtagttggtggtatttactagtgctatnactaacctctaactaacgtgttaggaggtacgtccggaacggtacgggaacgtaaaggtaacggtaatacgaaggtaccgtaacgtggtacggtacgtacgacaaccgtacttccgttgtccttactacctcccgtacccg

SEQ ID NO: 99705 - DNA, 703 bp, Homo sapiens
  misc_feature: GYAE6OF02IMEAW.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtgggatattgtgatgactcagtcctccactcctccctgcccgtcacctccgtggagacgccggcctccatcctcctgcaggttcctagtcagacgccctacctaaaacactaatggtaattactacttcttagaattggtacctgacaaggaacgccgagggctacgtcctaccacgacgtccttacgttagaattagtttaggtttcggggttacttacggtcccggggtcccgttcccgggggtcctaggtaccgtagggtttacgaggttcggaccgtaggtaggtactacgtagtacctaacgtaacgtttaacttttaaccgaacgttaaagtaaaactcggtaacggtcggtaggggtagggaacggacgtaaaggtaaggtaggttagggtttagggttattttaagttacgtgtacttacgtacgaaccttaaccgtactaaacgtaaacgttggtaggtacgggtaccggtaccggaaccggaaacgggtaaccgtaagggtaacgaacgtaacgtaacggaaccggtaagtggtacgtcgtaccgaaccg

SEQ ID NO: 99706 - DNA, 257 bp, Homo sapiens
  misc_feature: GYAE6OF02JH8A4.40.81.H04.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (256)..(257): a, c, t, g, unknown or other
  misc_feature (256)..(257): n is a, c, g, or t
tcagtctagcgactcacgaccggtgctcgatttagtagtgtagattcgcggggatactactctttgaattggtacctgcagaagccagggcagtctccacagctcttgatatattggggtccttatcggccgtccgggtccctgacaggttcagtggcagtggatcagtcacagtatttacaactagaaaatcagcagggtggaggacgagaagagtgtgggntttaattactgcatnctaacctctacagtacgnn

SEQ ID NO: 99707 - DNA, 797 bp, Homo sapiens
  misc_feature: GYAE6OF02FZP3G.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctgggctgaggtgaagagccgtgggcctcggtgaaggtctcctgacaagtactttcgtaggaaaccaccctgagacaactactacatacactggatgcggacacggcccgtggacgtaggggttgaggtggagtggggtagactaccgaaccgtaccgaggtacggtcggtacaacgtaaacgtacgtacgaactaacggtaacctttacggaagggtaccggtaacggggttacctaaccgtaacgtacggtaacccgggtacggggtaccggtacccgggtttaaccaacgttaccgaaaccgggtacccgaaccgtaacgttaccgttaaaccgtaacgttacgggtaaccgtttacggtacggtacgggtaccgggtaaccgttaaccggacccgtttaccggtaccggtaacccggtaaccggtaaccggacccgtttaagttaccggtttaaaccgttaccgggtttaaggaacgggtttaaacgggaaacggtttaccggggttaaggggttacccggtaaccccggttaccgggggtaccgggtaaccccggttacggtaacccggtaacccggggttacccgggtaaacccccgggg

SEQ ID NO: 99708 - DNA, 650 bp, Homo sapiens
  misc_feature: GYAE6OF02JF2CH.40.81.H04.1.454.CMB.1.raw
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
tcagtctagcgactcacgaccggtgctcgatttagtagtgtagattcgcgggggactgatcaggactcctcagttcaccttctcacaatgaggctccctgctcagctcctggggctgctaatgctctgggtctctggatccagtggggatattgtgatgactcattctccactctccctgcccgtcactcctggacgagccggcctccatcctcctgcaggtctagtcagacgtcctacctaaacactaatggatactactctttgaatttcggacctgacagaagccgagggcncgtctccanacgctcttagatagttagttgggttacttacgccgggtccgtcccggggtacccttagccgtaggttcgnggtacggcgtaaggtcggatacgacgtactactagttaacgttttaacaacgttaagaaaactcggtaagacgtaggggtacggtaagggactaaagggtaacgtaggtttagggttacgggttaattttacttaacgtgtactagtcgaactaccctataaacgtaaacgtgtacgggttacgggcgttaaccgggaccgtaaacgggaaccgttaagggtaacggtaacaaggtaacggtacggaaaccgttggtcggtaccgtcggtaacccg

SEQ ID NO: 99709 - DNA, 530 bp, Homo sapiens
  misc_feature: GYAE6OF02FPD6P.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagcctggggcctcggtgaaggtctcctgcaagatttctggaaacaccctgagcaactactacatacactggatgcggcaggcccctggacaggggttgagtggatggggtgatcgaaccctacagaggtggacacgaagtatcgacagtactttcgagggcagggtcacgatcgaccgtgggacgcgtcgatcgagcacagtactacatcgatcgtaggcgcggactcggaccgtacgcgacgacgtacggacagtgtatacgtggtagaagtagtaggttcggtggtcgtcggcgggtcgcgtaccgaggtccgggg

SEQ ID NO: 99710 - DNA, 541 bp, Homo sapiens
  misc_feature: GYAE6OF02I3SS2.40.81.H04.1.454.CMB.1.raw
  modified_base (459)..(459): a, c, t, g, unknown or other
  misc_feature (459)..(459): n is a, c, g, or t
  modified_base (485)..(485): a, c, t, g, unknown or other
  misc_feature (485)..(485): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctggggcctcggtgaaggtctcctgcaagatttcaggaaacaccctgagcaactactacatacactggatgcggcacggccctggacgaggggtttgagtggagtggggtagataccgaacccgtacgaggtacgggtggaccaacgaaagtacgtacgacgagtaactttacgagggtacacgggtcaccgagtcgaccgtcgggacnccgtcacgtcagcgacacgtcctacngtcgatcgtgacgcggctacggacgtacgacgacgacgacggcagtcgtatcgagg

SEQ ID NO: 99711 - DNA, 518 bp, Homo sapiens
  misc_feature: GYAE6OF02FUEE0.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttcgagtggagtggggtggatcaaccctaccgagaggtggcacaaagtatcgacagaactttcgaggcaggtcacatgactgggacgcgtccatcacgacacgagtctacatggatctgagcggactgcctcgtcgacgacacggcatcgtattactgaggaagagacggttgtggcgtacggcgggcctaggacctacggtgggtaacccgg

SEQ ID NO: 99712 - DNA, 377 bp, Homo sapiens
  misc_feature: GYAE6OF02IU4I3.40.81.H04.1.454.CMB.1.raw
  modified_base (289)..(289): a, c, t, g, unknown or other
  misc_feature (289)..(289): n is a, c, g, or t
  modified_base (351)..(351): a, c, t, g, unknown or other
  misc_feature (351)..(351): n is a, c, g, or t
  modified_base (368)..(377): a, c, t, g, unknown or other
  misc_feature (368)..(377): n is a, c, g, or t
tcagtctagcgactcacgaccggtgctcgatttagtagtgtagattcgcggggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacgtcggaccaagggaccaaggtggaaatcaagngaactgtagctgcaccatctgtctcatcttcccgccatctgaactcgctagactgagcgggntggcaaggcgacatagnnnnnnnnnn

SEQ ID NO: 99713 - DNA, 741 bp, Homo sapiens
  misc_feature: GYAE6OF02IYV03.40.81.H04.1.454.CMB.1.raw
  modified_base (333)..(333): a, c, t, g, unknown or other
  misc_feature (333)..(333): n is a, c, g, or t
  modified_base (546)..(546): a, c, t, g, unknown or other
  misc_feature (546)..(546): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggagatcctcttcttggtggcagcagccgcaggagcccactcccaggtgcagctgggtgacagtcgtggggctggaggtagaagaacgccgtcggggccgtcgggtagacggtctccgtgactaagtctttcgtacggaaacctacccgtagacgtaccgtaaacctaactaactaataccacgtagggactcggaccgggaccnccgggtaccccgtagggaaccgggttaggggggtttacggtagggttacgggtgggtacgggggttggtaaccgttaccgaaaccccgtacggtaacggtacggtacggactaaacggtaaagttacgacgtaacgtacgtaaaccgttcggacggggtaccgaagggtccaacgtacgtaccggaccgggtagggaccggtccgtaccgtanaccgtacggctacgacgttactaagtcgtaggtactacgtcggacggacggtacgtacggtcctacgacgaaccggtacgtacgacgtaacgttacgttacgttacgtacggtacgggtaaggtacggttacggtagggtcgtaccggtacggggcggtacctacgggtaccggtcggggtaccgggtaacccgg

SEQ ID NO: 99714 - DNA, 743 bp, Homo sapiens
  misc_feature: GYAE6OF02GRESD.40.81.H04.1.454.CMB.1.raw
tcagtctagcgactcacgaccggtgctcgatttagtagtgtagattcgcggggatcaggactcctcagttcaccttctcacaatgaggctccctgctcagctccgtggggctgctaatgctctgggtctctggatccgaggtggggatattgtgatgactcagtctccactcctccctgcccgtcacctccgtggagacggcccggcctccattcctcctgcgtaggttctagtcagacgccctaacctaaacactaagtggtaacttaccttacttctttagtaacgtttcggtacctgacaaggaacgccgaggctacgtcctaccgacagtccttcgttagaattagttacggtttcggggtttacttacggtccgggtacccggttcccggggtacccttaggtaaccgttacgggttaccgagggttcggacgtaagggtacgtacgttacgtacggtacgaacgttaagtttaacttttaaccgaacgttaagtaaacgtcgaggtacggtaggggtacggaacgtacgaaggtaaggttaggttagggttacggttaatttacgttacgtacgacgtaacgtacgtaaccttaaccgttaacgtaaactacggtttggtacgggttacgggtaaccgggtcggtaacccggtaaggggtaaccgtaaagggtaacggttaacgtaacggaaccggtacgtaacggttcggacggtaccgtacgaccgtaacgtccg

SEQ ID NO: 99715 - DNA, 656 bp, Homo sapiens
  misc_feature: GYAE6OF02FWQ7S.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcattctccactcctccctgcccgtcactcctggagagcccggcctccatctcctgcaggtctagtcagacgcctaccaaacactaatggatactactctttgaattggtacctgctagaagccagggcagtctccacagctcttgattatagttggggttcttagtccgggcccgttccggggtccctggacgtacggttcgaggtggctaggtggactcgacgtacacgtagtattttaaccgaagttacgaaaattcaacgggtcgtaagggggtacgggaacgggtacgaaggtaaaggagttagggtttcgggttaattttaagttacgtgtacgtagtacgtaccgtaaaccttactaaccgtaaacttgggtacggttaacggggtaccgggttccggaaccggtaaccggggtaaaccgtaacggggtaaggtaaaacgtacgaaacggtaaccggtaaccgttagggtacggtcgttacgtacccg

SEQ ID NO: 99716 - DNA, 549 bp, Homo sapiens
  misc_feature: GYAE6OF02HVJP4.40.81.H04.1.454.CMB.1.raw
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
  modified_base (469)..(469): a, c, t, g, unknown or other
  misc_feature (469)..(469): n is a, c, g, or t
  modified_base (495)..(495): a, c, t, g, unknown or other
  misc_feature (495)..(495): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggagggtagaaggaaggccgtggggcccgtcgggtggaaggtctcctgcaagatttctaggaaaccaccctgacgcaactactacatacactgatgcggcacggccctgggacgtaggggttgaggtggagtggggtggatcaaccctacgaggaggtggacacgaaagtatcgacagtaactttcgaggcgagggtcacgancgtacgtcgggcgcgtcatcagcacagtactanagtggatcgtagaggcggtacgtcgccgtancgaccgacgacgacagtgtattacgnggtgaaggtagtcgtggtggcgtacggcgggtactacggtaccgacggtcgggg

SEQ ID NO: 99717 - DNA, 715 bp, Homo sapiens
  misc_feature: GYAE6OF02JS4UK.40.81.H04.1.454.CMB.1.raw
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagtctagcgactcacgaccggtgctcgatttagtagtgtagattcgcgggggtgatcaggactcctcagttcaccttctcacaatgaggctccctgctcagctcctggggctgctaatgctcgtggtctctggatccagtggggatattgtgatgactcagtctccactctccctcgcccgtcacctcctaggacgacgccggcctccactcctcctcgcgtacggttcgtacgtcacggacgtcctaacctaaactaccttaagttcggaacttaccttacttaccgtttagtaaaacgttcgggtaaccgtacggtaacgagaaccggtccgaacggggtctacgtacctaccgacgacgtacttacgtttacgaagttacgtttagggtttcggggtttacttaccgggtccgggtacccggtccgggttaccngggtaaccgtacggttacgnggttacgcgtagggtacgtactacgaactcactagttattacactagtaaactcgagtacggagggtacgacggtacgaagtacgtacgttaggttacggttactttacgttcgtacgattacgtacgtaactaaccgtacttaaaccgtagttacgggtacgtcgggtaaccgggtacgtaacggaaaccgggtaaggtaacggttaacgaacgtacgaacggtcgtacggtagtacgtacgtacggtcctaacg

SEQ ID NO: 99718 - DNA, 597 bp, Homo sapiens
  misc_feature: GYAE6OF02FNRMJ.40.81.H04.1.454.CMB.1.raw
  modified_base (480)..(480): a, c, t, g, unknown or other
  misc_feature (480)..(480): n is a, c, g, or t
  modified_base (524)..(524): a, c, t, g, unknown or other
  misc_feature (524)..(524): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtggggcctcggtgaaggtctcctgcaagtatttctaggaaaccaccctgagacaactactaacatacactggatggcggcacggcccctggacgtaggggtttgaggtgggagtggggtgactaccaaccgtacgagaggtggacaacaaaggtatacgaacgaacgtaactttacggacgggacgtacgggtccaaccgagtggaaccgtggggaaccgtcgtacccagtccgacgccacgtacttactacagtacgacttcgnggacgcgggactggaccttcggacgaaccgacgtacgcctagtntagtctggtaggaacgtagggttacggttggacggtacggtaccgggcgggtccgtacgaccgcggtacgggg

SEQ ID NO: 99719 - DNA, 745 bp, Homo sapiens
  misc_feature: GYAE6OF02JVCNM.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccgactcccaggtgcagctggtgcagtcgtgggctggaggtgaagaagccgtcggggtcctcgggtggaagggtcctccgtggaccgaagtactttccgtacggaaaccacccgttgaggaccaaactaccgtaacactaccagtaggatagccggacgaccggcccccgtaggacggtagggggtttagagggtacgggtagggtggggtagggtacttaccggaaaccccgttacgacggagggtcggtaccgaaacggtaaacgtaacgtccggtaaacgtacggttaaacctttaccggaacggggtacggaaccggggttaccaaccgtaacgtacgggtacccgtacgggggtaccgtaccggtacccgtacgtaccggtaccggtacacccggaagttaccgtaaacgtacgttacggaagttaccggtagacgggtacggtaccgtacggtacctacgtacggaccgtaccgaccggtacgactcggttaatccgtaggtacggaaggtagtacggttggtacggtaccgtcggtacggaccggttcggaacgtcgggttaccgggacccgg

SEQ ID NO: 99720 - DNA, 738 bp, Homo sapiens
  misc_feature: GYAE6OF02HXR3O.40.81.H04.1.454.CMB.1.raw
tcagtctagcgactcacgaccggtgctcgatttagtagtgtagattcgcgggcgtagactttgtgtttctcgtagtctccctgctcagctcctgggctgctaatgctctgggtctctggactccaggtggggatattgtgatgactcagtctccactcctccctgcccgtcactccgtggagacgcccggcctccactcctcctgactacggtctagtcagacgcctacctaaaacaactaagtcgataaccttacttcgtttagaaactttggtaaccctgacgaaggtaaacgccggaaaggggcaacgttccgtaccaactacgtccttacgtttggaactttaataaggttttcgggggttaaccttttacggtcccggggttccccgttcccgggggttaccctcgggtaaaccgttacggggttccaagggttcggtaccgaaggttcgggtaactcgtaagtccgtaaacggtaactttaacgttttaaccaacgtaagtaaaaactcggacggttacgaggggtaggacgagtaaaggaagtacgttagggttacgtaaagtttgtaacgtgacgtagtcgacctaaacgtctaaacgtaaacgtgtacggtcggaacgtccggaacgaacggtacggaagtaaacggtaatacgaacgacgtaacggtcggtagtccacggtaaccctagtacgtacgttcgtttacctctaccttcccgttaccccgg

SEQ ID NO: 99721 - DNA, 626 bp, Homo sapiens
  misc_feature: GYAE6OF02G8S04.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcattctccactctccctgcccgtcactcctggagacgcccggcctccatcctcctgcaggtctagtcagacgcctacctaaacgctaagtggatactacttctttgaattggtacctgcagaacgccgagggccagtcctccacgagtccttcgttgattattagtttcgggggtttaccttacgtccggggtacccgttcccgggggtcccttggaccgtagggtttcaggttggctaggtggactcgacgttcacgtagtacttttacacgtacaaatcagcgtagggtaggaggacgagaagtagttagttgggtatttagttacgtgtacgtagtacgtacctaaccttacgtaacctaacgtacgttacggtagggtaccggtcggaccggaacgggtaaccgtaagggtaacgtaaacgtacgaacggtacgtaaccgttcggtacggtctacgtaccg

SEQ ID NO: 99722 - DNA, 638 bp, Homo sapiens
  misc_feature: GYAE6OF02FPZUH.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtgggcctcggtagaggtctccgtgcaagtatttctaggaaaccaccctgacgacaactactacactacactggatggcgcgacggccccgtggacgtggggttgaggtggagtggggtagactacccgaacctacgaggaggtacgacaagaaagtatacgaacgtaacgtaacgttacgacgggtacgacgggtaccaacgtagtaccggtaccgtcgggaccgcgtaccacgttaccgacgcgaacgtcgttaccgtaacgagttacgactcgtacgacggtccggtactacggtacctcggacgacgacgtaaccgctagtacgtacgttacgtaggtacggtaacggtacgttacgggtcggtacggtaccggtaccgggcgggttccgtacggtacccgtacgggtcgggaacccgg

SEQ ID NO: 99723 - DNA, 686 bp, Homo sapiens
  misc_feature: GYAE6OF02F8BG9.40.81.H04.1.454.CMB.1.raw
  modified_base (255)..(255): a, c, t, g, unknown or other
  misc_feature (255)..(255): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtaccngcagagccagggcagtctccacagcttcttgatagttagttcggggtttacttagtccggggtcccgttcccgggggtcccttaggacgtaggttcaggtcggcaggtggatcagtcacgagtatttacagtagaaatcagtcgagggtggagggacaaggtaaagtagttagggtttagggtaattttaacgttacgtagtacgtagtccgtacctaaacccgttactaaaccgtaaacttgggtaggtacggggtaaccgggtaccgggtaaccggaaacgggggtaaccgtaaaggggttacggtaaaacgtccggaaacggtaccggtaaaccgggttggttaccgggtactacgggtaaccctaaccgttaacgttcgtttaccggttacccgtttaaccgtaccgttaccccgtttaccccccgg

SEQ ID NO: 99724 - DNA, 794 bp, Homo sapiens
  misc_feature: GYAE6OF02GWLIP.40.81.H04.1.454.CMB.1.raw
  modified_base (238)..(238): a, c, t, g, unknown or other
  misc_feature (238)..(238): n is a, c, g, or t
tcagtctagcgactcacgaccggtgctcgatttagtagtgtagattcgcggggatcgaggactcctcagttcaccttctcacaatgaggctccctgctcagctcctggggctgctaatgctctgggtctcgtggatccaggtggggatattgtgatgactcagtctccactctccctgtcccgtcactaccgtggagacgccggtcctccatcctacctgcaggtctagtcaggtacncctacgtaaacactaataggacttactacgttctttagagttcgtacctagctaagacgcgaacggtcacgtcctaccgacacggtcctacgttgattaagttaacggtttcggggtttacttaacggtcccggggtcccgttaccccgggggttacccctaggaaccgttacggggtttccgaagggtttcggaacgtaggttagggaaacttaccggtaacgttaccgtaaccgtaaggtttaacctttttaaccgaaacgtttaacggaaaaacgttcccgtaacgggtaccgggtaaagggggtacggggaacgaaccgggtaaaggtaaagggttccggtttaaggggtttagggttaaaccttttaaaggtttaaccgtcgggtacttaaacgttaccgggaaccctaaaccttaccgttaaacgttaacgttagggtaccggtacgggtaaccgggttaccggaacccggtaaggggaaacccgttaagggtaaacggtaacgtaagtaacgacggttaacttcggacggttagccgtacaccgttacg

SEQ ID NO: 99725 - DNA, 597 bp, Homo sapiens
  misc_feature: GYAE6OF02F98DX.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtgggctggaggtgaagaagccgtggggcctcggtgaaggtctccgtgcaagatttctaggaaacaccctgagacaactactacagtacactggatgcggcacggcccctgggaccgtaggggtttgaggtggaggtggggtggatccgaacccgtacgaggaggtggaccgaagtaaaggtagtacggaactagtaaccgtttacgacggggcgagggtccaacgtagtcggaccgtgggaccgtccggtaccagtacgacgcaacgagtaccttaacgacgttaggactcgaggtacggcggtacgtacgtacccgtacgttacgaccgtacgtaccgggctaggtacgttacgttagtacggg

SEQ ID NO: 99726 - DNA, 596 bp, Homo sapiens
  misc_feature: GYAE6OF02IM5UD.40.81.H04.1.454.CMB.1.raw
  modified_base (262)..(262): a, c, t, g, unknown or other
  misc_feature (262)..(262): n is a, c, g, or t
  modified_base (322)..(322): a, c, t, g, unknown or other
  misc_feature (322)..(322): n is a, c, g, or t
  modified_base (528)..(528): a, c, t, g, unknown or other
  misc_feature (528)..(528): n is a, c, g, or t
  modified_base (569)..(569): a, c, t, g, unknown or other
  misc_feature (569)..(569): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtgggcctgggtgaacggtctccgtgacaagtatttcgtaggaaacnccctagacgacaactactaacatacactggatgcggcaggcccctggacgacggggtttnaggtggagtggggtgactacaaccctacgaggacggtgacaagaaagtacacgaacgacgtaacgtttcgagggtacgaggtacaccgtagacgtaccgtgggaccgtcgtaccacgtcgagacactacgtacgtacatacgggatacgtacggacgcggtactcgaccgttgacgtaccgacgacgtacgattacgactttacgnggtaacggacgaggtaccggttaggacggtcgtacccgggnggtacacggtaccgtacggtaccgggg

SEQ ID NO: 99727 - DNA, 630 bp, Homo sapiens
  misc_feature: GYAE6OF02FVF10.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccgcctccatctcctgcaggtctagtcagacgcctacctaaacactaatggatactactctttagaattggtacctgccagaacgcgagggcacgtctccacacgctctagatatagttgggttcttagtccggtccgtccggggtccctggactaggttcgaggtcggagtagtggatcgacgtcacgtagttacttttacaataagtaaactacgagtcggttagggtacgggacggtacaaggtaagtaggttaggttagggttaattttaagttacgtgtactagtcggaaccttaactaaccttaacgtaaacggttgttacgggtacgggtaccggggtcggaacccggtaaggggtaaccgtaaaggggtaacggaaacgtaggaaccgtaacggtaacgtaggtacggtaccggtagtaacccgg

SEQ ID NO: 99728 - DNA, 724 bp, Homo sapiens
  misc_feature: GYAE6OF02IIYJS.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccacctcccaggtgcagctggtgcagtcgtggggctaggaggtgaaagagccgtggggccgtcggtaggaacggtcctccgtgactaagtatttcgtacggaaaccaccctaggacgacctaaactacctaacactacacgtaggatcggcgccgaccggccccgtagggacgtaggggtttagaggtggaggtggggtgactaccgtaaccctaccgaggacggtacggacaaacgtaaagtacgacgaacgtaagttacctttacggacgggacggtacggtaccacgtagtaccggcggtacgggaccgccgtaccgactacgacgtaccacgtacgtacttaacgtagtacggtacttcgaagggaccgggtacggtaccgtacggtacccgtaccggacggtaacccgtaaccggaacccggtactaccgttaggttaccttacggacgggtagggaaacgttacggggtacgggttggtacccgggtaccggttacccgggggccggggtaccgtaccggaaccggtacccgggggtaccggggtaacccgg

SEQ ID NO: 99729 - DNA, 618 bp, Homo sapiens
  misc_feature: GYAE6OF02GCL22.40.81.H04.1.454.CMB.1.raw
  modified_base (252)..(252): a, c, t, g, unknown or other
  misc_feature (252)..(252): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagccccactcccaggtgcagctggtgcagtcgtgggctggaggtgaagaagccgtggggcctcggtgaaggtctcctgcaagtatttcgnggaaaccaccctgagcaactactacatacactggatgcggcgacggccctggacgtaggggtttgaggtggagtggggtgactaccaaccctacgaggaggtcgacaacaaagtatcgaacagtaacgttcgagggcgtagggtacacgagtcgaccggtggaccgccgtacacgtcgacgaccacagtacctaacagttaggactcgtaggacggcgggtacttacgaccgtcgacggaccgacgacgtccgagtacgttactacgttggaacgggtaagtaacggttcgggttagggtaccggtaccggtacccgggtcggggtaccgtaccggacccggtaccgggtccgggggtaaccccgg

SEQ ID NO: 99730 - DNA, 684 bp, Homo sapiens
  misc_feature: GYAE6OF02F86SP.40.81.H04.1.454.CMB.1.raw
  modified_base (219)..(219): a, c, t, g, unknown or other
  misc_feature (219)..(219): n is a, c, g, or t
tcagtctagcgactcacgaccggtgctcgatttagtagtgtagattcgcgggcacgaccggtgctcgatttagtagtgtagattcggcggggagagcatcacccagcaaccacatctgtcctctagagaatcccctgagagctccgttcctcaccatggactggacctggaggatcctcttcttggtggcagcagccgcaggagcccactcccagggtncagctggtgcagtcgtggggctggaggtgaagaacgccgtggggcctcgggtaggaacggtcctccgtcgacaaggtacttttcgtagggaaaccacccctaggacgaccaaacgtactaacatacacgttggatgcggcacggtcccgtaggacgtaggggtttgaggtcggaggttggggtggtactacccgaacccgtaacgaggtaggtacggacgaacgaaagtactacgacgtaaggtaacgtttacgacgggtacggacgggttacccaaccgtacgtacggtaaccggtacggggaccggtaccgtaccaacgtacgacggtactaaccgtaagttaccctaacgtacgtacggacgttaccgtaggacgggtaccggaaccgtccggtaaccgtaccgttacggaacccggacggtaccgggtacctaacggttacggttacgttacggttagggg

SEQ ID NO: 99731 - DNA, 615 bp, Homo sapiens
  misc_feature: GYAE6OF02FK3RC.40.81.H04.1.454.CMB.1.raw
  modified_base (261)..(261): a, c, t, g, unknown or other
  misc_feature (261)..(261): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatactactctttgattgtacctgcagaancaggcagtctccacagctcttgatatattgggttcttatcgggcctccgggtcctgacaggttcagtggcagtggactcagtcacagtattttacactagtaaatcagcgagggtggaggcagaagagtgttaggtatttattactgtatatgacctaaccttacctaactaaacgttgtaggttacgggtacggggttacccgggaaccgaaacggggaaccgtaaacgggtaaggtaaacgtaccggtaacggacggtaaccgttagggtaccggaccggtacggtacctaacccgttacgttacccgtttcggttaccctttaccggtacctttacccgtttaccccccgg

SEQ ID NO: 99732 - DNA, 747 bp, Homo sapiens
  misc_feature: GYAE6OF02F8ZP5.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagacgccggcctccatcctcctgcaggtctagtcagacgcctacctaaacactaatggatactactctttgaattggtacctgactaagaacgccgagggcacggttcctccacacgtcttcgttagacttagttagtttcggggttctttagtccggggtcccgtcccgggggtccctaggaccgtaggtttcgaggtcggacgtaggtgggaattcgaggtcaaccgtagtacttttaacgaactaagtaaaactcgaaggtcggaagggggtacgggaacgggacgaaacggtaagggtaacgtttagggtttaggggttaattttaaggtttaaccttagggtactaagttaccggaccttaaaccccgttacgttaaaaccgttaaacgtttacgggttaggttaaccggggttaccgggggtacccggtaacccgggtaaacggggtaacccggtaaaaggggttaacgggaaaacgttaaccggaaaccggtaaccgggtaacgtttacgggtaccgggtaccggtaccggtaccgtaacccgtttaaccg

SEQ ID NO: 99733 - DNA, 557 bp, Homo sapiens
  misc_feature: GYAE6OF02IG0OA.40.81.H04.1.454.CMB.1.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (497)..(497): a, c, t, g, unknown or other
  misc_feature (497)..(497): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (536)..(536): a, c, t, g, unknown or other
  misc_feature (536)..(536): n is a, c, g, or t
  modified_base (541)..(542): a, c, t, g, unknown or other
  misc_feature (541)..(542): n is a, c, g, or t
  modified_base (548)..(548): a, c, t, g, unknown or other
  misc_feature (548)..(548): n is a, c, g, or t
  modified_base (550)..(557): a, c, t, g, unknown or other
  misc_feature (550)..(557): n is a, c, g, or t
tcagtctagcgactcacgaccggtgctcgatttagtagtgtagattcgcgggggagcatcacccagcaaccacatctgtcctctagagaatcccctgagagctccgttctcaccatggactggacctggaggatcctcttcttggtggcagcagccgcaggacgcccactcccaggtgcagctggtgcagtcgtggggctggaggtgaagagccgtggggctcggtagaggtctctgcagtattcagaaccncctgacnctaatactaacatacactggatgcgcacggcccgtaggacggtagggttgacggtaggtaggtggggtagtacgtacccgtaaccgtaccggaggtacggtaggacaaggtaaacgttagtaccggaacgtaagttaacgtttacggagggtacggtacgggtaccacgtagtccggacggtacgggaccgtacctaccgatacgacgctaacgacgttacaacgttagcgtactcgnggacggcgggtcgagacgacgcgactgancngntnnacncgagnngacgtngnnnnnnnn

SEQ ID NO: 99734 - DNA, 686 bp, Homo sapiens
  misc_feature: GYAE6OF02JGXGH.40.81.H04.1.454.CMB.1.raw
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagtctagcgactcacgaccggtgctcgatttagtagtgtagattcgcgggcacgaccggtgctcgatttagtagtgtagattcgcgggagagcgatcacccagcaaccacatctgtcctctagagaatcccctgagagctccgttcctcaccatggactggacctggaggatcctcttcttggtcggcagcagcccgcagggacgccccactccccgaggtcgccagcctcgggtgccaggttctgggggctggacggttgaagaggcctgggggccttcgggngaagggtctccgtggcgaagtntttccngggtaaaccacccgtgacgacaactactacagtacagttgatgcggtcacggcccctggacgtaggggttgacggtaggagtcgggggtagtacgtcccgaaaccccgttacgaggacgggttggaccgtaacggaaacgtagtacgacggaaacgtaacgtttcgacggggtacgtacggtaccgactacgtacggaccgtgggaccgccgttacccgattacccgagtaccgaaccgtacgtactaaccgagtacgggtacttacgtacgaccggtaccggcgttaaccgtacccgttacgtcccgggtaaaccgaccgggttaaccgggaccctaacgggttacgtttaaccggttaaccgttacgggg

SEQ ID NO: 99735 - DNA, 620 bp, Homo sapiens
  misc_feature: GYAE6OF02J1HZH.40.81.H04.1.454.CMB.1.raw
  modified_base (196)..(196): a, c, t, g, unknown or other
  misc_feature (196)..(196): n is a, c, g, or t
  modified_base (242)..(242): a, c, t, g, unknown or other
  misc_feature (242)..(242): n is a, c, g, or t
  modified_base (342)..(342): a, c, t, g, unknown or other
  misc_feature (342)..(342): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (588)..(588): a, c, t, g, unknown or other
  misc_feature (588)..(588): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctctaggactccaggtcgggatagttgtgatgactcattcctccactctccctgacccgtcactccnggacgcgccggacctcatcctcctagctaggtcctagtcaggtacnccctacctaaacacctaagtggactactaccttctttagaacgttggtaacctgtacaagacgacccggagggacctagttccaccgacacgtctacgtnatacgttagttggggtacttaggtccgggtccttccggggtcctagtaccgtagggttcacggaggttccgaaggttccgattcgtaacggtccaagtaacgtttacttaacgtaacgttaacgtaaactcgtaagacgggtaggtacgggaagtacgataaagtgtagttggttattgtactgacngtnaacgtacctataacgtgtagtggcggtacgcgtaacggacggaacgaagtcggaanaacgcgtaacgagttcgaggtccgtagtaccg

SEQ ID NO: 99736 - DNA, 655 bp, Homo sapiens
  misc_feature: GYAE6OF02GZZHN.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggtctcctgcaagatttcgaggaaaccacctgacgacaactactacatacacgtggatgcggcgacggccccgtaggacgtaggggtttgaggtcggagtggggtgacgtaccaacccgtacgaggaggtggacgacgaaagtactacgaacgagtaacgttacgagggacgacgggtccaacgacgtacgaccgtcgggacgtccgtacctagtaccgacggtaccgtacgtacgttaccgtaacgtacgttacgggtaattccggtaggaccgggaccggttacgtacggtaccgtacggtacgaccgacgaccggacttagtacgttacgttacgtaggtaggaaaggtacggttacggttcgggtacgacggttaccggcggggtaccgtacggacccggtacggtacggggtaacccggg

SEQ ID NO: 99737 - DNA, 758 bp, Homo sapiens
  misc_feature: GYAE6OF02JAVHH.40.81.H04.1.454.CMB.1.raw
  modified_base (294)..(294): a, c, t, g, unknown or other
  misc_feature (294)..(294): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatcctcctgctaggtctagtcagacgccctacctaaaacactaatggaatactacttctttagaattggtacctgcagaacgccgagggcagtctccacagctntagattatagttgggttacttacgtccgggtacccgtcccgggtccctaggacgtacggttacgtaggtcggctaacggtggactcgtagtcaacgtacgttaattttaaccaacgttaagtaaaacgtccgaaggtacggtaacggggttagggaacggagaaaggtaaaggtagttagggtttacggggttaattttacggttacctgtacgttaagtaccgtaacccgtaaccttaacccgtaaacgttaaaccgttgggttaacggttcggggtaaccggggttaccgggtaacccgggaaacggggtaaacccggtaaagggttaacgtaaaacggtacgtaaacggtaccgtaaaccggtttcgggtacgggtaaccgtcgggtaaaccctaccggttaacgtttccggttaacgttcccggttttaaccttaccccgtttacccggttaccccccgg

SEQ ID NO: 99738 - DNA, 851 bp, Homo sapiens
  misc_feature: GYAE6OF02GY8CZ.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctcgtgggtctcgtggatccgaggtggggatattgtgatgactcagtctccactcctccctcgcccgtcacctccgtgggacgacggcccggcctccacttcctccgtgacgtacggtctagtcacggactaccctaacctaaaactacgttaagtcggtaacttaaccttactttacgtttagtaaacgtttcggtacctgacgtaaggaacgaccggacgggaccgtacgttaccgtacccgaacgtacggtcctttaccgttaggtaaactttaaggttttacgggttttacggggggttttacctttacgggggtcccggggttaccccggtttccccgggggttacccgttaggtaaccggtttacgggttttcggaaacgggttcggggtaacgtaacgggtaacggttaacgttaccggtaacgttaaccgttaacgttaacgtttaaacgtttttaaccgtaaaccgttaaacggtaaaacgttacggtaaacgggttacgggttagggggtaacgggaacggtaacgtaaagggtaaaggtttaggtttaggggttagtttaaagttttacgttacgtcgtaacgttacgtacgtaaccttaaccgttacgttaaacggttaacgttagggtacggtacgggtaccggtaacggaccggtaaacgggtaacgtaaggtaaggtaacgtacgaacgtacgtacgtaggtcgacgtacgac

SEQ ID NO: 99739 - DNA, 545 bp, Homo sapiens
  misc_feature: GYAE6OF02FMKSB.40.81.H04.1.454.CMB.1.raw
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (534)..(534): a, c, t, g, unknown or other
  misc_feature (534)..(534): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagcctgggcctcggtgaaggtctcctgcaagatttcnggaaacncctgagcaactactacatacactggatgcggcacggcccctggacgaggggtttgaggtggagtggggtggatcaaccctaccaggaggtggacaacaaagtagtcgacagtaactttcgagggcgagggtcaccatgacccgtgggacgccgtcatcgagcacagtactacagtcggatcgtggacgcggtactggacctcgtcgaccgacgacggctagtgtagtactggtaggaagtaggtcgttcggtggcgtaccgggccggggtctcggtaccncggtaccgggg

SEQ ID NO: 99740 - DNA, 545 bp, Homo sapiens
  misc_feature: GYAE6OF02FIALU.40.81.H04.1.454.CMB.1.raw
  modified_base (406)..(406): a, c, t, g, unknown or other
  misc_feature (406)..(406): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctctcttggtggcagcagccgcaggagcccactcccaggtgcagctggtgcagtctggggctgaggtgaagaagcctggggcctcggtgaggtctcctgcaagatttctggaaacaccctgagcaactacgtacatacactggatgcggcaggcccctggacaggggtttgagtggatggggtgatcaaccctacgagaggtgcacaaagtatcgacagaactttcagggcagggtcaccatcgaccgtgggacgcgtccatcagtccanacgtactacatggactctggacgcggactgtaccctagtcggaacgacgacgactagtagttagttactggttacggaaggagtaacggttgggtacgtacgtaccggcgggtccacggacctacggtcgggtacccgg

SEQ ID NO: 99741 - DNA, 601 bp, Homo sapiens
  misc_feature: GYAE6OF02GQNZJ.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagcctggggcctcggtgaaggtctcctgcaagatttctaggaaacaccctgacgcaactactacatacactgatgacggcaggcccctggaccgtaggggtttgagtggagtgggggtggatcgaaccctcgaggacggtggacaagaaagtagtacgacgaagaactttacgacggggctagggtccacgatcgacgtgggacgcgtccatcgagcacagttactacatggatctagacgaccggactacgacctcgacggtacgaacgaccggtactacgttacgttattacgtggtaagggtaaacggacggttacgggttcgggacgtaccgggttacccgggtcggggtaccgtacggaaccggtacggtcgggggtaaccccggg

SEQ ID NO: 99742 - DNA, 569 bp, Homo sapiens
  misc_feature: GYAE6OF02HCCBT.40.81.H04.1.454.CMB.1.raw
  modified_base (328)..(328): a, c, t, g, unknown or other
  misc_feature (328)..(328): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaaggaagccgtggggcctcggtgaaggtctcctgcaagtatttctggaaacaccctgagccaactactacatacactggatgcggcacggcccctggacgaggggtttgaggtggagtggggngagtccaaccctacgagaggtggacaacaaagtatacgactagtaactttgagggcagggtcacgatacgaccgtggacgcgtccatcagcacgngtctaacngtacgntcgtaggacgacggctacgacctcgtagaccgacacggtccaagttgttacgtacgtggtacgggaagtaggtacggttggtcggtacgtacccgggcgggtccgtacggtaccgacggtacgggtacccgg

SEQ ID NO: 99743 - DNA, 638 bp, Homo sapiens
  misc_feature: GYAE6OF02G1IP8.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcgggtgaaggtctcctgcaagtatttctggaaacaccctgagcaactactacatacactggatgcggcacggccccgtggacgtaggggtttgagtgggagtggggtggataccgaaccctacgaggaggtcggacaacaaagtactacgacagtaactttacgagggcagggtacaccgatcggaccgtcgggacgcgtaccagtcagaccacgagttctaactagtggactcgtacggacggtacggacttcggtaccgtacgtacggaaccgaaccgaccggtaccgtagttacggttacgtttacgtagggtaacgggtaaggtaacggtaccgggtttacgggtacgggtccggttaacccggggccgggggtaccgtacggtacccggaccgggttaacccggggg

SEQ ID NO: 99744 - DNA, 610 bp, Homo sapiens
  misc_feature: GYAE6OF02J1CMB.40.81.H04.1.454.CMB.1.raw
  modified_base (194)..(194): a, c, t, g, unknown or other
  misc_feature (194)..(194): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
tcagtctagcgactcacgaccggtgctcgatttagtagtgtagattcgcgggggagcatcacccagcaaccacatctgtcctctagagaactcccctgagagctccgttcctcacatggactggacctggaggtatcctcttcgttggtggcagcagccgcgaggacgcccactccgaggtgcagctggtgacngtcgtggggctggaggtacgaagacgccgtgggtcctggtagacgtctctgacgtatacttcgacggaacacctggaacgctaactactacgtaataccgacgtggatcgggccgacgaccggtcccggtaggaacgggttgggttaggtacgggtaggtagggttcgggacgtaccgaacctaaacccgtacgaggtacggtgaaaccgaagtaacgtccgacgacgtaagttacgtacggagggctacggtccacgttagccggacggtcgggacctcgacgtcaggactaaccgtgaccgtattaccggtgtaagggccttgggcggaacgggttcgggacgtaccggaggcgaaccgaacgcgtagcntatacgngngagcgngngtcgcgtgcgcgacgcgacgcgagtcg

SEQ ID NO: 99745 - DNA, 657 bp, Homo sapiens
  misc_feature: GYAE6OF02GODOH.40.81.H04.1.454.CMB.1.raw
  modified_base (244)..(244): a, c, t, g, unknown or other
  misc_feature (244)..(244): n is a, c, g, or t
tcagtctagcgactcacgaccggtgctcgatttagtagtgtagattcgcggggagcatcacccagcaaccacatctgtcctctagagaatcccctgagagctccgttcctcaccatggactggacctggaggatcctcttcttggtgcagcagccgcaggagcccactcccaggtgcagctggtgcagtctggggctgaggtgaagagcctgggcctcggtgaaggtctcctgcaagtatttcnggaaacaccctgacgcaaactacacactacactggatgcggcacggcccctggacgtaggggtttacaggtggagtggggttacgactaccaacccgtacaggacggtagacaacgaaagtatacgaactacgtaacttacgacgggtacgaggtaccacgtagtacggaccgtgggaaccgtccgtaccacgttacgacgtaccaaccgtacgttactaaccgtgttacggacgttacgtaggaccggtacggtaccgtacgtacccgtagtaccggaccgaacgaccggtacccgtagttacgtagttaccgtaggtacggtaacggtacggttaacggttcggtacggtaaccccggtaccgggtccgggttaccgtaacggtaccccgtacggtacccgggtaacccgg

SEQ ID NO: 99746 - DNA, 748 bp, Homo sapiens
  misc_feature: GYAE6OF02ISYE3.40.81.H04.1.454.CMB.1.raw
  modified_base (647)..(647): a, c, t, g, unknown or other
  misc_feature (647)..(647): n is a, c, g, or t
tcagtctagcgactcacgaccggtgctcgatttagtagtgtagattcgcggggtggccctgagagcatcacccagcaaccacatctgtcctctagagaatcccctcgagagctcgttcctcaccatggactggacctggaggagtcctcttcttggtggcagcagccgcaggagcccacctcccaggtacgcacgtccgtggttcgcgaagtcgttcggggcctggaggtgaaaggaagcccgtggggtcccgtcgggtagaaagggttccgtacccgttgacgaaggtacgtttacgttacggaaaccgtaccccgtacggtaacggacaaccttaaccgtaactaacttaaccgtacgtaggtaacgttcggaccggtacgaaccggtcccccgtagggtacccggtagggggttttagtaacgggttacggtacggggttacgggggttaggtacgtaaccggtaacccccgtaaaccggacgggtacggtacggacgaaacgtaaacgttacgtacggtaacgtaacggtaaccgtttacggacgggtaccgtacgggtaccacgtacgttacggaccggtacgggaccggtacgtacgtacgtacgaacgttcacgtacgtcgtaacgagtcggagttacgngtaacgcggtcgtacgctacgtcggaacacgacgcgagtttacgattaccggtgtaacgacgtacggtaaggtcggtagtaccgtcggaggtccgtaacgg

SEQ ID NO: 99747 - DNA, 634 bp, Homo sapiens
  misc_feature: GYAE6OF02H2NRB.40.81.H04.1.454.CMB.1.raw
  modified_base (231)..(231): a, c, t, g, unknown or other
  misc_feature (231)..(231): n is a, c, g, or t
tcagtctagcgactcacgaccggtgctcgatttagtagtgtagattcgcgggggactgatcaggactcctcagttcaccttctcacaatgaggctcccctgctcagctcctggggctgctaatgctctgggtctctggatccagtggggatattgtgatgactcagtctccactcctccctgcccgtcactcctggagacgccgcctcatcctcctgcaggtctagtcagngcctacctaaaacactaatggaattactacttctttgaattagtacctgcaagacgcgaggctagtctcactgccttcttagtaatagttgttggggttcttacgtcgggtcccgttcccgggtcctgacgtggttacaggtgctaggtgactcgagtccatagtaatttaccataagaaatcgagacgaggggtaggacggacgaaggtaagtagttaggtttacgggtaactttaagttacgtacgtacctagttccgtaacctaacccttacgttaaactaacggttaggtacggttacgggtacggtaccggtaacccggaaagggtaacccgggtaagggtaaagtaaccgtaacggaaccgtacggtaaaccgttaggttccgtacgtacgtacccg

SEQ ID NO: 99748 - DNA, 701 bp, Homo sapiens
  misc_feature: GYAE6OF02F00K8.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcattcctccactcctccctgcccgtcactcctggagacgccggcctccatcctcctgcaggtctagtcagacgcctaccaaactactaatggatactacttctttagaagttggtacctgacaagaacgccgaggacagtcctaccacagctcttagattagttagtttgggttacttacggtccggtccgttcccggggtacctgtacgtaggttcaggtggacgagtggactcgacgtcaacgtagttaactttaacactaagtaaaactacgtaagtacggaaggggttacgggaggtacgaaaggtaaagtagttagggttagggtttaaatttttaacgtttaacgtagtactacgtaccgaacgttaacccttaaccttaaacgtaaacggtttggttacggttacgggggaccgggtttacccgggaaccgggtaaacggggtaaacccgggtaaaggggttaaacggtaaaacgtaaccgggaacggtaaccggtaaacggtttaggggaccggttacggtccggtaaacccg

SEQ ID NO: 99749 - DNA, 719 bp, Homo sapiens
  misc_feature: GYAE6OF02JJW7M.40.81.H04.1.454.CMB.1.raw
  modified_base (264)..(264): a, c, t, g, unknown or other
  misc_feature (264)..(264): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtcgcgagtcgtggggctggaggtgaagaggcctggggcctcgggtgaaggtctcctagcaagtctttctggaaaccnccctgagcaactacgtacactacactaggatggcggtcgacggccccgtggacgtacggggtttgacggtgggtacggtggggtggaagttaccgaaacccgtacgaaggtacgggtaggaccgaacgaaaaggtacgtacggaactaacgtaaccgttttacggacggggtaccgtaacggggtcctaacgaacgtaccggtaccgtaggggaccgtaccggtacctagtccgaacggtaccaacgtaggtaccgttaacgtacgtacgggttaactccggtacgagggtaccgggtactacggtacccgttaccggtacgaaccggtaaaccgtaccggacgtaacgttacgttacgtttaccggtgtacggggaacttaacgggtacggttaccgggaggttcccggtacggtaccgggtaccggttacgaccgtaccggtaacccgggggg

SEQ ID NO: 99750 - DNA, 606 bp, Homo sapiens
  misc_feature: GYAE6OF02HC2NR.40.81.H04.1.454.CMB.1.raw
  modified_base (328)..(328): a, c, t, g, unknown or other
  misc_feature (328)..(328): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaagccgtggggcctcggtgaaggtcctcctgcaagatttcgtaggaaaacctacccgtgacgacaactactacatacactgatgcggcacggccctggacgtaggggttnaggtggagtggggtgactaccgaacccgtacgaggaggtcgacaacgaagtatacgacaggtaacttcgagggacacgggtacacgagtacgtaccgtcgggacgtcgtaccgagtccgaacgccgtacgtacgtctaacgagtggactcgtaggacgtcgggactcggtacctcgacggtaaccgaccgacgtactacgtagttaacttacggtaggtaggaacggttacgtacgggttcgggtacggcccggtaaccgggtcgggtactacccggg

SEQ ID NO: 99751 - DNA, 660 bp, Homo sapiens
  misc_feature: GYAE6OF02HSFQ3.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcttggtggcagcagccgcaggacgcccactcccaggtgcagctggtgcgagtcgtgggctgaggtgaagagcgtgggctcggtagacggtctcctgactaagtatttcgagaaaccaccgtgagactaacgtactaacataccacgtggactggcggcacggccctaggaccgttggttgaggtgggagtggggtacgtactaccgaaccgtacgaggtacggtcggaacgaacgtaaagtacgtacgtaacgaagttaacgttacgaggtacgtacggtacaccgtacgtacgtaccgtacggggaccgtaccgtaccgaactacgaacggtacgtaaccgtacgtaaccttaacgtacgtcggtaacgtcgtacggaccggtcggtaaccgtggtaacctacggacgtacgacgtacgacgtactaagtacgtacgacgttagggacgtaggttacggtacggttcggtacgtacggtacgggtccgacgggtaacgaccggacgggttaaccggg

SEQ ID NO: 99752 - DNA, 504 bp, Homo sapiens
  misc_feature: GYAE6OF02F3DOE.40.81.H04.1.454.CMB.1.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (501)..(504): a, c, t, g, unknown or other
  misc_feature (501)..(504): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagacgccgtggggcctcggtgaaggtctcctgcaagtatttcnggaaacaccctgagcaactactacatacatggatgcggcacggcccctgggacgtaggggtttgaggtggagtggggtggataccgaaccgtaccaggacggtgcaagaagtancgacagtaacttcgagggcaggactcacagtcgaccgtgggacgcgtacatcagcacgagtctacagtcgatcgtgaggcgggcgtggacgaacgggcgtaacagtacgntgngnagctgatgancgtanctnagcnnnn

SEQ ID NO: 99753 - DNA, 661 bp, Homo sapiens
  misc_feature: GYAE6OF02I1ZOC.40.81.H04.1.454.CMB.1.raw
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (493)..(493): a, c, t, g, unknown or other
  misc_feature (493)..(493): n is a, c, g, or t
  modified_base (641)..(641): a, c, t, g, unknown or other
  misc_feature (641)..(641): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtgggatattgtgatgactcagtctccactctccctgcccgtcactcctggagcgccggcctccatcgtcctgcaggtctagtcaaggcgtcccttacctaaaacnctaaacgtggatacctactctttgaatttcggacctgcagtaacgcagggcngtactccgaacagtcctcttgaacttgtaacgttggggttctttacgcgggtcccgttacccgggccctgactaccgggttanacgggtcgggtaactggtacggtanctaggtccaaagtacgtatttaaccactaggaaaatcctaagcggtagggtaggaagcgtaaagagtagttagggtggtaacttttagtactaggtctagtntaaccgtaactcctaaagtaacgtgtacgggtagaccgttcgggacccgtaaaagggccgtaaaggtaacggaacttacggaagtacgggaaacctttgggcccgggtataccgggacccaaccttcggttaacctcgttaacccgtnttacccggtaccttccccgg

SEQ ID NO: 99754 - DNA, 833 bp, Homo sapiens
  misc_feature: GYAE6OF02HL0SY.40.81.H04.1.454.CMB.1.raw
  modified_base (812)..(812): a, c, t, g, unknown or other
  misc_feature (812)..(812): n is a, c, g, or t
tcagtctagcgactcacgaccggtgctcgatttagtagtgtagattcgcgggggagagcatcacccagcaaccacatctgtcctctagagaatcccctgagaggctccgttcctcaccatggactggacctggaaggatcctcttcttgggtggcagcgagccgcaggacgcccactcccgagggtcgcagcgtggtcgcgtaggtcgtgggggctggagggtagaaggaacggtccggtcggggccgtcgggtaggtaacggtcctcccgttaggactaaggttactttccggtaacggaaaccctacccgtaggaacgtacctaaaccgtaacctaactacgtaaccgtacgttacgggtaacgttcgggaccggacggtacccgggtaccccggttaggggtaaccgggtttaggggttttacgggacgggttgggtacgggttagggggtaccgtaacctacccgtaaacccggtacggtaagggcgggttaccgaacctaaacggtaacgttaaccgtacggaaacgtaacggttaaacgtttaccgggacgggtaccggttaacggggtaacccaaccggttaacggtaccgggttaacccgggttacggggtaacccgttcccgggtaactaaccggtaccggaaccggttaccgtaacgttacccggtttaactaacgggttacggtacggttccggtaacgtacggggaccgggacggttaaccgttaccggaccgtacgggtaccgaacgccgtacgagtaccgtagtctacggtgaagtcgagtcgtcggtacgcgtcggngtacgtcggacgttggccggg

SEQ ID NO: 99755 - DNA, 1014 bp, Homo sapiens
  misc_feature: GYAE6OF02IBXO4.40.81.H04.1.454.CMB.1.raw
tcagtctagcgactcacgaccggtgctcgatttagtagtgtagattcgcgggggagagcatcacccagcaaccacatctgtcctctagagaatcccctgagagcctccgttcctcaccatggactggacctggaggatccttcttcgttgggtggcagcagccgcaggacgcccactcccaggtggcagctggtgcgacggtctgggggactggtagggtagaaggaaggtccggtacgggggcccgttcgggtagaaacgggttccgttcccgtgaccgtaaagtacgttttaccgaacgggtaaaacctaaccccgtggaacggtaccaaaccttaaccttaaacaacttaaccgtaacgttagggaattcgggaccgggtaccggaaccgggtcccccgtaaggggtaaccgggttacgggggtttttagggaagggttggggaagggttagggggtagggtaacgtacccgtaaaacccccgttaaccgtaaaggggacgggttacgggaaacccaaaacggtaaaacgttaacggttaaccgaaacggtaaccggtttaaaacgttttaccgggaacgggggtaaccggtacggggttaaccctaaaccggtaacggttacccgggttaaccgggttacccgggggtaaaccgggttccccgttacccggtaaactaccggtaaaccggaccgtaaccggtaaacggttacccttaaaccggtaacggttacggggtaactttccgggtaaacgggtacgggtaaccccggggtaaacggtttacccggtaaacccccggttacggttaacccgggaaccggtaaacccccgggtaaaccggtaaccccgtaaaggtttacgggttaacccgtttaagggtaacgggttaacggggtaaacggtaccggttaacccggggtttcggttaccgggggtacccggttaccggggttacccgggggaacgttttaacccggacccgggttaaccgggggttaaccccggggg

SEQ ID NO: 99756 - DNA, 675 bp, Homo sapiens
  misc_feature: GYAE6OF02FTPIH.40.81.H04.1.454.CMB.1.raw
  modified_base (648)..(648): a, c, t, g, unknown or other
  misc_feature (648)..(648): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagtctccactctccctgcccgtcactccgtggagacgcccggcctccatcctcctgcaggtctagtcagacgtccctacctaaacactaagtggacttaactacttctttagtaagtttcggtacctgacaaggaacgacccgaggggcctacgttcctacccgaacgacgtccttcttagtacttaagttaggttttcgggggtttacctttaaggtcccccccggggtaccggttaccccggggtaccctacggtacgtacgggtttacgaggttcggacgtaggtggtactcgagtacgaatacgttaactttaaccactaagtaaactcgaacggtacggacggggtaggacggacgaaggtaagaggtttcgggttaaggttacttttagtacgttacacgtagtacgtactaacccgtacgtaaacaacgttggtagttacgggaccggtaccggaacgaacgggacgtaaggaacgtaanacgaaggtcgagtgtacgcgtagaccg

SEQ ID NO: 99757 - DNA, 755 bp, Homo sapiens
  misc_feature: GYAE6OF02F3LH7.40.81.H04.1.454.CMB.1.raw
  modified_base (590)..(590): a, c, t, g, unknown or other
  misc_feature (590)..(590): n is a, c, g, or t
tcagtctagcgactcacgaccggtgctcgatttagtagtgtagattcgcgggggagagcatcacccagcaaccacatctgtacctctagagaatcccctgagagctccgttcctcaccatggactggacctggaggatcctcttctggtgcagcagccgcaggacgccctactcccgaggtgcagcgttggtgcgagtcgtagggctggaggtgaagacgcgtgggccgtcggtgaaggtcctccgtcggactaagtactttcgtacggtaaaccctcccgtaggaacgaccgtaacctacctaaccgtactaaccaccgttacgggacgttacggaccgggaccgtaaccggtccccccggttaggggtaaacggttacgggggttttacgggaaggtttacggggacggtttcggggggttacggtacgttaacccggtaaaccgtaccggtaaggaacggggttaccggactaaaccgtaaagttacggtaaccgtaacgtaaacgttaacgttaccggaacgggtacggaccgggttaccgaacgtacgtacggaaccgtcgggtaccgcgttacccgagtaccgngaccgtaacaccgtactaagtcgttacgcgtacggacggttcggacggtaccgtcgacgttaacgccgtacgaactccggctacgtgtaccgttgtacggttcgaaggttacgtcgttcggtacggacgtccgggttaccgcggtacgtaccggcggtaccgggg

SEQ ID NO: 99758 - DNA, 693 bp, Homo sapiens
  misc_feature: GYAE6OF02IY0CI.40.81.H04.1.454.CMB.1.raw
  modified_base (632)..(632): a, c, t, g, unknown or other
  misc_feature (632)..(632): n is a, c, g, or t
  modified_base (686)..(686): a, c, t, g, unknown or other
  misc_feature (686)..(686): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccaggtcgcagctggtgcagtcgtggggctggaggtgaagacgccgtggggcctcggtgaacggtctccgtgacaagtatttcgtacggaaaccacccgtggataccaacttactaacactacacgtaggatcggccggtcgacggtccccgtaggaccggtggggtttagaggtgggtaaggtgggggtacgtaaccgtaccgtaaacccgtacgtaacgggagggtacggaaccgtaaacggtaaacgtaacgtacgaaaccggttaacggtaaaccgtttacggaacggggtaccgtaacggggtaccaaacccggtgttccggtaaccggtacggggaccgtccggttaaccgacgttcgaacggtaccgaacgtacgttactacgtcgttaacggtctacgtacggacggttaccggacgttaccgcgttacgacgaccgtaacgccgacgttanagtacgtactggacgcggtaatcggtagcgtagccggtgacgtcgacggtacgnggtacgg

SEQ ID NO: 99759 - DNA, 540 bp, Homo sapiens
  misc_feature: GYAE6OF02HNJ1P.40.81.H04.1.454.CMB.1.raw
  modified_base (313)..(313): a, c, t, g, unknown or other
  misc_feature (313)..(313): n is a, c, g, or t
  modified_base (413)..(413): a, c, t, g, unknown or other
  misc_feature (413)..(413): n is a, c, g, or t
  modified_base (531)..(531): a, c, t, g, unknown or other
  misc_feature (531)..(531): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagattcgtggaaacacctgagcaactactacatacactggatgcgcaggcccctggacagggttnagtggagtggggtgataccaacctaccgagaggtgacaacgaaagtatacgaacagtaaactttcgagggacgtagggtaccacagtcggactagggacnccggtcatcagcacagtacacgatggactcgtagacgcgggaactcggacctaggtacgacgacgtaggcctagtcgtaatacgtgtaaggagacgtacgttcggcgtacgtaccggnggactacgg

SEQ ID NO: 99760 - DNA, 592 bp, Homo sapiens
  misc_feature: GYAE6OF02FSTHK.40.81.H04.1.454.CMB.1.raw
  modified_base (399)..(399): a, c, t, g, unknown or other
  misc_feature (399)..(399): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctcatctcctgcaggtctagtcagacgcctacctaaaacaactaatggatactactctttagaatttggtacctgcagaagccgagggcagtctccacacgctcttagatattagtttgggttcttagtccggtccgtccggggtccctgacgtggttcaggtggctaggtgtactcgagtaccaactaagtacttttaanacgttagaaaattcgacgtcgtaggggtaggacggtacgaaggaagttgtagggtttggtaatttagttactaggctatcgactaacctacgtaacgtaactgtacggtagggtaccgggtcggacgtaacgggacgtaacggtaggtaaacgtacgacggtacgtacgtggtacggtctggacctacgtacg

SEQ ID NO: 99761 - DNA, 670 bp, Homo sapiens
  misc_feature: GYAE6OF02J194E.40.81.H04.1.454.CMB.1.raw
  modified_base (304)..(304): a, c, t, g, unknown or other
  misc_feature (304)..(304): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttctggtgcagcagccgcaggacgcccactcccgaggtgcagctgggtcgcgacgtcgtggggctggaggtgaaagaacggtccgtggggcccgtgggagtaacggtcctaccgtggactaaggtntttaccgtagggaaacccacccgtagacgtacaactactacactacacgtggatcggcggactaccggcccgtagggtacgtaggggttgaggtgggaggtggggtcgtactaccaacccggtacaagggtcggcggtacaacgtaaacgtacgtaacgaacggtaacgtaacgttacggacgggtacgacgggttaccgaccgtagtcgtaccggtagggtaccgtaccgtacgctacgacgacgaacgtacgtacctacgtacggtagtaccgtgtacggacggtacggtaaccggttccgtaacggtccgtaacgtaaccgaccggtaccgtaccgtacgttaggttaccgtaggttaacggg

SEQ ID NO: 99762 - DNA, 554 bp, Homo sapiens
  misc_feature: GYAE6OF02GFRZP.40.81.H04.1.454.CMB.1.raw
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
  modified_base (393)..(393): a, c, t, g, unknown or other
  misc_feature (393)..(393): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatcctcctgcaggtctagtcagacgcctacctaaacactaatggatactactctttgattggtacctgcagaagccagggcagtctccacagctctgatntagttggggttctatcgggcctccgggtcctgacnggttcagtgcagtgatcagtcacagtattttacactagtaaaatcagcgagggtaggaggacagaagnttggttgggtatttagtactgcatggactacctactaacgtaactggtagtcggacggtcggacgaacgggaccgaaagggtaggaaacgtcgaacggcgtaacgttggtaggtctcgaccaaccgtgttaccgttgttcctactacgttccctaccccgg

SEQ ID NO: 99763 - DNA, 637 bp, Homo sapiens
  misc_feature: GYAE6OF02JGUA2.40.81.H04.1.454.CMB.1.raw
  modified_base (301)..(301): a, c, t, g, unknown or other
  misc_feature (301)..(301): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccagtggactggacctggaggatcctcttcgttggtggcagcagccgcaggagcccactcccaggtgcagctggtgcagtcgtgggctgaggtgaagaagccgtgggcctcggtgaacggtcctccgtgctaagatttcgaggaaaccnccctgacgacaacctactacatacactggactgccgtcgacgcccgtggacgtgggttgagtggagtggggcgtatcccgaacctaccgagggtacgggtcgggacctaacgtaaacggtgtaccgaacgtaacgttaactttaccgggagggtacgtacggtaccgacctaacgtcggtaaccgtcggggaccgtccggtacctacgtaccgacgtaccgaccgtacgttccgtaacctggtaacgttacacggttgaaccgggtccggtaacgttaccggtacttaccggagaacccggcgaccgggtacctaggtacttaacgttcgtacggg

SEQ ID NO: 99764 - DNA, 686 bp, Homo sapiens
  misc_feature: GYAE6OF02HL37G.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtgggatattgtgatgactcagtctccacttcctccctgcccgtcactccgtggagacgcccggcctccattcctctgacgtaggtctagtcagcgtccctacctaaactactaaagtggtaactaactacttctttagtagttacggtacctgacgtaagaacgccgacgggactacgtcctaccactacgctttacttagtaattattaggtttggggttacttacggtccgggtcccttcccggggtcctcggacgtggttacgtaggtggtactaggtcgtatcgtagtccaagtacgttaacttttaacgaacgttaagtaaaacgtcgtaggtcgggtaggggtaggacggtaacgaaggtaaggtacgttaggttagggttatttacgttacgtgtactagtcgtacctaaccttactaaaccgtaacgtgttaacgggtcgggtaccgggtaccggtaacgggaaacggaacccggtaaggtaacggtaaacgtaacggtaccggacggtaacgttcgggacgttcgacgtaaccg

SEQ ID NO: 99765 - DNA, 625 bp, Homo sapiens
  misc_feature: GYAE6OF02FR7F5.40.81.H04.1.454.CMB.1.raw
  modified_base (365)..(365): a, c, t, g, unknown or other
  misc_feature (365)..(365): n is a, c, g, or t
tcagtctagcgactcacgaccggtgctcgatttagtagtgtagattcgcgggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctacctaaacactaatggatacttactctttagaattggtacctgcagaagccgagggcagtcctccacagctctgatatagttggggtttctacgtccgggcccggtccggtcgacgtagtcggtagtgtcgngtagtagtacgtacgtagtacgatagtttaacttacgtaacgtaaacgtaactacgaggtacggtaaggggtaggacgaacggtaaagaagttaggttagggtagtttaaattttacgttacggtacgtactacgtacgtaacctacgttaactaacgttaacgtggtagggtaccgggtacgggtaccggaacggaaccggtaagggtaacggtaaacgtaagacggaacgtagtacggtggacgtcggtactaacccg

SEQ ID NO: 99766 - DNA, 653 bp, Homo sapiens
  misc_feature: GYAE6OF02GKBY9.40.81.H04.1.454.CMB.1.raw
  modified_base (243)..(243): a, c, t, g, unknown or other
  misc_feature (243)..(243): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtgggctgaggtgaagaagccgtgggcctcggagaaggtctcctgcaagtnttacagaaaccaccctgagcaactacacatacactggatgcggcgacggccccaggacgtgggtttgtacgtggagtcggggtagactaccgaaccctaccgaggacggtaggacgaacgtaaagttactaccgaacgtaacgtaacgtttacgaacggggtaccaggggtacctaacccgtagtacgtacccggtcgggacgtccggtacccgtagtccaaggtacccaaccgtacgtacgtaacgtagtcggtacttacgaggaccggtacggtaccgtacgtaccgtacgtcggtaaccgacgtaccggtactagttacgtacgttacgagtacggaggtaccgttagggtaccgtcggtaccgtaccggtcggtaccggtcgtaaccgtccggtacggtaacccgg

SEQ ID NO: 99767 - DNA, 805 bp, Homo sapiens
  misc_feature: GYAE6OF02G0UU9.40.81.H04.1.454.CMB.1.raw
  modified_base (648)..(648): a, c, t, g, unknown or other
  misc_feature (648)..(648): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccaggtggggattattggtgatgactcagtctccactcctccctcgcccgtcacctcctggacgacgcccggtccctccgacttcctccgtgaccaggttctagtcgagctccctacctaaacacgtaatggatactacttcttagtaacttcggtactgacaagacgacccggaggcctacgtccaccgtacacgtcctttcgttgtaacgtttagtttagggttttcgggttactttaacgggtcccgggttccccggttcccgggtttaccctaggtacccgttaggtttaccggaaggtcggtaccgtaggttacggtataccggaacggtacctaaccgttaaggttttaaccgtttttaaaccgaaccgttaaaaggtaaaaaccggtttccgaacggggttaaccgggtagggggttaaccgggtaagggtaaaccgttaagggaaacgggtttcgttttaaggggttacggttaaagttttaacgtaacggttcggaaccgttntaaccgtacccgttaaacctaccgttaaacgtaagtcgggtttaggaccgggttaaccggtccggaaccgggttaaccgggaaacgggtaccgggtaaaggaaaccgtaacggaacgggaccgttaggtccgggttacgcggtaccgacgttaaccg

SEQ ID NO: 99768 - DNA, 572 bp, Homo sapiens
  misc_feature: GYAE6OF02HK1AJ.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagtatttctggaaacaccctgagcaactactacatacactggatgcggcacggcccctggacgtaggggtttgaggtggagtgggggtggatccgaaccctacgagaggtcgacaacgaaagtactacgaacgtagtaactttcgagggtacgagggtacacgtatcggaccgtgggacgtccgtaccatcgagcacgagtctacgtagtggaatcgtagacggcggtacgtcgacctacgtacgacgacgacggcagtcgtatacgtagtacggaagtacggtacggttggacgtcgtacggcgggactacggaccgtacggtgggaccgg

SEQ ID NO: 99769 - DNA, 710 bp, Homo sapiens
  misc_feature: GYAE6OF02FKA3B.40.81.H04.1.454.CMB.1.raw
  modified_base (234)..(234): a, c, t, g, unknown or other
  misc_feature (234)..(234): n is a, c, g, or t
  modified_base (397)..(397): a, c, t, g, unknown or other
  misc_feature (397)..(397): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagagcctggggcctgggngaaggtctccgtgcaagtatttacgtacgggaaacaccctgacgacaactactacactacacgtggatggcggcgacggtcccgtaggtacggtaggggtttagaggtgggtaggtgggggtaggtacgtaccgaacccgtacgaaggaggtaccccccgganaacgtaaagtacgtaccgtaacgtaacgtaacgtttacggacgggtacgtacgggtccaaccgtacgtacggtaacccggtacggggtaacccgtccgtacccgacgtacccgtaacggacccgtaccgtaacggttcccttaacgaacggttgggtaacgtccgtaggaccgggtaccggggtacgttaccgggaccgttaacgggtccggaaccgtacgaacggtcctaggttacgtaaggttacgtaggtaacggtaacggtaggtacggttacggtccgggtacgtaccgggtacgggtcgttaccggg

SEQ ID NO: 99770 - DNA, 704 bp, Homo sapiens
  misc_feature: GYAE6OF02F40YA.40.81.H04.1.454.CMB.1.raw
tcagtctagcgactcacgaccggtgctcgatttagtagtgtagattcgcggggatcaggactcctcagttcaccttctcacaatgaggctccctgctcagctccgtggggctgctaatgctctgggtctctggatccaggtggggatattgtgatgactcagtctccactctccctgcccgtcacctcctggacgacgcccggcctccatcctcctgcgaggtctagtcagacgcctacctaaacacgtaagtgaataccgtacttacgtttagaagtttcggtacctgacgtaaggaacgccgagggctacggtcctaccacgacgtccttcttagaacttagtttaggtttcggggtttacttaccggtccggggtacccgtttcccgggggtaccctaggacgttagggttccgagggttcggacgtaggtcggtataccgtacgtcaacgttaagttacttttaacgaacgtaacgtaaatacgtacggtacggtaaggggtaggacggacgtaaggtaacggtagttagggtttacggttaatttacgttacgtagtacgtagtacgtaaccgtaacctacttaaccgtaacgttggtacggtcgggtaaccggtccggacgtaacgggtaccggtaaaggtacggtaaacgtacgaaggtaccggtacgtcggtacgtacgtacgtacctacgtaccg

SEQ ID NO: 99771 - DNA, 656 bp, Homo sapiens
  misc_feature: GYAE6OF02FIAGE.40.81.H04.1.454.CMB.1.raw
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (631)..(631): a, c, t, g, unknown or other
  misc_feature (631)..(631): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctaggaggatcctcttcttggtggcagcagccgcaggacgcccactccccaggtgccagctggtagcaggtctggggtctggaggttgaagagccgtggggccttgggtgaacggtcctccgtgcaagtatttccnggaaaccncccttggacgctaactactacactacgactgagtgcggtcacggtcccctaggaccgtaggggtttcaggtcggtagttggggtaggacttccgtaaaccctcgtacggtacggtcgacgaacgtaaagtagaccgaacgaagttaacctttacggagggacctagggtccaacgtagtcggaacccgttgggaccgtaccggtcctagtcgacgcacgtacggttcacgtagtcgacttccgagacgtcggacgtcgaccgttacgtacgaacgtccgacgtacacgttaacgttagtacggttggtaacggacgttacgggtaccgtttcggacgtaccgtaccgggtacccgggtntaccggaacccggtggtacccgggg

SEQ ID NO: 99772 - DNA, 624 bp, Homo sapiens
  misc_feature: GYAE6OF02FE6TQ.40.81.H04.1.454.CMB.1.raw
  modified_base (274)..(274): a, c, t, g, unknown or other
  misc_feature (274)..(274): n is a, c, g, or t
  modified_base (366)..(366): a, c, t, g, unknown or other
  misc_feature (366)..(366): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtgggatattgtgatgactcagtctccactctccctgccccgtcactcctggaagacgtcccggaccttccgatcctcctgcaggtctagtccagacgcctacctaaacactaagtggacttactacttctttagaattcggtacctgnagacgccgaaggcctagtccaccacagcttacttgatagttagtttcgggttcttagtccgggtccttcccggggtcctggactacgggttnaggtgctaggtcgatccgagtcacgtagtactttacgacttaagaaactcgagtcggtagggtcggagtcaaaggtacgtattggttaggtatttaagtcgttgacgtatgtaccctaacttactaacctaaacgtgtacggtacgggtaccggtcggtaaccggaacggaccgtaaagggtagtaaacgtcgagaccgtagtcggacgtcgtacgacctaccgtacttcgtaccgttctacgtacttcccgtacccg

SEQ ID NO: 99773 - DNA, 685 bp, Homo sapiens
  misc_feature: GYAE6OF02JSI0O.40.81.H04.1.454.CMB.1.raw
  modified_base (214)..(214): a, c, t, g, unknown or other
  misc_feature (214)..(214): n is a, c, g, or t
  modified_base (267)..(267): a, c, t, g, unknown or other
  misc_feature (267)..(267): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtgggctagaggngaagacgccgtgggcctcggtgaacggtctcgtgacaagtattcgtagaaccncctgacgacaacgtactacatacacgtggatggcgcgcggccctggacgtacggggttgagtggacgtggggtgactaccgtaacccgacggaggtacggtacggactaaacgtaaagtacgtacgaacgtaacgtactttacgggaagggccgtacgggtacctaaccgtagtaccgggaccggtagggtaccgtaccggtaccgtaccgttacgaaccggactacgtacgtaccttaacgtagtacgggtacttacggtacggtacggtaccggtacgtaccggtaccgttagaccggtaacgaacggtaccgttacgaacgttacggtacgttaacgtgggttaaacgggtagtaaccgggttcgtttacggggaccggttacccgggaacgggttcccgggtacggttacccgg

SEQ ID NO: 99774 - DNA, 711 bp, Homo sapiens
  misc_feature: GYAE6OF02GWDPU.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctgggctgctaatgctctgggtctctggatccagtgggatattgtgatgactcagtctccactcctccctcgccccgttcacctcctgggagacggcccggcctccactctcctgacaggtcctagtcagacgccctactaaaacactaagtgaactactacttcgtttagaacgttggtacctgacagaacgtcccgagggcacgttacctacccaactgccttacgtttagaagttatttaacggtttcggggttactttacggtccggggtcccggttacccggggtcccctggtaacctaggtttcgaagggttcggcgtaagggtgtaactcacggtacaacgtagttaactttaactacgttaagtaaactcgtaaggtacggtacggggtagtaacgggtagaaacgggtaaagtaggtttacgggtttaagggttaacttttaacgtttacgttacggtactacgttacgacccttaaccgtaacttaaacgtaaaccgtggttacgggtacggttaccgggtaccggaccggaacgggaacgtaacggtaaggaaacgttacgaacgtacgtacgttggacggcgtagaccgtaacg

SEQ ID NO: 99775 - DNA, 776 bp, Homo sapiens
  misc_feature: GYAE6OF02JT18N.40.81.H04.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctcgtgggtctctggatccaggtggggatnttgtgatgactcagtcctccacttcctccctcgtcccgtacaccttccgnggaacggcggccggtccctcctacttcctcctgctacggtctacgtcaggtacgacctacctaaaactacttaagtcggtaactacgttactttacgttttagtaacgtttcggttacctggaaccaagtaaccggccgtaacgggctaacgttccctaccaacgagtctttactcggttaattaagtttacggttttggggtttaccttaacggtccgggttccccggttcggggttaccccgtaggtacgtacgggttttaccagggttacggcgtaggtggtaactccgtagtacgtacgtagttaactttaccgtaaattaagtaaacttacgtacgtcggtacgggggttagaccgggtagtaagggtaaacgtagggtttacggtttaacggttaattttacggtttaagttccgaagtcgttaacgttaacccgaaacctttaacgtaaacggtaaaccgttggttagggtaacggggtaccggttacgggtaacggtaaacgggaacgttaaacgggaagtaaacgtgtaaacggtagtaccggtacggtcggttacgacgtaacg

SEQ ID NO: 99776 - DNA, 803 bp, Homo sapiens
  misc_feature: GYAE6OF02IX86X.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtcgcagctggtgcgagtcgtcgggctggaggtagaagacgtccgtggggcctcgggtagaacggtctccgtgacgtaagtacgtttcgtaacggaaaccgtaccgtagaacgtacctaacctaacgtaacgtaacgttaaacgtacggtacggtacggaccggaccggtaccggtacccggttacgggacgggttacgggggttaggtaggtagggtagggtaggggtacgtaccgttaccgtaacccggtacgaacgggtaacggtacggaaccgtaaacgtaaacggttaccgtacggtaacgtaacgttaaccgttacgggaaccgggtacggtaacggtaccgtaaccgtacgtaccgggaccggtacggggtacccgtacggtaccgtaactacgacgaccgtaacgtaccgttacgtaacgtacggtacggtacttccggtaacggacggtaccggtacgttaccgaccgttacgtaccggtaacccggaccgtaccggtaccgtagtttacgtagttacggttacggacggtaggtacggttaccgggtacgggaccggttaccggtccggtacgggtacgtacccggtacggtaccggggtacgggacccggtaacggg

SEQ ID NO: 99777 - DNA, 656 bp, Homo sapiens
  misc_feature: GYAE6OF02FWPDJ.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtgggatattgtgatgactcagtctccactctccctgcccgtcactcctggagagcccggcctccatctcctgcaggtctagtcagacgcctacctaaacactaatgatactactctttagattggtacctgcagagccgagggcagtcctccacgagtctctgattatgtttggggtttcttacgtccgggtccgttccgggtccctagacgtaggttcaggtgcgtagtgatcgagtacacgagttaactttacgataagtaaactcgaaggcgtaaggggtgaggcaaggtaagtgttaggtttcggttaattttacgttacgtgtacgtactacggtaacctaaccgttaccgttaaaccgttaaacgtttcgggttaacgggttacggggtaccccgggttaacccgggaaccgggtaaaccgggtaaccgtaaaacggggttaaattaaaaaccggttaccggaaacggtaaccggttaaaccggtcggtaacggtaccgtacgtaaccc

SEQ ID NO: 99778 - DNA, 818 bp, Homo sapiens
  misc_feature: GYAE6OF02IQHUN.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcgaggacgccccactcccgaggtcgcagctggtgcagtcgtggggctgaggtgaagaaggccgtgggtaccgtcgggtaggaacggttcctccgttggaccgtaaggtactttcgtaggaaaacctaccccgtgaacgtaccaaacctaacctacaactaacaccgtaggactacggaccggcgaccggccccgtaggtaccggttaacggggggtttagaacgggttgggtaacgggttgggggtacggtaaccgttacccgaaaaccccggttaaccgaagggtaacgggttccgggaaccgaaaacgtaaaacggttaccggtaacggtaaacgtaaaccggttaaacctttacggggaacggggtacgggaaaccgggtttacccaaccgggtaacgttacccgggtaaccgggtttaccgggaaacccgggttcccgtaccgtaacccggtacgtaaccgtaacccggaaccgtaaccggttcgtaaaccgtaacggttacgggtaaaccgttccggaacggttacgggaccgggtacggtacgtaaccgtaaccggggtcgtaaacccgggactaaccggactacgtagtacgtggtaccgaggtacgacgtagtcggtcgtccgtacggtcggatcggacgtcggtaaggg

SEQ ID NO: 99779 - DNA, 693 bp, Homo sapiens
  misc_feature: GYAE6OF02I5KGP.40.81.H04.1.454.CMB.1.raw
tcagtctagcgactcacgaccggtgctcgatttagtagtgtagattcgcggggtgatcaggactcctcagttcaccttctcacaatgaggctccctgctcagctcctggggctgctaatgctctgggtctctggatccaggtgggattattgtgatcgactcagtcctccactcctccctgtcccgtcactcctggagacgcccggcctccatcctcctgctaggtctagtcagacgcctacctaaacacttaactggactactacttctttagtaattcggtacctcgacgaagacgccggaagggtcacgttccaccacgagtcttacttagtattacgttaggtttcggggtttcttaacggtccgggtccccggttcccggggttcccttacggtacgttacggttacgtaggttacggtcgaggttaggaacgttaccgactaccgaaacgttagttaacttttaacgaacgttaacgtaaaacgtacgacgtacggtaaggggtacgggtaacggacgtaggtaaacgtaggtttcggtttaagggttattttaacgttaccgtagtaactaagtcgtaacctacgtacgttaaactaacgtggtacggtacggtccggtacggaaccggtaaggaaccggtaaggtacgtaacgagaacgacgtacgtagtggtactcggactacc

SEQ ID NO: 99780 - DNA, 837 bp, Homo sapiens
  misc_feature: GYAE6OF02H5SJ9.40.81.H04.1.454.CMB.1.raw
  modified_base (490)..(490): a, c, t, g, unknown or other
  misc_feature (490)..(490): n is a, c, g, or t
tcagtctagcgactcacgaccggtgctcgatttagtagtgtagattcgcgggcgtagactttgtgtttctcgtagtctccctgctcagctccgtggggctgctaatgctctgggtctctggactccaggtggggatattgtgatgactcagtcctcactcctcccgtcgcccgtcactccgtggagacgccgcctcactctcctgcgaggtctagtcagcgtacctactaaacactaagtcgattactacttacgttagtaagttcggtacctgacaaggacgcgtaggctagtcctaccaacgtacgtcttccgttaagtaacttaagtttacggtttacgggttttcctttaaccggttcccgggtaccccgggtttccccggggttaccgtacggtaaccggttagggttacgacgggtcggtacgtagggttcgacgttcgacgtacgtaacgtaagtttaactttaacgaacttaaaggtaaacnccggaaggtacgggtaaggggtcggacggacgtaaaggaacgttaggttacgggtttaaggtttaacgttacgtttacggtacgtacgtaacgtaaccgtaacccgtaaaccgtttaaccgtaaacgttaacggtttcgggtaacgggttaccgggggtaacccgggtaaccgggtaaacccgggaaacggggtaaaccgtaaaggggtaaaccgtaaacgtaaccgggtaacgtaccgggttaaacggtgggttaaccgggtacctacggttaaccctaccggtttcgtttaccggttaaccggttttacccgtaaccttaccccggtttaccccgttaaccccgg

SEQ ID NO: 99781 - DNA, 658 bp, Homo sapiens
  misc_feature: GYAE6OF02GM6KA.40.81.H04.1.454.CMB.1.raw
  modified_base (132)..(132): a, c, t, g, unknown or other
  misc_feature (132)..(132): n is a, c, g, or t
  modified_base (136)..(136): a, c, t, g, unknown or other
  misc_feature (136)..(136): n is a, c, g, or t
  modified_base (185)..(185): a, c, t, g, unknown or other
  misc_feature (185)..(185): n is a, c, g, or t
  modified_base (244)..(244): a, c, t, g, unknown or other
  misc_feature (244)..(244): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctntggntccaggtgggatattgtgatgactcagtcctcactcctccctgcccgtnactcctggagacgccgcctcatctcctgctacggtctagtcgagacgcctacctaaacncgtaagtgtactactacttctttagaacgtttgtacccgtagaccgtaagaaacgtccgaaggggtacctagttccgtaccacgagtccttacgttaacgtattaacgttaggttcggggtttacttaacgtccgggtacccgtcccggggtcctacgtacgtacggttcacggtcgactaggtcggtactaccgtagtaccgactacgttaactttacgaaacgttagtaaaactgaacggtcgtaggggttagaggtacgtaaagaagttagttcgggttaagtatttacttacgagtacgtagtacgaacctaccgttactaaacgaagtcgttagacggtacgtacggtacggtaacggacgtaaggtaacgaaccgtagaacggtccgtaaggtcgcggtacaggtacc

SEQ ID NO: 99782 - DNA, 694 bp, Homo sapiens
  misc_feature: GYAE6OF02H6ORU.40.81.H04.1.454.CMB.1.raw
  modified_base (439)..(439): a, c, t, g, unknown or other
  misc_feature (439)..(439): n is a, c, g, or t
tcagtctagcgactcacgaccggtgctcgatttagtagtgtagattcgcggggactgatcaggactcctcagttcaccttctcacaatgagctcctgctcagctcctggggctgctaatcgctcgtgggtctcgtggatccgaggtgggatatgtgatgactcagtctccactctcctcgcccgtcactccgtggagacgccggcctcactcctcctgctaggtctagtcagcgcctacctaaacacttaagtgtattacttacttctttagaattcggtaacctgacaagaacgcccgtagggacctacgtccacccgagacgtccgtttacttaggaacttagttttacgggtttcgggtttaccttacggtccggggtcccgttacccggggttcctggaacgtggtttacaggttcggcgtaaggtggtactcgngtacactagttactttacagtaaataaactacgtagtcggtcggggtaggaacggtagaaggtaacgttagttagggttaggttaactttattacgtgtacctaggacctaaccgtaaccttagtaaacgtaacggttcggtacgggtacggtaccgggttaacggaccgggtaaacgggtaacggtagggtaaacgtaaaccgtacgtaaacggtaccggtaacggttcgggtaacggttccgaacgtacccgg

SEQ ID NO: 99783 - DNA, 628 bp, Homo sapiens
  misc_feature: GYAE6OF02GR06G.40.81.H04.1.454.CMB.1.raw
  modified_base (411)..(411): a, c, t, g, unknown or other
  misc_feature (411)..(411): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactcctccctgcccgtcacctcctggagacgcccggcctccatcctcctgcaggtctagtcagacgcctacctaaacactaatggaatactactctttgaattggtaccctgcagaacgccgagggcagtctccacacgctcttgatattagtttgggttcttagtccgggtcccgttccgggtccctagacgtacggttcgaggtcggacaggtggactcgagtcatagttactttacataanaaatcagcgagggtaggacggcgaaggaagtagttaggttaggttaatttagttacgtgtcgtatcgacctaaccttactaacgtaacgttggtacggtacgggtacgggtaccgggtaccggaaacggggtaccggtaaagggtacgggtaaaacgtaccggtaaacggtaccggtaaccggttagggtaccggtacgtacggtaccttaacccgg

SEQ ID NO: 99784 - DNA, 709 bp, Homo sapiens
  misc_feature: GYAE6OF02GW90A.40.81.H04.1.454.CMB.1.raw
  modified_base (217)..(217): a, c, t, g, unknown or other
  misc_feature (217)..(217): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccaggtgggatattgtgatgactcagtctccactcctccctgcccgtcactccgtggagacggcccgtcctccatcctccngcaggtctagtcagacgcctacctaaacactaatgactactacttcttagattcggtacctgacaagacggccgagggcacgtccaccacagtcctagttgattattaggtttcgggtttacttacggtccgggtcccgttcccgggttccctagacgtacggttacaggtcggacgtaggtaggactacgaggtcacgttaagttacttttaacgacttaagtaaacgtacgtaggacgtaggggtaggagacgtaaggtaacgtaggttacggtttagggttaacgttttaagttacgttacgtacgttacttaccgtaaaccttaaccttaaccgttaaacgttaaacgttcgggttaacgggtaccgggttaaccggggtaccggtaaccggtaaaccgggtaaccggttaaacgggtaaaggtaaaccgtaaccgtaaaggtaccgttaaacgggtcggttaacggtacgttacggaccctaaccgg

SEQ ID NO: 99785 - DNA, 690 bp, Homo sapiens
  misc_feature: GYAE6OF02FP88Q.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctagggtgaacggtctccgtgcaagtatttcgtaggaaaccacctagacgacaactactacatacacgtggatggcggcgacggccccgtaggacgtaggggtttgaggtggtaggtggggtaggactaccgaaacccgtacgaggtagggtacggactaacgaaagtacgtacggactaacgtaaccgtttacggaggggtacgaacggggttaccaaccgtaacgtacggtacccggtagggggaacccgtcggttacccgaacgtcgaacggccaacgtacgtacgtaccgaaggttcggtaactcggtacggacggaccggtacgtccggtaccttcggaccgaaccggtacgtacccggcgtaacgtacgtttaagtaccgttagggtaacggtaaggtacgggttacggtttcgggacgtacccggtaccgggtccgggtaacgtacccgggg

SEQ ID NO: 99786 - DNA, 567 bp, Homo sapiens
  misc_feature: GYAE6OF02G2BWE.40.81.H04.1.454.CMB.1.raw
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (360)..(360): a, c, t, g, unknown or other
  misc_feature (360)..(360): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcagtctccactctccctgcccgtcactccgtggagacgcccggcctccatcctcctgcaggtctagtcagacgcctacctaaacactaatggatactactctttagaattggtactgcagagacgaggcagtctccacagcttntnatattagttggggttcttagtcgggtccctcccggggtcctgactaggttcnggtgcagtgatcagtacacgagttacttttacactagaaatcagtcgtgggcggaggcgtaagagtagtggttggtattttagtacgtgtactatgtaccaaccgttctaaaccgtatacggtgtacgggtacggtacgggaccgtaaagggacccgtaaggtaaggaactacgaacggccgtaagtgggtacgtcgtcgtaacccg

SEQ ID NO: 99787 - DNA, 736 bp, Homo sapiens
  misc_feature: GYAE6OF02GG6U0.40.81.H04.1.454.CMB.1.raw
  modified_base (162)..(162): a, c, t, g, unknown or other
  misc_feature (162)..(162): n is a, c, g, or t
  modified_base (241)..(241): a, c, t, g, unknown or other
  misc_feature (241)..(241): n is a, c, g, or t
tcagtctagcgactcacgaccggtgctcgatttagtagtgtagattcgcggggacgtgatcaggactcctcagttcaccttctcacaatgaggctccctgctcagctcctgggctgctaatgctctgggtctctggatccagtggggatattgtgatgactnattctccactctccctgcccgtcactcctggagcgccggcctccatcctctgacaggtctgtccagcgcctacctaaanactaagcggatacctatctttagattggtacctgctaagaacgcgaggcagtcctacacagtccttctacgattacgtagttttcggggttacttaacggtccgggtcccgttccgggggtcccctttaggaccttaagggggtttccaacgggttcgggtaccgtaggggtttacgggaacttaccgtaacggtcccgtaacgtaacggtttaacttttaaccgaccgttaaaggtaaaacttcggaacgtacgggtaacgggtagggaacgggtacgttaaagggaaacggttaggttgggtttaaacggtagttttaagttaccgtacggtaacgttacgtaacgtaccgtaaccctttagaaaccgttaaaccgtgggttacgacgggttaccggtaccgggtaccgtaaacggggaccgttaaaggggaaccggttaaaacgtacgaaacgggttaccgtaaaacgttcgggtacgtacgttacggaacc

SEQ ID NO: 99788 - DNA, 616 bp, Homo sapiens
  misc_feature: GYAE6OF02G7PUN.40.81.H04.1.454.CMB.1.raw
  modified_base (294)..(294): a, c, t, g, unknown or other
  misc_feature (294)..(294): n is a, c, g, or t
  modified_base (504)..(504): a, c, t, g, unknown or other
  misc_feature (504)..(504): n is a, c, g, or t
  modified_base (543)..(543): a, c, t, g, unknown or other
  misc_feature (543)..(543): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgacagtcgtggggctggaggtgaagagccgtggggcctcggtgaagtccgtcctgacaagtatttcgtaggaaaccacctgacgacaactactacatacactaggntgcggacgacggccccgtggacgtaggggtttgaggtggaggttggggtgtacgtaccaaaccccgtaccgaaggacgggtaggaaccgtaagaaacgtagtacgaactaacgtaacgttacgagggcgtaagggccaccgagtacggacccgtaggggtcccacgtcctaagtccgagccaactcgttacgtacgagttcggactacgnggtacggcgtacggtcacctcgcgaacgacggacgtcgngttagtatacgtaggtaggtaagaggtcgtacggtacggaccgtacggccgggtcacgaccggtgtcccgggg

SEQ ID NO: 99789 - DNA, 404 bp, Homo sapiens
  misc_feature: GYAE6OF02FT8XZ.40.81.H04.1.454.CMB.1.raw
  modified_base (239)..(239): a, c, t, g, unknown or other
  misc_feature (239)..(239): n is a, c, g, or t
  modified_base (376)..(404): a, c, t, g, unknown or other
  misc_feature (376)..(404): n is a, c, g, or t
tcagtctagcgactcacgaccggtgctcgatttagtagtgtagattcgcggggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttggatttatactgcatgcaacctntacaaactgtgtggacggtcggccaagggaccaaggtggaaatcaaagcgaactggtggctgcacatcgtgtcttcactccttacccgcatctagaagtcgactagctgacgcggctggcaaggcacgagtagcagnnnnnnnnnnnnnnnnnnnnnnnnnnnnn

SEQ ID NO: 99790 - DNA, 755 bp, Homo sapiens
  misc_feature: GYAE6OF02JQ3TS.40.81.H04.1.454.CMB.1.raw
  modified_base (340)..(340): a, c, t, g, unknown or other
  misc_feature (340)..(340): n is a, c, g, or t
  modified_base (546)..(546): a, c, t, g, unknown or other
  misc_feature (546)..(546): n is a, c, g, or t
  modified_base (592)..(592): a, c, t, g, unknown or other
  misc_feature (592)..(592): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcttggtggcagcagccgcgaggacgcccactcccgaggtcgcagcgtggtgcagtcgtggggctggaggtgaagagccgtggggacctggtagaacggtctccgtgacgtagtactttcgtacggaacctaccgtagacgactaaacctactaacaactaccgtacgtaggacgtaggccggaccgccggtaccccgngggtaaccggtaggggtttcggagggttgggtagggtcgggggtagtaccgtaccgtaaccccggtacggtaacgggtaaggggtcgaaccgtaaaggtaaacgttacggtaccgtaacgtaacgttaaaccgttacggacggggacgtacggtacctaacgtacggtacggtcggtacgggaccgtacgtaccgtacgtaaccgngtaacccgacctaacgttaccgtaacgttaacgtcgtaacgtacgnggaacggtccggtaactacggtaaccggtccgtacgaaccgcggtaaccgtcgtaacgttagtacgtacgttagggtaaggacgggtaacgtacgggttcggaacggtccggtaccgggccggtacggacccggtacggacccgggttacgggtaacccgggg

SEQ ID NO: 99791 - DNA, 649 bp, Homo sapiens
  misc_feature: GYAE6OF02I8HXZ.40.81.H04.1.454.CMB.1.raw
  modified_base (215)..(215): a, c, t, g, unknown or other
  misc_feature (215)..(215): n is a, c, g, or t
  modified_base (642)..(642): a, c, t, g, unknown or other
  misc_feature (642)..(642): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggctagcagccgcaggagcccactcccaggtgccagctggtagcagtcgtggggactgnggtgaagtaagccgtggggcctggtgaacggtctcctggcaagtattctcggaaacacccgtgacgcaactacgtacacgttaacacgtaggagttcgacggtcacggccccgtaggacgtaggggttcgagtcggaggtggggtagacgtccgaaacccgtacgaggcggttacggcaacgaaagtcgtacgaacgtacgtaaacgtttccaaggggacgtacgggtacactaacgtcggaaccgttacgggaccgcccggtacctaacgctaacggccctaaacgacggttccaactagtccgggaaattcgttacggacggaggtacccgttagaacccttgggtaaccgagaccgtacggacctgtaacggtacttcgtaggacgaagtcggtacgtttcgggcgtaccgtacgggtacgggnttaacgg

SEQ ID NO: 99792 - DNA, 752 bp, Homo sapiens
  misc_feature: GYAE6OF02IPI0S.40.81.H04.1.454.CMB.1.raw
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (711)..(711): a, c, t, g, unknown or other
  misc_feature (711)..(711): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccaggtcgccgagctggtcgctagtcgtggggctggagggtagaagagccggtgggcctcgggtagaacggtcctccgtgcgaagtntttcgaacggaaaccnccctggacgacctaaactaacgtacataacacgttggatcggccggaccaccggtcccgtagggacgtaggggtttagaggtgggagggtggggtacgtaacgtacccaaacccgtacggaggtacggtacggaacctaaacgtaaaggttcgtaacccggtagtaaaccggttaacgtttaccggaacggggtaccggtaacgggtaccccaaacgtacggttaccggaccggtacggggaacccgtccggtaaccttacgacgtacgacctaacggtcctacgaacgtgtacggtagtactcgggaaggttccggagtaccgtaccgtacggtaccgaaccgggaaccaccggtacgtaataccggtttagttaccggtagggtacggtaaagggtccgtacgggttcgggtaaccgtcccgggttaccggggnggttaacgtccccggaaccggtgggtacccggtaaccgggg

SEQ ID NO: 99793 - DNA, 606 bp, Homo sapiens
  misc_feature: GYAE6OF02JBARL.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagcgccgcctccatctcctgcgaggtctagtcagacgcctacctaaacactaagtggtactactacttctttagtaattcggtacctagacaagtaacgccgaaggctagtcctaccacgacgtctcttagattatacgtttggggttcttagtccggtccgtccggggtcctgtacgtaggttcaaggtggactaggtgatacgtcgtacaacaggttactttaacagtaagaaatcgagtgtgggtagagagaacgtaagtaggttgttacgggttatttacgtagtgtacgtactacgaccctacttacgttaactaaggttcgtggtacggtaccggtccgaccggtaacgggaacggtaagggtaagtaacgtagaacgtacgtaacgtcggtacgtactcgaacccg

SEQ ID NO: 99794 - DNA, 596 bp, Homo sapiens
  misc_feature: GYAE6OF02GF00G.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagagccgtgggcctcggtgaaggtctccgtgcaagatttctggaaaccaccctgacgcaactactacatacactgatgcggcacggcccctggacgtagggtttgaggtggagtggggtgactccaacccgtacgaggaggtcggcgaacgtaaagtacgtacgacgaacgtactttacgagggcgacgggtaccaccgagtacggaccgtggggaccgtcgtacccgagtaccgacgacctaacgacgttactacgagttaggactcgtaggacgtcggacgtcgtacctacgtacggacacgaccggccagtagtacttagtggtacggaagacggtacgttggtcgtaccgaccggggcggtcgtacggaccgtacggaccgggg

SEQ ID NO: 99795 - DNA, 925 bp, Homo sapiens
  misc_feature: GYAE6OF02JSM23.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctcgcccgtcacctccgtggagacgccggcctccatcctcctgcaggtctagtcagacgcccttacctaaacactaagtggaacttaccttacttctttagtaagttcggtaccctgacctaagaacggccgacgggtcctaagttcccgtccaacgacgtccgttacttagacttaaggtttaggtttcgggggttactttacgggtcccggggtcccccggtttaccccgggggttaccccttacggtaacccgggttagggtttacccgaggggtttacgggacgttaagggtccgggtaattaccgtaacggtacccgtaaagtaagttttaacgttttaacccgaaattaacgggttaaaaacgtcgtaacgggtaacggggtacgggggttacgggaaccgggtaaggtaaacggaaggttaaggtttacgggtttaaggggtttaaacgttttacgtttaacccggtaggttacgtacggttaaccggtaacctttaacccgttaaccgtaaaccgttaaaacggttcgggtttaccgggttaaccggggttaccggggtaaacccgggtaaccggggtaaacccggggttaaacggggtaaaacgggtaaaccggttaaacgggttaaccggtaaaccgggtaaccggttacgggtaaacgggttccgggtacgttaacccggaccgtaacccggtttaaccttcggtttaacccgttaccgttttaaccccggttaccttacccccggtttacccg

SEQ ID NO: 99796 - DNA, 600 bp, Homo sapiens
  misc_feature: GYAE6OF02JB9CR.40.81.H04.1.454.CMB.1.raw
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggacgcccactcccaggtgcagctggtgcgagtcgtggggctggaggtgaagacgccgtgggcctggtacgaaggtcctcgtgacaaggtnttcgtaggaaaccncctgacgacaactactacactacacgtaggatcggcggacaccggccctaggacgtaggggttgacggtaggagtggggtagactaccgaaccgtacgaggaggtcgacaagtaagtagacgacgtacgtaacgttacggaggtacgagggtcacgagtcggacgtgggacctcgtaccagtacacgactacgtacgtactagacgtcgtagtcgtaggcgacggtactcgtaccgtcgacgtacgacgtaccgcgtaagtcgtacgtacgaggtcggaagtggtagtcggtggaccggttacggcgggtacgacgtacggacgggtaccggg

SEQ ID NO: 99797 - DNA, 638 bp, Homo sapiens
  misc_feature: GYAE6OF02IUQ4B.40.81.H04.1.454.CMB.1.raw
  modified_base (179)..(179): a, c, t, g, unknown or other
  misc_feature (179)..(179): n is a, c, g, or t
  modified_base (521)..(521): a, c, t, g, unknown or other
  misc_feature (521)..(521): n is a, c, g, or t
  modified_base (561)..(561): a, c, t, g, unknown or other
  misc_feature (561)..(561): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccaggtncagctggtgcagtcgtgggctgaggtgaagagccgtcgggcctcggtagacgtctcctgacaagtattacgaggtaaaccaccgtagacactaactactaacatacacgtggtatggccggacaccggtcccgtaggacggttaggggttgacggtggtaggtaggggtagtaactacccgaaccgtacgaggtacggtacgaactaaacgtaaacgtaacgtacgaaacgtaacgttaaaccgttcggaacggaaccggtaacggtacccaacgtacgtacggaccggtaacggggacctaccgtaccgtaatacgaacgcctaaacgtcgtacttaacgngtacgtattcgagacggtcggctacgactaggaccgtaanaccgagccgtaatacgtgacgttggaacgtagacgtagttggacgaccgtcggcgtaccgacgacgtcggcggaacg

SEQ ID NO: 99798 - DNA, 732 bp, Homo sapiens
  misc_feature: GYAE6OF02JGBGL.40.81.H04.1.454.CMB.1.raw
  modified_base (624)..(624): a, c, t, g, unknown or other
  misc_feature (624)..(624): n is a, c, g, or t
  modified_base (698)..(698): a, c, t, g, unknown or other
  misc_feature (698)..(698): n is a, c, g, or t
tcagtctagcgactcacgaccggtgctcgatttagtagtgtagattcgcgggggtgcccgtgagagcatcacccagcaaccacatctgtcctctagagaatcccctgagagctccgttcctcaccatggactggacctggaggatcctcttcttggtggcagcagccgcgaggacgcccactcccaggtgcagctggtgcagtcgtggggctggaggttgaagtaagccgtggggacctcggtgaaggtctcctgacaggtattcgtaggaaaccacctagagacaactactaacatacacgtggatgcggcgacggccctaggacgtacggggttcgaggtcggtaaggttggggtggacttacgaaccccgttaacgacggcgggtaggacgaacgtaaacgtagtaccgaacacggtaaccgttttacgagggacgtacgggttaccgaaccgacgttacggtaccgtacggggtaccgaggtacccgtaacgtactacggacaaacgtaccgttacctaacgttacggaggtaacttccggtaaggtaccgggtaaccgggtacgttaccgggccttaaaccgggtaccggaaccggaaccgtaacccggtacccgttanaacccgggtttaacgtttacccggttaggttaaccgggaacggtaaggttaaccggggtttacggtaacccggngttacccccggggttagggtaccccgtaaccggg

SEQ ID NO: 99799 - DNA, 752 bp, Homo sapiens
  misc_feature: GYAE6OF02GMGZY.40.81.H04.1.454.CMB.1.raw
tcagtctagcgactcacgaccggtgctcgatttagtagtgtagattcgcgggggaggagcatcacccagcaaccacatctgtcctctagagaatcccctgagagctccgttcctcaccatggactggacctggaggatcctcttcttggtggcagcagccgcaggacgcccactcccgaggtgcagcgtggtgcagtcgtggggctggaggtgaagagccgtggggcctcgggtagaaggtctccgtggacaagtatttcgtaggaaaccacccgtgacgtacaaactaactacatacgaccgtaggaactcggccggtacgacggtccccgtggtaccggtaggggtttgaggttgggaggttggggtacggtactacccgaaacccgtacggaggtacggggtacggacaacgtaaaaggttacgtaccggaacgtaacgtaacgttttccggaacgggtaccgtaacgggtaccaacgtacgtacgggaccggttacggggaccgtacccggtaccgtaacgttccgaacgaccgtaacgttaccgttaccttaaacgtacggttaccggtaacgttcgtacggaaccggggtccggtaaccgttaccgggtaacccgttcggaacggtaccgaaccgtaccggactacgttacgttactaggttacgggtaacggtaacggtacgggtacggttcggacgggtaccgtacggggtccggtaccgtcggtaacccggaggtacccgggg

SEQ ID NO: 99800 - DNA, 722 bp, Homo sapiens
  misc_feature: GYAE6OF02IH57A.40.81.H04.1.454.CMB.1.raw
tcagtctagcgactcacgaccggtgctcgatttagtagtgtagattcgcgggcgtagactttgtgtttctcgtagtctccctgctcagctccgtggggctgctaatgctcgtgggtctctggactccgaggtggggatattgtgatgactcagtctccactcctccctcgcccgtcacctccgtggagacgcccggcctccatcctcctgcgaggttctagtcgagtacgacccttaacctaaaacaacgtaagtcgtaatacctattcttagtaattcggtacctgacaagacgacggagggactacgtcctaccacgacgtccttacgttacgtaattaaggtttaggtttcggggtttacgttaccggtccggggtcccgttcccggggtaccgtgtacggtaggttcgtacgggtcgacgtagggtcgtactcgtacgtacacgtaacttacgtttaaacgacttaaagtaaactcggacggtacggtaagggggtcgaaggtacgtaaaagggtaacgttagggttacggttaggttatttacgtacgtggtactacgtacgtaacctaaactacgtaacgtaaggttcgtaagggtaccggaccggttacgggaaccgaaacgggtaacgtaaaggttaccgaaaagacgtaccgagttaccgaggttcggctacggactacgttctacgttcgtacttcggaccttcccgtaccg

SEQ ID NO: 99801 - DNA, 982 bp, Homo sapiens
  misc_feature: GYAE6OF02HN6VZ.40.81.H04.1.454.CMB.1.raw
  modified_base (195)..(195): a, c, t, g, unknown or other
  misc_feature (195)..(195): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggactcctcttcttaggtggcagcagccgcaggacgcccactcccagggtcgcagcgtggtnctacggtcgtcgggggctggaggtacggaaagacggccggtggggaccctgggtacgaacggttcctccgtaggacaaagttctttacgaacgggtaaacctacccgtaggacaacctaactactacgtaactacctacggtagtacgtcggccggacgtcccggtcccgtaaggggtaccggtagggggtttacgacgggttacgggacgggttacgggggtacgtaacccgtaacccgtaaccccgtaaccggtacgggacggggtacggaacccgtaaaaacggtaacgggttaaccgtaccggtaaacgtttaaacggtaaacccggttttcggaaacggggtccggtaaaaccggggcccttaaaccggaacggttaccgggtaaaccccggggtacggggtaaaccccggttaccgtaaccccggtaagttaacccgggaccgtaacccgttaaacgtaaccggtttaacccggttaaacgtaccgggttaagttacccgtttaaaccggtaccggggggtaacccggttcccgggttaaaccgttcccgggtttaaaccccggcgggttaaaccgtacccgggttaaacccggtaaaccggttacccgttaaggttaacggttttaaccgttcccgggttaaaggtaaaccgggggttaaccggtaaacgggttttcccggggtttaccggggtacccgggttaacccggttcccgggggggttacccggttaacccgggttaaccccgggaccgggtcccgggggttaaaccccggggg

SEQ ID NO: 99802 - DNA, 703 bp, Homo sapiens
  misc_feature: GYAE6OF02HIO7S.40.81.H04.1.454.CMB.1.raw
  modified_base (234)..(234): a, c, t, g, unknown or other
  misc_feature (234)..(234): n is a, c, g, or t
  modified_base (272)..(272): a, c, t, g, unknown or other
  misc_feature (272)..(272): n is a, c, g, or t
  modified_base (470)..(470): a, c, t, g, unknown or other
  misc_feature (470)..(470): n is a, c, g, or t
  modified_base (630)..(630): a, c, t, g, unknown or other
  misc_feature (630)..(630): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccacgtcccgaggtgcagcgtggtgcacgtcgtggggctggaggtgaagacggccgtggggcctcgggngtaacggtcgtcctgactaagtactttcgaggaaaccnccgtgacgacaacgtactacgactacacgttggactcggcggcgtaccggtccgtaggtacggtagggtttcggaggttcgggtaggttgggggtacggaccttaccgtaacccggtacgagggtacggtcgaacaacgtaaagtagtccgaagtacgttacgtaggacggtcgaggtaccacgtagtaccgtacggngggtcctacgtaccgagttacgacgctaacgtcggtacctaacgagttcgggacttcggaggtaccggtacggaccgttaccgtacgtacggacgggtaacccgaacggcccggtacgttaaggttacgttaccttacgggtcggtaagggttaaccggnggttaccgggtcgggtcgggtacccgtccgggacgggttcctaacgggcccggttcgggaccggggtacccgg

SEQ ID NO: 99803 - DNA, 558 bp, Homo sapiens
  misc_feature: GYAE6OF02FIKCG.40.81.H04.1.454.CMB.1.raw
  modified_base (426)..(426): a, c, t, g, unknown or other
  misc_feature (426)..(426): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggccctcgggtgaaggttctccgtgccaagtatttctggaaacaccctgagcaactactacatacactggatgcggcagcccctggacaggggtttgagtggagtggggtggatcaaccctaccagaggtggcacaaagtatcgacagaactttcgagggcacggggtcaccatcgaccgtgggaccgcgtccatcagcacagtctacntggatcgtgacgcgactgacctcgtagaccgacacggaccatacgttattacgtgtaggaaagtaggtaacggtttgggtcggaccgttaccgggcgggggtacctacggaccctaccggtgggggaacccg

SEQ ID NO: 99804 - DNA, 699 bp, Homo sapiens
  misc_feature: GYAE6OF02GODVO.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccagtggggatattgtgatgactcagtctccactctccctgcccgtcactcctggagacgccggcctccatctcctgcaggtctagtcagacgccctacctaaacactaacgtggatacctacttctttagaattcggtaacctgaccagaacgccagggctacggtcctccacagtcttcttagattagttagtttcggggtttacttaggtccgggtcccgttccggggtccctaggaccgtaggtttccgaggtcgacgtaggttacggactacacggtaccaacgtacggttaactttttaaccaacgttaacgtaaaacgtacgaacggtaccgggtaggggtacgggaacggtaacgaaggtaaagttagtttaggggttaacggttacgtttttaacgttaacgtttacgaccttagtaccgtaacctaacccgtttactaaaccgtaaacgttcggttacggttaccgggtacggtaccggaaccggtaacgggaaccgtaagggtaacgtaaacgacgtaacggacgtaacgttcggagtaccgtagtaaccc

SEQ ID NO: 99805 - DNA, 555 bp, Homo sapiens
  misc_feature: GYAE6OF02G0IKN.40.81.H04.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
  modified_base (508)..(508): a, c, t, g, unknown or other
  misc_feature (508)..(508): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (538)..(555): a, c, t, g, unknown or other
  misc_feature (538)..(555): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctgggaggatcctcttcttggtggcagcagccgcaggacgcccactcccaggtcgcagctggtgcagtcgtgggctggaggtgaagagcgtgggctcggngagtctcctgcaagnttcgagaaccncctgagccaactactacactacagtagatcgcggacnccggcccgtaggacggtaggggtttggaggtgggtacggtgggggtacgtactaccgtaacccgtaccgtaggacggtcgacgaaacgtaaggtactacggaacgtaacgttacgttacggagggtacgtacggtacaacgtagtccggaacgtcgggacgtcctacgactgaactaccgacgttacgacctagtatacggtactgggtgacggtcggngtacgggacgacggactgtacgancgngannnnnnnnnnnnnnnnnn

SEQ ID NO: 99806 - DNA, 765 bp, Homo sapiens
  misc_feature: GYAE6OF02I8LHO.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctggtctctggatccaggtgggatattgtgatgactcagtactccactctccctgccctcactcctggagacgccgcctcatctctgcgaggtctagtcagacgacctacctaaacacgtaatggaacttacctacttccgtttagaacgtttcggtacctgtaccgaaacgtaaacgccgaacggggacctacggtacccttaccgaacgtacggtaccttaccgttaggaactttaccttaagggttttcgggttttaccgttaacggttcccggggtcccggttaaccccgggggttcccctagggtaaccgtacgggtttccgtaaggtccggtaacgtggtacggtaactcgtaacgtcctaagtacgttaactttacgaacttaagaaaccgtagtacgtacggtacgggtacggaaggtaccgaaaggtagtaggttggttagggttaactttaacgtacgttacgacgttaacgtaccgggtacctaaccgttactaacgttaaaccgttgggttaacgggtccggttaacggggtacccggtaacggtaaaccggggttaaaccaacggggttaaacgttaaaccgacggtaaacgtccgttaaaccgtcggtttacggacttaacggaaccc

SEQ ID NO: 99807 - DNA, 747 bp, Homo sapiens
  misc_feature: GYAE6OF02J1G9Z.40.81.H04.1.454.CMB.1.raw
  modified_base (615)..(615): a, c, t, g, unknown or other
  misc_feature (615)..(615): n is a, c, g, or t
tcagtctagcgactcacgaccggtgctcgatttagtagtgtagattcgcggggactgatcaggactcctcagttcaccttctcacaatgaggctccctgctcagctccgtgggctgctaatgctcgtgggtctcgtggactcgaggtgggattgttggtgatcgactctacttcctcccaccttccctcccgtccgtccccgtacctaccgttccgagggacggaccgtcccggtcctcctacgttccttcccgtgtaccgtaggttaccgtacgtacgacggtaccgtaccctaaacctaaactaacttaagtacggttaccttaccttactttacgttaagtacggttacgtactagacgaggtaacccgcgacggtacctcgtacctaccgaacgtcctacttcgttagtacgtttaaggttcggtttccgggtttactacccgggtcccgggtacccggttccgggtctacgtacggtttcggacgtggacgtcgtagtacgtctacgtacgtctaattacgtacttaacgaacgtaacgtaacgtcgtacggtagggtaggacggagtagtaacggttagttacggtttggtaactttactacgttacgngtaccttgaaccgttactaacgttaactacggtaacggttcggaacggtccgggtacggtaacggtaccgggaaacgtaggtaactaacggtacgtaaacgcggttaacgtggtcgtaccgcgtaactaccg

SEQ ID NO: 99808 - DNA, 711 bp, Homo sapiens
  misc_feature: GYAE6OF02FFJ3X.40.81.H04.1.454.CMB.1.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcacgccgcaggacgcccactcccaggtgcagctggtcgcagtcgtggggctggaggtgaagacgccgtggggcctacgggngtaacggtctaccngacaagtnttactacggaaccacctganctaactactacatacncgtgatgcggacncgtccgtgacgtagggtttcgaggtcggaggtcggggtataccgtaccaacccggtacgaggtacgggttcggactaaacgaaacgtacgtaccggtaataacgtaacgtttaccggagggtaccgtaccgggtacaccgtacgtaccgacgtcgggaaccgtaccgtacgactccgtaacgcgaacgtacgttactaacgtagtacggtactccgtacggtacggtaccggtacttaccggtaacccgtacgtaaccgaaccgtaccgtaccggtactaacggtttacgttacgtaacggtaaggtaacggtaacggtaacgggttaaccgggttaccgggtaacggtcccgggtaacccggggtcggtaccggtacccggtaccggtcccggtaacccggggg

SEQ ID NO: 99809 - DNA, 834 bp, Homo sapiens
  misc_feature: GYAE6OF02JCRWY.40.81.H04.1.454.CMB.1.raw
  modified_base (156)..(156): a, c, t, g, unknown or other
  misc_feature (156)..(156): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctcgtggatccgagtggggatagttgngatgactcagtctccactcgtccctgacccgtcaccgtccgtggagacgtcccggcctccatcctccctgactacggtactagtccgagtacgtccctaacctaaaacaccgttaagtggtaacttaacctactttacgtttagtaacgttttacgggtaacccttgaccgaaggtaaaccggtcccggtaagggcctaacggtaccctccgtaacaacggtctaccgtttagtaaccttattaacgggtttcggggtttaccttaaggtccccgggttacccggttcccggggggttacccttagtaaaccgggttcgggtttacgtacggggtgtaacccgttagggggttacaagttaccccggttaacggtaccgtaaaacccggtagtttttaaacccgttttaaccgaacggtttaaaacgtaaaacgtttcgaacggttacccgggttaagggggttacgggacggtaagtaacgggtaagttaaggttagggtttagggttaaacctttaagttacggtacgtacggacgttaacgacgttaaccgtaacgtaacgttaaacgtgggttccggttaggggacccgttaacgggaccggaaacgggtaccgtaaagggtaaccgtaaagtaccgaacggtacctagggttcgaccggttcgtacgtaaccc

SEQ ID NO: 99810 - DNA, 777 bp, Homo sapiens
  misc_feature: GYAE6OF02JOWWI.40.81.H04.1.454.CMB.1.raw
  modified_base (519)..(519): a, c, t, g, unknown or other
  misc_feature (519)..(519): n is a, c, g, or t
  modified_base (541)..(541): a, c, t, g, unknown or other
  misc_feature (541)..(541): n is a, c, g, or t
  modified_base (554)..(554): a, c, t, g, unknown or other
  misc_feature (554)..(554): n is a, c, g, or t
  modified_base (622)..(622): a, c, t, g, unknown or other
  misc_feature (622)..(622): n is a, c, g, or t
tcagtctagcgactcacgaccggtgctcgatttagtagtgtagattcgcggggactgatcaggactcctcagttcaccttctcacaatgaggctccctgctcagctccgtgggctgctaatgctcgtgggtctcgtggactccgaggtggggtattagttggtgatgactctagtcctccactcctccctcgccccgtctaccgtccgtggacgacgcccggtaccctctacttcctccgtgcgtaggtactacggtaccaggtaccgtaccctaacctaaaactcgtaagtaggtaacttacctacctttcgtttaaggtactttaccgggtaacctggaccgaaggtaacgaccggaacgggtacctacggtacctaccgtaacgcgtcctttcgtagtattaagttgggtttacggggttacttaccgggtcccgggtaccccggttaccgggggttccctaggtaacgttgggttacgtaggtcggtagtagtacgtagtccgtaataccggtanagtttactttaacgagttaaanaacgtgtaaccgngggtaagggacggacgacggtaaaggtaacgttgggttacggttaggtttaactttacgtagacggtntaaggtcctaaaccttaccgttaaacgttaacgtaacgggttgggttaaccggtcggggttacccggaacgggtaaaccggtaacgggttaacgggtaaacggtaacgtaacggacggtaacgaccggtaggttcgacgggttacaaccggtccg

SEQ ID NO: 99811 - DNA, 881 bp, Homo sapiens
  misc_feature: GYAE6OF02HAJFP.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcaggacgcccactcccgaggtcgcagctgggtcgcagtcgtgggctggaggtagaagacgccgtggggacctcgggtgaaggtctcgtgcaaggtatttcgaggaaaccaccgtgacgaccaaacgttactaacactaaccacgtaggattggaccgggcgaccgggtaccccgtacgggtaacgttacgggggtttcggtaagggtcgggtaggttcggggggtaacgacgttaccccgaaacccgtaaccggacgggtaacggtcgggtaaccgtaaacggtaaaacggttaccgtaacggaaccgttaaaacgggttaacccggttttacgggaaacgggggtaccgtaacgggggtaacccgtaaacccgttaacgggtaccggtaacccgggttacggggtaaacccgggtacccggttaacccgtaacggttaacccgtacgggtacccgtaaaccggtaaccggttaaacgttaaccgggtaacggtttaaccgggtacgtttaaccgggttcggggaaaccggttaccggggaaccggtttacgggttaacccggtaccgggttaacgtaaacccgggaccgggtaaaccggccggttaacgtaaggtttacccggttacgttaacgggaggtaaccggtaaagggtttccggttacgggttaacccgggtacggtttacccggggttacggtcggtaacccgggg

SEQ ID NO: 99812 - DNA, 722 bp, Homo sapiens
  misc_feature: GYAE6OF02GHDMG.40.81.H04.1.454.CMB.1.raw
  modified_base (336)..(336): a, c, t, g, unknown or other
  misc_feature (336)..(336): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctcccgttcctcaccatggactggacctggagatcctcttcttggtggcagcagccgcgaggacgccccacctcccgaggtgacgacgtcgtggtgcgtagtcggtggggctgggaggtaggaaggaacggccggtcggggccgttcgggtagtaacggtccgtccgtgtactaagttactttcgaacggaaaccncccgtaggaccgtacaactactacaatactacgtgagtggccgacgaccggcccgtaggtaccggttagggttaggaggtggtaggtcgggtagtacctacccggtaccgtacggaggtacgggtacggactaaacgtaacgtaccgacgaaacctacggtaaccgttacggacgggtaccgtacggtacccgacgtacgttaccggaccggtccgggactcccgtacagttaccagaccctacgttaacgtacgtacgtagtacggactttcggacggttcggaccggttacgtacccggttaccgtccggttaaccgggaccgtaaacccgggtacccggtaaccgtttaccggttaacgtttaccggtaacggtttaacgggg

SEQ ID NO: 99813 - DNA, 787 bp, Homo sapiens
  misc_feature: GYAE6OF02HH7FF.40.81.H04.1.454.CMB.1.raw
  modified_base (244)..(244): a, c, t, g, unknown or other
  misc_feature (244)..(244): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagtcctccactcctccctcgccccgtcacctccgtaggagaccgccggtccctccatcctcctcgcgtaggtctagtcagacncctaccaaacactaatcggatactacttactttagagttcgtactgacgagaacgaccgagggactcgtacctccacagtccttcgtagtattagttaggtttacggggttcttacggtccggggtacccggtcccgggggttaccctaggtaccgtaggtttaccggaaggttcggacgtaggtacggtatctacgttacaacgtagtttaactttaccgacgtaaagtaaacttcgaagggtacgggtaacgggtacgggtaaacgggctaaaaggggtaacgtaagggtttaggggtttaacccgggtttaaattttaacgtttaaccggcggttaattaaccgttaaccggtacccttaaaccctttaaccgaaaaccgtaaaccgttgggttaacggttaccggggaacccggggtttcgggaaacccgggaaaagggtttacccgggaaaagggtttaacggaaacggtaaacccgttaacgggtttaacccggaaggttaaccgggttaccggtaccggttaacccgttaacccgg

SEQ ID NO: 99814 - DNA, 752 bp, Homo sapiens
  misc_feature: GYAE6OF02HY85S.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcacggccgcaggacgcccacctcccgaggtgcacgcgtggtgcgtagtcgtggggctggaggtagaaaggaacggccggtcgggtccggttacgggtaggtaacggtccgtacctcggacaacggtatttacgacggaaacctacccgtaggaacgacctaaactactaaccgtaactaacgtaacgtacggtacgtcggtcggccggaccggtacccgtacgggtaacggtttagggggttcggaggtagggtagggtagggggtacgtacgtaacccgaaacccgtaacggtacgggaacgggtaggtaaccgtaaacgtaaacggttaacgtaccgtaaacgtaacgttaaccggttaacggacggggtaacgtaccgggtaccctaaaccggttacgtaccggtaaccggtacgggtaacccggtcccgtaaccgtacgtaccggtaacgacccgtacgtaacgttaccttaacgtagttacgtagttacgtacgggacgtcggacgtccgaacgttaccggacgacgacgaccggactaggtactacgtacgtagg

SEQ ID NO: 99815 - DNA, 844 bp, Homo sapiens
  misc_feature: GYAE6OF02FM0IB.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtgaaggtctcctgcaagtatttctggaaacacccgtgacgcaacgtactacatacactggatgcggcacggccccgtaggacgtaggggtttgaggtgggagttgggggtacggtactaccgaacccgtaccgaaggacggtacggaccaacgtaaacggttactaccggaactaacggtaaccttttaccggaaggggtaccggtaacggggttaccaaccgtaacggttaccggtaacccggtacgggggtaaccggtcccggttacccgtaacgtccgtaaacgcccgaaacgtaaccggttaccgttaaacgaacggtttcgggtaacttccggtagggaaaccgggtccgggtaaacccgttcgggtaaccccgtttacggtaaccgggtaacccggaaaccggtaaccccgggtaccttaacggttttaacgggttaaccgtttttaaccgggtcggggtttaaacgggtaaaccgggttaacgggttaaacccggggttttcggggttaaccggggttaaccccgggttaccccgggggtacccggggggttaacccgttacccgggggtaacccccggtaacggggttcccgggggggtaaaccccccggg

SEQ ID NO: 99816 - DNA, 643 bp, Homo sapiens
  misc_feature: GYAE6OF02HFDXX.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtaggggcctcggtaggaaggtcctccgtgacaagtatttcgtaggaaaccaccctgacgaccaactactacatacactggatggcggacgacggcccctggacgtggggtttagaggtggagtggggtgactccaacctacgaggacggtggacaagaaagtagtacgacaagtaactttagacggcgaggtcacgtaagtcgaccggtacgggacgtccgtcaactccgaacgcaacgtacgtacctaagtacgtaggacttacgtcggacggcgtaacgtccgaccgttacgacggaacgtaccgacggtaccgtagtacgttacgttacgttcgggtaaggaacggtaacggtacgggttgggaccggtaccggtacccggggccggtaccgtacgggtaccgaccgggtacgggtaacccggg

SEQ ID NO: 99817 - DNA, 636 bp, Homo sapiens
  misc_feature: GYAE6OF02G7FAZ.40.81.H04.1.454.CMB.1.raw
  modified_base (297)..(297): a, c, t, g, unknown or other
  misc_feature (297)..(297): n is a, c, g, or t
tcagtctagcgactcacgaccggtgctcgatttagtagtgtagattcgcggggatcaggactcctcagttcaccttctcacaatgaggctccctgctcagctcctggggctgctaatgctctgggtctctggatccagtgggatattgtgatgactcagtctccactctccctgcccgtcactcctggagacgccggcctccatctcctgctaggtctagtcagcgcctacctaaacactaatggatactactcttgtaattggtactgcagaagccaggcagtctcacagctattnatatagttagggttcttagtccgggccgttccggggtcctcgactaggtcaggtggcgagtggactcagtaccagaagttactttacgtaactagtaaactacgtaaggacgtaggggtacggaaggtacgaaggtaagtagttcgggttagggttagttttaacgttactcggtaactagttacgaccgtaaaccttaccttaaacgtaacgttaggttacggttacgggttacgggtccgggaaccgtaacggggaaacggtaacgggtaacggtaaagtaccggaaaggtaccgtaacggttcggttacggtacctacggtaccgacccttaacgg

SEQ ID NO: 99818 - DNA, 729 bp, Homo sapiens
  misc_feature: GYAE6OF02HYAG0.40.81.H04.1.454.CMB.1.raw
  modified_base (198)..(198): a, c, t, g, unknown or other
  misc_feature (198)..(198): n is a, c, g, or t
  modified_base (603)..(603): a, c, t, g, unknown or other
  misc_feature (603)..(603): n is a, c, g, or t
tcagtctagcgactcacgaccggtgctcgatttagtagtgtagattcgcgggcacgaccggtgctcgatttagtagtgtagattcgcgggggagagcatcacccagcaaccacatctgtcctctagagaatcccctgagagctcgttcctcaccatggactggacctggaggatcctcttcttggtggcagcagccgnaggacgcccacctcccaggtgcagctggtgcagtcgtggggctggaggtgaagaacggccgtggggcctcgggtagaacggtctcctgaccgaagtacttacgtaacggaaaccacccgttacggacgtaccgtaaaccgttaacctaacctaactaaccgaacgttacgggaacgtcggccggaccggaccggtccccggtagggtacggttacgggggtttggaggtggtacgggttgggggtacggacttaacccggaaccctaacggtaacgggcgggtacggactaaaccggtaaagtaccgtacggaaactaacggttacgttacgggtagggacgtacggtaccgaacgtaggtaccgtaaccgggtcggggaccgtccggttaccgaatacccgganacccgtaacgtaacgttctaaccgtaggtacgtactaccggttaggacgggtcccggaacgttccggaaccttcgggaacgtaaccggaccgtacggaccttaaggtttcgttacgttacggtagg

SEQ ID NO: 99819 - DNA, 726 bp, Homo sapiens
  misc_feature: GYAE6OF02HI4I6.40.81.H04.1.454.CMB.1.raw
  modified_base (284)..(284): a, c, t, g, unknown or other
  misc_feature (284)..(284): n is a, c, g, or t
  modified_base (582)..(582): a, c, t, g, unknown or other
  misc_feature (582)..(582): n is a, c, g, or t
tcagtctagcgactcacgaccggtgctcgatttagtagtgtagattcgcgggggtgccctgagagcattacccagcaaccacatctgtcctctagagaatcccctgagagctccgttcctcaccatggactggacctggaggatcctcttcttggtggcagcagccgcgagggacgccccaccgtcccagggtcgccgagccgtgggtcgcaggtcggtgggctggagggtagaagaacggccggtacggggccgtcgggtgaacggtctaccgtgacaagttnttacgtacggaacctaccgtgacgactaactacctacactacacgtaggacgtacggcgacgaccggcccgtaggacggtcggggttagtaggtaggtagggtcggggtagtacgtaccgaacccgtacgtaggacggtacgacgtaacgtaaacggtagtacgaacgtaacggtaacgttacggacgggacgtcgggtacctaacgtcggtaccggtaccggtacgggaccgtaccgttaccgctacggaccgtacgacgttaacgtctacgtacgtggaaccttggtagacccggngtaccggttaaccgaccttcgtaccggaaacgacccgtaacggttacgatttacggtaagttaccggaggtaaggtaacgtgggtttaaccggcggggttaccggacccgggtcggggtacccggttcctaacgggtacccggg

SEQ ID NO: 99820 - DNA, 689 bp, Homo sapiens
  misc_feature: GYAE6OF02G6DZW.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcgttggtggcagcagccgcaggacgcccactcccaggtgcgagcgtggtgcagtcgtgggctggaggtagaagaacgccgtgggccgtcgggtagacggtctcgtgactaagtattcgtacggaaccaccgtgacgactaactactaacataacacgtagagtcgcggtacgccggcccgtaggaaccggttaggggttagacgggttggaaggttggggggacgtactacccgtaacccgtaccggaagggtacggtacgaccgtaaacggaaaagttacgtaacggaacgttaaacgtaaccgtttacggaacgggtacggtacgggtaccaaccgtaacgtcgtaacggtacgggacgtaccgtactacggtaccgaacgacccgtaactacgttaaccgaacgtaggtaacgtagtaccggtaggaccggtacgggacgtaccgtacggttaaccgacggtaaccacccggttaccggaccgtaagtaccgtagttacgtaaggg

SEQ ID NO: 99821 - DNA, 653 bp, Homo sapiens
  misc_feature: GYAE6OF02JOEAJ.40.81.H04.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (275)..(275): a, c, t, g, unknown or other
  misc_feature (275)..(275): n is a, c, g, or t
  modified_base (434)..(434): a, c, t, g, unknown or other
  misc_feature (434)..(434): n is a, c, g, or t
  modified_base (497)..(497): a, c, t, g, unknown or other
  misc_feature (497)..(497): n is a, c, g, or t
  modified_base (578)..(578): a, c, t, g, unknown or other
  misc_feature (578)..(578): n is a, c, g, or t
tcagtctagcgactcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtcncctgcaaggcttntggttacaccttttacaactatggtatcgagttgggtnacggacgacggtccccgtaggacgaagggtccttaggacggtggacgtggggattcgggaatcgagccggtactacgtaagtcggtcaacaacgtaactagtacgcaataaccgaaccttcggaacggcaacggaagtaccaacgactacggaacccanaacgactaccgactcgaacgcgactacggactagactacggactggacgcgtactggagtacnccgtaggaccgtaccgccggtacgtgttacgttagcgtaggacgtaacggaggtacggtacgggttaaacttacgggttanaccgggttagttacccgtttacggttaacgtccggttaccgggacggttacccgggtaacgacccggtttaccgg

SEQ ID NO: 99822 - DNA, 671 bp, Homo sapiens
  misc_feature: GYAE6OF02F7P40.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagccgtggggcctcggtggaaggtctccgtgcaagtatttcgtggaaaccacctgagacaactactacatacactggatgcggcacggcccctggacgtaggggttgaggtggagtggggtggataccaaccctacgaaggaggtggacaacaaagtatacgaacaacgtaacctttacgagggacggtacgggtaccaaccgtagtcggtaaccgtggggaccgtaccggttacccaagtaccgaacgaccgaaaccgtacgtaacctaacacgttacggacttacgtacgggaacggccggtacgttaccggaaccgttacggtacggaaccggtaaccgaaccggtaaccgtagttacgtacgttacgtaggtaacgggtaagtacgggtacggtttacgggacgtacccgggttaccgggccgggtcgttacggacccggtacggtaacccggggg

SEQ ID NO: 99823 - DNA, 715 bp, Homo sapiens
  misc_feature: GYAE6OF02JLGBN.40.81.H04.1.454.CMB.1.raw
  modified_base (198)..(198): a, c, t, g, unknown or other
  misc_feature (198)..(198): n is a, c, g, or t
  modified_base (444)..(444): a, c, t, g, unknown or other
  misc_feature (444)..(444): n is a, c, g, or t
  modified_base (479)..(479): a, c, t, g, unknown or other
  misc_feature (479)..(479): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatagactcagtcctccactcctccctgcccgtcaccgtctggganaggcccggcctccatcctccgtcgctaggtcctagtcagacgccctacctaaacactaagtagatactacgttacttagaatttcggtacctgcaaggacgccggtagggccagtcctaccgacactctcttagactatttaggttcgggttccttacggtccgggccgtcccgggttactacgtacgtagttgagtcggagttagaggtcactgtacctacgtagttactttaacaacgtttaanaacgtacgaacggaccgggtagggtcgggtaacgngaaccggttaaggtagttttacgggttagggttaattttacgtcgttacgatacgtaccgggttacaacccgtttaacttaaacctaacggtttggttaacgggttggggtaacccggttccgggaaaccggttaacggggaaaccggtaacgggttaaaccgggtaaagttaaaccgggaacggttaaccggtaacggttaccgggttaggacccgtaggtaccccgttaaccgg

SEQ ID NO: 99824 - DNA, 636 bp, Homo sapiens
  misc_feature: GYAE6OF02F1URF.40.81.H04.1.454.CMB.1.raw
  modified_base (578)..(578): a, c, t, g, unknown or other
  misc_feature (578)..(578): n is a, c, g, or t
  modified_base (590)..(590): a, c, t, g, unknown or other
  misc_feature (590)..(590): n is a, c, g, or t
  modified_base (630)..(630): a, c, t, g, unknown or other
  misc_feature (630)..(630): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagcgtggtgcagtcgtgggctgaggtgaaggaagccgtggggacctcgggtagaacgggttctccgtggacaagtcttttcgtaaggaaacctacccgtggaacgacctaaaccgttacaaccgtataaccaccgtggtactggacggcgaaccggtcccccgtagggaaccggtggggtttcgaggtggtacggtgggggtgactaccgaacccgtacgaggtacggtcggacctaagtaacgtacgacgtaacgagtaacgtttcggacgggtcgacgggttaccaccgacgtcgaccggtggacgccgtcacgtcgacgtaccaactacgtactagtagtcggagtcgtagacggcgggtacctacggaccgtacggacgacgaaccgtagtaccngttactgtacgngaggtcgtaggtacgtgtgacgttcgcgactcggctcggngtacgg

SEQ ID NO: 99825 - DNA, 660 bp, Homo sapiens
  misc_feature: GYAE6OF02IODMQ.40.81.H04.1.454.CMB.1.raw
  modified_base (398)..(398): a, c, t, g, unknown or other
  misc_feature (398)..(398): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcgaggacgcccactcccgaggtgcagtcgtggtgcagtcgtggggctggaggtgaagagccgtgggcctcggtagacggtctcgtgacaagtactttcgacggaaacctcctgacgcaactactacactacagtacggatcggacgtaccgaccggcccgtaggacggtagggttagaggtggtagtggggtagtacttccaacccgtacgaggtacgggtcgaaccgaagaacgtanaccgaacgtaagtaaccgttcgaagggccaaacgggtccaacggtacgtacggtaccggtacgggccgtacgtccgatacgacgacacacgttactaacgtacggtacgtacgtacgttaggacgtaccggtacgtaccgtaccgtcgtacgaaccgaccgaccgaccttagtacgttacgtacggtttaggaacggaacggtacggtcgtttacgggacgttacgggcggtacggtccgaacggaccggtgggtacccggg

SEQ ID NO: 99826 - DNA, 669 bp, Homo sapiens
  misc_feature: GYAE6OF02JC55J.40.81.H04.1.454.CMB.1.raw
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
  modified_base (339)..(339): a, c, t, g, unknown or other
  misc_feature (339)..(339): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccagggtgccagctggtgcagtcgtggggctggaggtgaagaagccgtggggcctcggtgaacggtctcctgcaagtatttctaggaaaccnccctgagcaactactacatacacgtggatgcggacncggccccgtaggacgtaggggtttgaggtggagtggggngactcaacccgtacgaggaggtgacaacgaagtatacgacacggtaacttcggaggcgacgggtaccacgtacgtacggaccgttacggggccgtaccggtccaacgtccgacgacccgaacgtacgttacctaacggtagttacggtactcgtaacggacgggtacccggtactacccggtaccgttacggaccggaaccgtaccgaccgggtaccctaaggttacgttagtaccgttagtaagggaacggtacggtaggttcgggtacggtacccggtaccgggtacggggtacctccggaaccggtacgggtcggggtaaccccggg

SEQ ID NO: 99827 - DNA, 683 bp, Homo sapiens
  misc_feature: GYAE6OF02HQ2O6.40.81.H04.1.454.CMB.1.raw
  modified_base (325)..(325): a, c, t, g, unknown or other
  misc_feature (325)..(325): n is a, c, g, or t
tcagtctagcgactcacgaccggtgctcgatttagtagtgtagattcgcgggggtgccctgagagcatcacccagcaaccacatctgtcctctagagaactcccctgagagcctccgttcctcaccatggactggacctggaggatcctcttcttggtggcagcagccgacaggacgcccactcccgaggtcgcagctggtgcaggtcgtgggctgaggtgaagacgcgcgggcctggagtagtctctgacaagtatttcgacggaaccaccgagacgactaactactacaactacactaggatcggcggacgaccggtccccgngggtacgttaggggttcgagggtaggagggttacggggtggtaacctacccgtaacccgaacgtacgggtaggacggaacgaaaacgtaaaggtacaccgtaacgaacgttaacgttacgggacgggacgtacggtaccacgtaggccggtaaacccggtcgggtacctaccgtccgtaacttacgacgtaaccgtaacgcgtaacctacgaagttccgggtaagttccgtaggaaccggacgtacgtacggtaccgacggtcgaaaccggtacgacgtccgttaaggtccttaacggtgaacggttaagggaccgtagttacgggttcgacggttccggacggttcggacgtaccgg

SEQ ID NO: 99828 - DNA, 845 bp, Homo sapiens
  misc_feature: GYAE6OF02IKEB6.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcgttggtggcagcagccgcaggagcccactcccgaggtgcagctggtgcagtcgtgggctgaggtgaagaagccgtgggcctcggtgaaggtctccgtgacaagtacttttacgacggaaaaccctacccgtaggacggtactaaaccttaacgttacaacttaaccgtaccgtagggtaacttacggccgggtaccgaccgggtccccgtaggggtaacggtacgggggggttttacgacgggtttaggggtaaggttcgggggggttacggaaccgttacccgtaaaccccgttaaccggaacgggttacggggtacggtaccgtaaaccggtaaaacgggttacgtaaccggaaaccgtaacggttaaaaccgtttcgggaacggggtaccgtaacggggtccctaaaccgtaggttacggtaaacccgttgggggaaccccgtaccggttaacccgtaacggttaaccggtaaccggtactaaacccggttaacggttaccgttaaccgtaacggtttaaccgggtactttaccgggtacgggtaccgggtaccgggtaccgtaaccgggttaccccgttacggtacccgggtaaacccggaccggttaacccgggtacccgttaaacgttacgggttttacccgttaaccggttaagggg

SEQ ID NO: 99829 - DNA, 851 bp, Homo sapiens
  misc_feature: GYAE6OF02IP20Q.40.81.H04.1.454.CMB.1.raw
  modified_base (194)..(194): a, c, t, g, unknown or other
  misc_feature (194)..(194): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtgcagcagccgcaggacgcccacctcccgaggtcgccagcgtggtncacggttcgtcggggtctgggtagggtaacgaagtaacggcccgtcgggggtcccgttaggggttacggtaacggttcctaccgtggaccgtaaagtacgttttaccgtacgggtaaacctacccgtaggtaacgacctaaaccgttaacctactaacttaaccgacgttggtaacgtcggaccgggaccgtaaccgggtcccggtaacgggtaccggtaacggggttttacgggaaggttacggggtagggttacgggggttaggtaccgttaacctaaccccgtaacgtacggtacggggtacgtaccgtaaacgtaaaggtactaccgtaacgtaacgttaacgttacggacggtaccggtacgggtaccacgtaggtacgtaaacccggttcgggaaccctccgggtaactacgtacggacggtaacctacgtacggttaactaacgtacttacgggtaaactcggttacgtacggccgggtttaacccacgggttaacccgttaacgggtcggtaaaccgttaccggaccgtaaaccgtaggttaccttacgttacggttacggtaacggtaacgtagggttacccggttaagggttccggtacccggaacgggttcccggtagtacccgtaccgggcgttaacccgggggg

SEQ ID NO: 99830 - DNA, 755 bp, Homo sapiens
  misc_feature: GYAE6OF02JLSJT.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatgctctgggtctctggatccgaggtggggatattggtgatgactcagtctccactctcccgtgcccgtcacctcctggagacgccggcctcatcctcctgctaggtctagtcgagacgccctaccgtaaaacactaagtggaactactacttcttagtaattcggtacctgcagtaaacgccgtaacggcgtaacgttccgtaccgaacgtacggtcctttacgtttagaaacgttttaagttacggtttgggggtttacctttaacgggttccgggggtaccccgttcccggggggttaccctggtaaccggttacgggttacgtacgggttcggacgtagggttaggacttacgacgtttacgaacgtagtttaacgtttaacgtaacttaaacgtaaaactcggacgtacgggttaggggtaacgggtacggacgtaaagggtaacggttagttaggggttaacgttaacggttttaactaccgttagtacgttaagtcgtaaacctaaccgttcgtaaacgttaaacgtggtacgtcgggtaccggtaaccggaccggtaaacgggaaccgtaaggggtaacgtaaacgttaccgaacggtacgtaaccgtgtacggtacgtaccgtacccg

SEQ ID NO: 99831 - DNA, 643 bp, Homo sapiens
  misc_feature: GYAE6OF02IIOAW.40.81.H04.1.454.CMB.1.raw
  modified_base (154)..(154): a, c, t, g, unknown or other
  misc_feature (154)..(154): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
tcagtctagcgactcacgaccggtgctcgatttagtagtgtagattcgcgggggagcatcacccagcaaccacatctgtcctctagagaatcccctgagacgctccgttcctcaccatggactggacctggagatcctcttcttggtggcagcngccgcaggagcccactcccgaggtgcagctggtgctagtcgtggggctggaggtgaagagccgtgggcctggtgaaggtctctgacaagtntttcgaggaaacncctgancgaactcgacatacacgtggatcgcgacgacgcccgtggacgtagggttgagtggacgtggggtagtactacgtaacccacgtagaggtcgacgaactaaaggtactcgaagtagtaaccttgaacgggcgtacgggtacaacgtcgtacgaccggtgggtacctccggacctaacggtccaggtcccaagtacgtacttaacgagttcggaattcgagaacggcgttctaccgacgttcgacggaccgtagaccggtacaagttacgtaccgttagtacggtacggaaaggtaaccgttccgggttggacccggtacgtttaccccgggggacggttccggttaacccgaacggtttccgggtacggggaaccccggg

SEQ ID NO: 99832 - DNA, 797 bp, Homo sapiens
  misc_feature: GYAE6OF02GYRXL.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaacgccgtggggcctcggtgaaggtctccgtgcaagtatttctaggaaacaccccgtgacgcaacttactacaactacaccgtggtatcggccgggaccgaccgggtccccgtagggaccgtaggggggttttacgagggttcgggtaggttgggggttacgggtaacgttaacccgaaacccccgttaaccggaaacgggtacggggttacgggaccctaaaccggaaaaacgtttacgtaacccggtaaccgtaaaggtaaacccgttttacggaaccgggggtaccggtaacggggttaccgtaaacccgtacgttacggtaacccgggtggggtaacccggtccgttacccgtaacgtcgtaccggtaccgaacgtacggttaacctaccgtaggttacggtaacttcgtacgggtacggccggtaacgttccgtaccgttacgtacggtaccgaacccggacggtaccctagttacgtacgtttacggtaggtaacggaaggttaacgggtcggtttacgggccggttaccggtacccggggtgggtacccgttacggacccggtaacggtaccccggggg

SEQ ID NO: 99833 - DNA, 627 bp, Homo sapiens
  misc_feature: GYAE6OF02HBWT9.40.81.H04.1.454.CMB.1.raw
  modified_base (549)..(549): a, c, t, g, unknown or other
  misc_feature (549)..(549): n is a, c, g, or t
  modified_base (584)..(584): a, c, t, g, unknown or other
  misc_feature (584)..(584): n is a, c, g, or t
  modified_base (612)..(612): a, c, t, g, unknown or other
  misc_feature (612)..(612): n is a, c, g, or t
  modified_base (619)..(619): a, c, t, g, unknown or other
  misc_feature (619)..(619): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcgttggtggcagcagccgcaggacgcccactcccaggtgcagctggtgcagtcgtgggctgaggtgaagaacggccgtggggtcccgtcgggtacgaaggtcctccgtggacaagtatttcgaggaaaccaccctgacgacaacctactacactacacgtaggatcgcgggcgacggccccgtgggacggttggggtttaggagggtggaaggttcgggggtacggtaccgtacccgaacccgtaccggaaggtacggcggtacaagtaaacggttataccggaacgacgttaaaccgttcggagggtaccgacgggtaccgaacacggtacgtaccggtagggaccgtcgtacacgtccgagaccacacgttaccgacgtacgtcggtactcgtacggaccggcggnggtaccgggccgaacggactagaacgtcgcaagtngcgtacggtaacgagctagtcagcgtgngccgtangacgtagg

SEQ ID NO: 99834 - DNA, 850 bp, Homo sapiens
  misc_feature: GYAE6OF02IHV6C.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttctcaccatggactggacctggaggatcctcttcttggtggcagcagcccgcgaggacgccccacctccccgaggtcgccagctggtcgcgagtcgtgggctggaggtagaagacgccgtggggccgtcggtagaacggttcctccgtcgacgtaagtactttcgtacggaaaccctaccgtacggaagacctaaacctacgtaacctaacgtaacctaccggtggtacgtacggcccggaccgaccgggtaccccggtgggtaccgggttagggtttcgagggtacggtagggtacggggtagtaccgtacccgtaaccgtaccgtaaggacggttaggaaccaaacgtaaagtccggtacgaacgtaacggttaccgttaccggaacgggtaccgtaccgggttaaccgaccgttaacggtaccggtaccggtacggggtaaccggtccgtaccccgtaacgtaccgtaccggaccgttaaacctaccgggttaccttaacggttacgtaccggtaacgttcggtaccgggaacggtaccgggtaaacccgttccgtaaccggtaccggtaaccggaacccgttaccggacccgggtaactaccgtttaaacgggtcccgttaagtcgggttaacggaacggttaccggtaacggttttccggggcggtaaccccggttccgggtaccggggtaccctttaccgggaccccggtaccgggttaaccccgggtaacccgggg

SEQ ID NO: 99835 - DNA, 790 bp, Homo sapiens
  misc_feature: GYAE6OF02FINZ4.40.81.H04.1.454.CMB.1.raw
  modified_base (272)..(272): a, c, t, g, unknown or other
  misc_feature (272)..(272): n is a, c, g, or t
  modified_base (291)..(291): a, c, t, g, unknown or other
  misc_feature (291)..(291): n is a, c, g, or t
tcagtctagcgactcacgaccggtgctcgatttagtagtgtagattcgcgggggagagcatcacccagcaaccacatctgtcctctagagaatcccctgagagctccgttcctcaccatcggactggacctggaggactcctcttcttggtggccagcagccgcaggacgcccactccccaggtgcctagctggtgcagtcctggggcttggagtcgaacgacgccctggggtccctcggtagaacgggttctccgttacgcctaaacggtntttacgtacggaaaacccncccgttacgacgcctaaacctacctacgtactaaccgaccgttcgaacgttacgccgggtacaaccggtccccgtaggtaacccggtaaggggttttccgaaggttcgggaacggttcggggtacgtaacgttacccgaaaccgttaccgacggtaggtccggtaccaacgtaaacggtactaccggaacttacgtaaaccgtttcggacgggtaccgtaagggttcccaaccgtactaccggaccgttacgggtaccgacccgttacccgaagttaccgagtaccaaccgtacggttaccaccgtacgtaccgggtaacttcggacgacgggtaccgacgttccggtaacctaccgttacggaccgaaccctaaccgggtcctagttacgttacttacccgtaggtaacggtaacggtaccggtaccggtttaagggtcccgttacccgggtaacccgggtccggggtaactcccgggtacccttaccgggaaccggg

SEQ ID NO: 99836 - DNA, 782 bp, Homo sapiens
  misc_feature: GYAE6OF02HODK0.40.81.H04.1.454.CMB.1.raw
  modified_base (124)..(124): a, c, t, g, unknown or other
  misc_feature (124)..(124): n is a, c, g, or t
  modified_base (736)..(736): a, c, t, g, unknown or other
  misc_feature (736)..(736): n is a, c, g, or t
tcagtctagcgactcacgaccggtgctcgatttagtagtgtagattcgcggggtgatcaggactcctcagttcaccttctcacaatgaggctccctgctcagctcctggggctgctaatgctcngggtctctggactccgaggtgggattagttgacggatcgactcagttcctccactcctccctcgcccgtcacctccgtaggacgacgcccgcctccactcctctcgccgtagtactacgacgacgcgaccttacctaaaccaatagtaggactacctacttcgttagacgttacggtacctgacaaggaacgccggaagggcctaacgttcccgtacccacgtagttccgttaccgtttagactttaaagggtttacgttttcggggtttaccttacggggtcccgggtccccgttcccggggttccctacggtaaccgttaggtccgtaggtcggacgtacggtagtaccgtacgtcgtaacgcgtttaaacgtttatttaaaccgtaaacgttaacgtaaaactacggaaacggtacgggtaagggttacgggaaggtaacgtaagggtaaagtttcgttagggtttaacggtttaatttacgttaacgtcgttagtaaccgttacgtaacctaaaccgtttacgtaaacttaacggttacggaggttaccggggtaaccgtccggtaaaccggaacgggtaacgggtaaacgggttaacggtaaaacgngtaaaccggacgttaacgggcggttagaccggtcgaacgttacccg

SEQ ID NO: 99837 - DNA, 807 bp, Homo sapiens
  misc_feature: GYAE6OF02JU0BA.40.81.H04.1.454.CMB.1.raw
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccctacctcccgaggtcgccagccgtgggtgcaggtcgtggggctggagggtgaaaggaacgcccggtggggccttcggtgaacggtcctccgtgacgaagtacttcgacggtaaaccncccgtggacgacaacgttacctactaanaaaaccgttggagttacgaccgggaccgaccgggtccccgtagggtaccggttagggggtttagacggtagggtacggttcgggggttgaaccgttacccgaaacccgttacgacggggcggttaccgggactaaacgtaaacggttacgaacggtaaccgtaacggttaacgtttacgggaaggttaccggacgggtaccgaactacggtaccggtaccggtacgggcccgtacggtccgaactacgtacgaccgtaccgtaacgtcctaaccgtagtaccggaattcgacgggtacggaccgggttaacgacccggtaccgttaccgggacggtaacccggaaccggttaacgcccgttaaggttacgtacccgtacggtacgggttacggtaagttaccggggtacggttacggggtacgggttacgacccggggccgggggtttacaccgggtaaaccggtccggggtaacggacccgggtaaccccggg

SEQ ID NO: 99838 - DNA, 709 bp, Homo sapiens
  misc_feature: GYAE6OF02HJ2NS.40.81.H04.1.454.CMB.1.raw
  modified_base (580)..(580): a, c, t, g, unknown or other
  misc_feature (580)..(580): n is a, c, g, or t
  modified_base (606)..(606): a, c, t, g, unknown or other
  misc_feature (606)..(606): n is a, c, g, or t
  modified_base (632)..(632): a, c, t, g, unknown or other
  misc_feature (632)..(632): n is a, c, g, or t
  modified_base (658)..(658): a, c, t, g, unknown or other
  misc_feature (658)..(658): n is a, c, g, or t
  modified_base (685)..(685): a, c, t, g, unknown or other
  misc_feature (685)..(685): n is a, c, g, or t
  modified_base (703)..(703): a, c, t, g, unknown or other
  misc_feature (703)..(703): n is a, c, g, or t
tcagtctagcgactcacgaccggtgctcgatttagtagtgtagattcgcgggggtgccctgagagcatcacccagcaaccacatctgtcctctagagaatccccctgagagctccgttcctcaccatggactggacctggaggatcctcttcttggtggcagcagccgcaggagcccactcccaggtgcagctggtgcagtccgtggggctgaggtgaagacgccgtggggcctcggtgaacggtcctaccttgcaaagtagtttctacgggaaaacctaccccgtgacgaccaaaccgtaacctaacaactacctaacgtcggaagttcggaccggtccgaaccgggtccccccgtagggtaaccggtagggggttttacggagggttacgggtaggttcggggggtaggtaaccgttacccgaaaccccgttaaccgaagggtaacgggtacgggacccgtaaaacgtaaacgggttaactaaccgaaccgtaacggtaaaccgttttacgacgggtacgaaccggggtacacccgaacgttacgaccgggtcgggaccgtaccgtccgactccgacncgtaaccgagttacctagagtacggntacgtacgagcgggtactacgtaccncgtacgcgtaacgacgccagtacgtntaacgtggtaaggacgaggtcgttggnggttaccgcggtacgggntaccgg

SEQ ID NO: 99839 - DNA, 907 bp, Homo sapiens
  misc_feature: GYAE6OF02HY41Z.40.81.H04.1.454.CMB.1.raw
  modified_base (851)..(851): a, c, t, g, unknown or other
  misc_feature (851)..(851): n is a, c, g, or t
tcagtctagcgactcacgaccggtgctcgatttagtagtgtagattcgcggggactgatcaggactcctcagttcaccttctcacaatgagctccctgctcagctcctggggctgctaatgctctgggtctcgtggatccaggtgggatattgtagatgactcgagtcctccactcctccctcgcccgtcacctcgtaggacgacgcccggtcctacactccgtccgtgacgtacggttacctagtcgaacgtaccgacccttaacctaaaacgtacgttaagtcggtaaactttaccgtacgtttacttacggttaaactttaccggtaacccgtcggtaacgtaacggaaccggtccccggtaagggaccgttacggttacctaaccggtacgtacgttccgttacgtttagtaacgttttacggttttacgggttttccggggttaaccttttaccgggcccgggggttaccccggtttccccggggtacctacgggtaacggtttacgggttacgtaggggttaccggtaacgttacgggttcggtaaccttaccgtacgttaccgttaaaccggttagtttaaaccgttttaacgaaccgttaaagtaaaccggtcgtaaacgggtacgggttacggggtaacggtaacgaaaggttaacggaaacgttggggtttaacggttttaaagggttaaaccttttacggttacgtacggttaacgttacgtacccgttaaaccttaacccgtaagtttaaacccgtaaaggtttcgtaaccgggggttaccgggtaccggtaaccgggtaaaccggaaacggggttaccgtaaaggggtaaaccggtanaaacccgggtaccggtaaacggtttcgaacggggtttacgccgttacccgtaaccg

SEQ ID NO: 99840 - DNA, 645 bp, Homo sapiens
  misc_feature: GYAE6OF02IF2HC.40.81.H04.1.454.CMB.1.raw
  modified_base (87)..(87): a, c, t, g, unknown or other
  misc_feature (87)..(87): n is a, c, g, or t
  modified_base (319)..(319): a, c, t, g, unknown or other
  misc_feature (319)..(319): n is a, c, g, or t
tcagtctagcgactcacgaccggtgctcgatttagtagtgtagattcgcgggcacgaccggtgctcgatttagtagtgtagattcgnggggagagcatcacccagcaaccacatctgtcctctagagaactcccctagagacgctcccgttcctccaaccagtggactggacctggagatcctcttcttggtgcagcagccgcaggacgcccactcccaggtcgcagctggtgcagtcgtggggctgaggtagaaggaacgccgtggggcctcggtagaacggtcctaccgtgactaaagtattttacgaggaaaaccncccgtgaacggacctaaccttaactacaacgttaacacgttaggaactcgccgggaccacggcccctggggaaccgtaggggtttagagtggaaggtggggtacgaactacccgaaacccttacgaggtacgggtacgaacaaacgtaaaagtactaccggaactaacggttaacttcggagggtacgtaacgggacaaccgtagtacgacggtcgggacctcgaccgaacgtcgaacgcgaacctaacgtcctaagacgttagaatccgtagaacggtcggaactcgacgccgtagaccgagtacgactaggtattcgtagtagg

SEQ ID NO: 99841 - DNA, 707 bp, Homo sapiens
  misc_feature: GYAE6OF02GV5M4.40.81.H04.1.454.CMB.1.raw
  modified_base (273)..(273): a, c, t, g, unknown or other
  misc_feature (273)..(273): n is a, c, g, or t
tcagtctagcgactcacgaccggtgctcgatttagtagtgtagattcgcggggtgccctgagagcatcacccagcaaaccacatcgtgtcctctagacgaatcccctgagagctccgttcctcaccatcggactcggacctggacggatccttcttcgttggtcggcagcacgcccgcgaggacgcccacgtcccgaggtcgcagcgttggtcgacgtagtcgtggggctggaggtacgaagacgccgtggggcctggtgaacggtcctacgngcgtaagtacttcgtacgaaacctacctagggggggggacacctaacgtactactactaactacgttacggacgtcggacggtccgaccggtaccccgtacgggtacgggtacggggttcggtacggtacgggtacggttacggggtacggtacgtaccgtaacccgtaaccgtaacggtacggtacggacgaacgaacgtaacgtacgaacgtacgtacgttcggtacggtacgtcggtaccgacgtacgtacgaccggtacgggacgtccgtactacgtacgacgactacgtacgtacgtagactacggcgtacgcgtacgaccgtacgtcgtacgtacgtacgaccgtacgaccggactacgtacgttacgttaagtacggtaagtacgtaggttacggttcggtcggtaccggtacggtccggtcgtacg

SEQ ID NO: 99842 - DNA, 685 bp, Homo sapiens
  misc_feature: GYAE6OF02GGKSW.40.81.H04.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggtacgcccactcccaggtcgcaagctggtgacagttcgnggggcctaggaggtgaaagagccgttggggccctggtagaacggttctaccgtgacaagtgttcgtgaaacctacctgagacaactacgtanatacncgtagatgccggcacggtccccgaggtacgtagggtttcgaggtaggtagtaggggtgtacgtaccgaaccctacgaggaggtacggacgaacgtaaagtcgtaaccgagtaacggtaacttacggtaacgggcggtaacgggtacaaccgtagtaccggtacgtacgggtacgtaccgaccgtaacgtacccggaaggtacccgacgttaccggtacgtacgtaacgtcgggaacttcggtacggtcgaccggaagttcccgtaacgtaccgtacgggaacccgtaacgggccgtaccgtagttaccgtattccggagttaaaccgagttccggacggttaggtcgtaacgtcccggtagggcctcggaccgttacggaccgggg

SEQ ID NO: 99843 - DNA, 642 bp, Homo sapiens
  misc_feature: GYAE6OF02JY6M7.40.81.H04.1.454.CMB.1.raw
  modified_base (531)..(531): a, c, t, g, unknown or other
  misc_feature (531)..(531): n is a, c, g, or t
  modified_base (585)..(585): a, c, t, g, unknown or other
  misc_feature (585)..(585): n is a, c, g, or t
  modified_base (591)..(591): a, c, t, g, unknown or other
  misc_feature (591)..(591): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagtccactcccaggtgctagctggtgcagtcgtggggctgagggtgaagaagccgtgggtcctcggtgaaggtctcctgacaagtacttcaggaaccacctgacgactaacgtactaacatacgactacggtatcggacggccgtacggaccccgttaggacggtaggggttcgtaaggtcgggtaggttaggggtcggataccgaaccgtaccgacggtacggtcggtacgaacgtaagtacgtacggaacgtaacgtaacgttacgagggacgtacggtacacgactcgggaacccgttggggaaccgcgtaccgtacgtcgaaacgtcgaactacgtgtaactggtccggtaactggtaacggnggtacgggtaccaggtccgagtacggacctagaccggtcgattacgcgttacgnggtaanacggtacgtcgggtagtccgtagtccggacggtacgtgaaccggtgtcggg

SEQ ID NO: 99844 - DNA, 690 bp, Homo sapiens
  misc_feature: GYAE6OF02FUNNB.40.81.H04.1.454.CMB.1.raw
  modified_base (504)..(504): a, c, t, g, unknown or other
  misc_feature (504)..(504): n is a, c, g, or t
  modified_base (536)..(536): a, c, t, g, unknown or other
  misc_feature (536)..(536): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgagggtagaagaacggccgtacggggcctcggtaggtaaggtcctccgtagacaagtagtttcgtacggaacctaccctaggacacaaccttaacgtaactactaccacgtaggtagtcggtcggaccggtacggtccccgtaggaccggtaggggtttacgaggtgggtggtaggggtacgactaccgtaacccgtacgaggtacggtacggacaacgtaacgtacgtaccgtagtaacgtacgtttacggacggcgtacggtacctacgtacgacggtaccggtacgggacgtaccgtcacncgtacgacaccgtataccgtacgagttacggntacggacggtcgaccggtcgtaacgtccgtacggacgtacgaccgtacgccgtagttacgtattacgtacgggttacggaacgtacggttacgggttggtaccggtcgttaccgggcggtaccgtaccggtccggacgggtcccgggtaaccgg

SEQ ID NO: 99845 - DNA, 709 bp, Homo sapiens
  misc_feature: GYAE6OF02HSMDT.40.81.H04.1.454.CMB.1.raw
tcagtctagcgactcacgaccggtgctcgatttagtagtgtagattcgcgggggagcatcacccagcaaccacatctgtcctctagagaaatcccctgagagctccgttcctcaccatggactggacctggagatcctcttcgttggtggcagcagccgcaggagcccactcccgaggtgcagctggtgcagtcgtgggctgaggtgaagaagccgtgggcctcggtagaacgtctcctagacaagtatttcgtaggaaacctaccgtagagactaactacgtacaatacacgtagtacgtcgcggacacggcccgtaggaccggtaaggggtttcgaggtcgggtaagtggggtgtaacgttaccgaaacccgtacgaggtacggtcggaacaaacgtaaagtcgtacgtaacaagtaacgtttcgaggacgtagtacgactacgtacgacgtaggaaccgcgtacgacgtacgaacgacaacgacgtaaccgtaactagacgtacgtacgtacggaacggtacgtccgtaaggtacccgtacgtacgtaaccggaacgacccggaacgtagttacgtaacgtttacgggttaaggaacgggtaaacggttaacgggtccgggtttaagggtaccggtacccgggttaccgggtccggggtaccgttaacccggaaccggtccgggggtacccggtaaaccccggggg

SEQ ID NO: 99846 - DNA, 863 bp, Homo sapiens
  misc_feature: GYAE6OF02IRILQ.40.81.H04.1.454.CMB.1.raw
tcagtctagcgactcacgaccggtgctcgatttagtagtgtagattcgcggggactgatcaaggactcctcagttcaccttctcacaatgagctccctgctcagctcctggggctgctaatgcttcgtgggtctcgtggactaccgaggttgggggactagttcgtggattcgactctacgtcctaccaccttctccctcgcccgtactaccgttccgtcgggacgccgcccgggtccttaccgtacttcccgttccgtacggtacgtacggttacgtacgtaccgacggtaccgtaccctacctaaaacgtacgtaagtcgtactaccgttaaccgttcgtttagtaaacgttcggtaccctagactaaggacgtcggtacgggtctaccgttccgacgacgtacgtcttcgtatagtacttggttcggttacctaggtccggtcgttccgggtacctgacgtacggttcacggtaggacctggtagactacgtacgtaccagttaacgttaactttacaacgttaaacggaaacgttccgaagggtaccggtaggggtaaccggtaacgtaggtaagggttaaattacgggtttacgggttacggttttaaaccttttacgggtaaccttagggtacccttaaaccgggtacaaccccggtttaaacctttaaaccggtaaaacgtaccggttttaacgggtacggggtccggggtttaaacccgcgggggttttaaaacccccgggaaacgggggtttaaccctaaaaagggggttaaccccgtaacggtttaaaccggttaaacgggcccgggttttaaaccgtggggtaaccccgggtttacggccgttaaaccccgg

SEQ ID NO: 99847 - DNA, 712 bp, Homo sapiens
  misc_feature: GYAE6OF02GSB3Q.40.81.H04.1.454.CMB.1.raw
  modified_base (157)..(157): a, c, t, g, unknown or other
  misc_feature (157)..(157): n is a, c, g, or t
  modified_base (336)..(336): a, c, t, g, unknown or other
  misc_feature (336)..(336): n is a, c, g, or t
tcagtctagcgactcacgaccggtgctcgatttagtagtgtagattcgcggggtgatcaggactcctcagttcaccttctcacaatgaggctccctgctcagctccgtggggctgctaatgctctgggtctctggatccgaggtggggattagttgngatgactcgagtctccactcctccctcgccgtctacctccgtagggagacgcccggtcctccactcctcctgcgtacggtctacgtcaggactcccgacctaaaacacgttaagtaggactactacttcttagtacgttcggtacctagacgacgacgtacgagggcacgtcaccacgntccttgttagtaatacgtttaggttccggggttacttaccggtccgggttcccggttacccgggttcctacggacgttacgggttgacgtcggacgtaggtcgtaactacgtacgttacctaagtacgtttaacttttaacgacgtaaagtaaaacgtcgaacggtaacgggtagggagggtaacggtaaggaagtaacgtaggttacggttacggttaagtttctagtcgtatacgtcgaacccttaactacgttaaacggtatgggttagtacggggtaccgtacgggacggaaaccgggtaacggtaacgggtaacgtaaacgtacgaacggtcggttaaccggtcgggttaccgacggtaccgacctaaccg

SEQ ID NO: 99848 - DNA, 684 bp, Homo sapiens
  misc_feature: GYAE6OF02FURHH.40.81.H04.1.454.CMB.1.raw
  modified_base (304)..(304): a, c, t, g, unknown or other
  misc_feature (304)..(304): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccagtgggatattgtgatgactcagtctccactctccctgcccgtcactccgtggagacgccggcctccatctcctgcaggtctagtcagacgcctacctaactactaatggatactactctttagaatttggtacctgacagacgccgtaggctacgtccaccanacgtcttcttagattagttaggttgggtttcttaggtcccggggtccgttcccggggtccctaggtacgtacggttctaggtttcgacgttagggtggtactaccgtacgtactaccgttaagtttaaccttttaaccgacgttaaagtaaaacttcggaacgggtacggttaaggggacggaacggtacgtaaaggtacgttagtttcgggttaggttaattttacgtacgtagtcgtagtcgtaaccctaccgttactaaacgtacgttgggtacggtacgggtaccggttaccggaaccggtaaacgggtaaccgtaacggggtacgtaaagtacccggtaagaccgtaacggttggaaccgtccgtacgtaacccg

SEQ ID NO: 99849 - DNA, 707 bp, Homo sapiens
  misc_feature: GYAE6OF02HOAZW.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctggaggtgaagaagccgtggggcctcgggtgaaggtctcctgcaagatttctaggaaacctacctgagacaactactacatactactggatgcggcacgggccccctggacgtacggggtttgagggttacgggaggttaggggggttggaacttaccgtaaacccctaccggtagggtacggggtacgggaccaaacggtaaaaaggtacgttacggaaaccgtaacggtaaaaccgttttcgaaacgggggtccgaacggggttacccaaaccggtacgtacggtaacccggttacgggggaacccggtaccggtacctaacgtacgaacggaccaaccgtacggttacctaacgaagtcggtagttccgaggtacgggtccgggactacgggaccgtacgacggaccgtaacggacgtaccgacgtacgtacgtacgtggacggtaaggacgtacgggtgtacggtacgacgggtaccggtacgacgtacccgtagggtccggg

SEQ ID NO: 99850 - DNA, 812 bp, Homo sapiens
  misc_feature: GYAE6OF02IBPVN.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagtcacgccgacaggacgcccactcccgaggtcgcagctggtgcagtcgtgggctggaggtagaagacgtcccgtggggcctcgggtagtaacggttcctccgtgacgtaagttacgttttacgacgggtaaacctaccccgttaggacgaacctaaaccttactaactaacttaaccgaccgttaggattacggcccgggaccgtaaccgggtcccccgttaggggtaaccgggttagggggggttttacgaacggggttacggggtaacgggtttacggggggttagggtaacctttaacccggaaaacccccgttaccgggtaagggtaaccggggtacggaaccgtaaacggtaaaacgtcgtaaccggtaacggtaacgtttaacccggtttacggaacggggtcccgaaaggggttaccctaaacccgtacgggttaccggacccgggttacggggtaaaccgtcccgttaccgacgtaccgacgaccgtacgtaacgtacttaacgtagtacgtaactcgtgaacgcgaacgtcgacctgacgtacgacctggacctgtactaagttcgaaggtaggaacggtacggttacgtagggtaccgaccggtacgggtccggggtactaccggaccggtacccgggaggtaaccccggg

SEQ ID NO: 99851 - DNA, 597 bp, Homo sapiens
  misc_feature: GYAE6OF02GPU69.40.81.H04.1.454.CMB.1.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagacgcctacctaaacactaatggatactactctttgaattggtacctgcagaagcagggcagtcctccacagcttcttgatatagttggggttcttagtcgggccgtccgggtcctgacnggtcaggtgnagtgatcagtcactagtatttacactagaaatcagcgagggtcggaggcagaagattaggttgggtatttatacgtgtactagtcgacctaaccgtcttaacctaacgttggttaggttacgggtaaccgggtcgggaccggaaacgggtaaccgaaagggtaaggaaactcggaacggtaccggtaacggttcgggtacggtctacggtacccgtactacgtttcgtgtttacctaccgtacgttcccgttccccg

SEQ ID NO: 99852 - DNA, 866 bp, Homo sapiens
  misc_feature: GYAE6OF02GY5CT.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaactcccctgagagctccgttcctcaccagtggactggacctggaggactcctcttcgttggtggcagccacgccgcagggacgccccaacctccccgagggttcgaccgacggccgttggggtacgcgtacggttcggtcgggggacgtgggtaaggggttaggaaaagggtaacggtcccgggtaggggggccccgtttacggggttacggaaacggtttcccgttccgtacggacgtaaacggtttactttttaccggtaacgggtaaaacccctacccgggttaggaaaccgtaacccgttaaaaccgtttaaccctaaacgtaaccgtaaaccgtacggttagggtacggttcggggaccggtaccggaccccggggtaccccggttagggggaaccgggggtttggggggtttaacgtaacgggggtagggttaacggggttgggggtaaaccgtacccgttaacccgtaaaccccgtcgggtaacgggtacggtacggtaaccgaacgtaaacgtacggtacgtaacggtacgtaacgtttacggacgggtacggtacggtaccgacgtacgacggtaccggtcggtcggtccgtaccgtacgtaccgacgacgaacgtacgtaccgtacggtacgtacgtacgtccgtacggacggtaccggtacggtaccgtacgtcccgtacggaccggtaccggaccggtacgtacgttacgttacgtacggtacggg

SEQ ID NO: 99853 - DNA, 703 bp, Homo sapiens
  misc_feature: GYAE6OF02G06FO.40.81.H04.1.454.CMB.1.raw
tcagtctagcgactcacgaccggtgctcgatttagtagtgtagattcgcgggcgtagactttgtgtttctcgtagtctcctgctcagctcctggggctgctaatgctctggtctctggatccagtgggatattgtgatgactcagtctccactctccctgcccgtcactcctggacgagcccggtctccatctccctgccaggtctagtcagacgcctacctaaacgactaatggacttactacttctttaggaacttggtacctgtcaagtaacgcctaagggcagtctcccgatagccttcgttagattagttaaggtttcggggttacttaggtccgggcccttccggggtccctgacgtaggtttacagttcggactaggtggatccgagtcaacgtagtaactttaccaagtataaacgtcaacggtcgacgggttaggaggactaaggaagtacgttgggtttaggtaacttttaacgttcgtagtccgtaagtacgtacttaacccggttactaaaccgttaaattgggtaccgttacggggtaaccgaccgggtaaaccgggtaaacgggaaccggtaaacgggtacgtaaaacgttccgaacggtaccttaaacgggtcggttccgggtaacttacgacccgtaacttacgggttcctaaccggttctttacccaccgttcccgtttaaccccg

SEQ ID NO: 99854 - DNA, 714 bp, Homo sapiens
  misc_feature: GYAE6OF02GD5AL.40.81.H04.1.454.CMB.1.raw
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccaactccccaggtcgcgacgcgtggtgctagtcgtggggctgaggtgaagacgcgtgggcctggtagagtctctgacgaatnttcgagaacnccgtgacgactaactactacactacacgtggatcggaccggtaccgaccggtaccccggttacgggaaccggttaggggggtttacgtagggttacggggtaagggtttcggggggaacggtaaccgtaacccggtaaaaccccgtacggtaacgggacgggttacggaaccgtaaacgaaaacgttacgtaaccggaactaacggttaaccgtttaacggacggggtacgacgggtaccaacggtacgtaccggtaaccggtaccgggaccgtaccgtactagtaccgacgacgacgtacgtactacgtaggtacgtacgtcgtaggcggtacggactacggtactacgcgaccgacgcgactaggtactagtcgtaggtacgaggtacgttaaggtccggtaggtacccgttccgggacgtccggtacgacccggtagggcccggtaacgggg

SEQ ID NO: 99855 - DNA, 851 bp, Homo sapiens
  misc_feature: GYAE6OF02GHYEC.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagcgtggtgctagtcgtggggctggaggtagaagagtccgtggggccgtcgggtaggaacggtcctccgtgacgaagtacttttcgtacggaaaacccacccgttaggacgaccaaaccttaaccgtaactaacttacaaccgttggattacgggccgggacgaccgggtccccccgtacggggtaaccggtagggggggtttttaggacgggttggggtaaacgggttcgggggggtacggtacgtaacccgtaaaaccccgttacccggaacggtaggggtacgggaacctaaacgtaaaacggtaacgtacggtaacgtaaacggttaaaccgttttacgggaaggggtaccggtaacggggtaccaaccgtaacgttacgggacccggttaacggggacccgtaccggtacccgagttacccgaaggtacccgtaacgtaacgttccgtaaacgtaccggttacgggtaacttcggtaacgggtacggaccgggtaccgtacggttacccgtacggtccggtaaacgaaccggacccgtacgtacgttcgtaacgtttcgtacggggtaacggaacggttaacgggtaccggtttggggtaccgggtaccggttacccggggaccggggtacccggtacgtacccgggtacggtaaccccgggggg

SEQ ID NO: 99856 - DNA, 720 bp, Homo sapiens
  misc_feature: GYAE6OF02HT5SV.40.81.H04.1.454.CMB.1.raw
  modified_base (206)..(206): a, c, t, g, unknown or other
  misc_feature (206)..(206): n is a, c, g, or t
  modified_base (645)..(645): a, c, t, g, unknown or other
  misc_feature (645)..(645): n is a, c, g, or t
  modified_base (667)..(667): a, c, t, g, unknown or other
  misc_feature (667)..(667): n is a, c, g, or t
tcagtctagcgactcacgaccggtgctcgatttagtagtgtagattcgcgggcacgaccggtgctcgatttagtagtgtagattcgcgggagagcatcacccagcaaccacatctgtcctctagagaactcccctgagagcctccgttcctcaccatggactggacctggagactcctcttgttggtggacagcagccgcaggacncccactcccgaggtgacagcgttggagccgagtcgtaggggtctggaaggtacgaaagaaccggcccggtacggggtccgttacgggtacgaaacggttctccgtacgacgaagttacgtttacgtacggaaaacctacccgtaggaacgacctaaacctaactaacgtaactaacctactaagggtagcggtacgggaccgaaccggtcccgtaggaacggtttaggggttacgaggtacgggaggttacgggggtcgtaacgtaccaaaacccgtacgaagggtacggtacgggacaaacggaaagtttacgaacgaacgtaacgttaaacgttacggtaacgggacggtacggtaccgaacctagtaccggaccggtacggacggttaccgcgtacgtacgacgtacaacgtacgtaactaccgtaagcggttaanccgtacgacggtaccgggtaanccgttacgttacgacggtacgaaccgtcgtaccgtagtaagttagacgttagg

SEQ ID NO: 99857 - DNA, 840 bp, Homo sapiens
  misc_feature: GYAE6OF02HN7Z6.40.81.H04.1.454.CMB.1.raw
  modified_base (248)..(248): a, c, t, g, unknown or other
  misc_feature (248)..(248): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatccctgagagctccgttcctcaccagtggtacgtcggaccgtggaggactcccttcttcgttggtggcgagcacgccgcgaggacgacccacctcccgaggtcgcagcgtttttttggngcgacggtcggtgggcgtggaggtagaaggaaacggtccggtgggggccgttcggggtaggaacgggttccgtccgtacggacgtaaggtacgttttacgtacggtaaaaccctacccgttaggaacgacctaaacctaaaccgtaacaacttaaccgaaccgttacgggtacgtacgggaccgggaccggaccgggtacccccggtacggggtaaccggtaaggggggtttacggtaacggggttgggtaacggggttaggggggttacgggaacgttaaccccgtaaaccccggttaacccgaagggtacggggtccggaacggaaacttaaaacggtacgtaaccggaacgtaaacggtaaaccgtttacggaggggaccggtaacgggtaaccgacctaacggtacggtaccggtacggggtaccgccggtaaccacgtacgaacgtccgaacgtacgttactaccggtagtaacgaccgttctacgggacggtacccggtaacttccggtaaccgttcccggtaaccggtaacccggacggtaacccgggcccgttaacggttagttaaccgtttggtaaaccgggg

SEQ ID NO: 99858 - DNA, 611 bp, Homo sapiens
  misc_feature: GYAE6OF02GHMFC.40.81.H04.1.454.CMB.1.raw
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctggaggtgaagaagccgtggggcctcggtagaggtctctgcaagtntttctggaaacnccctgagcaactacacatacactggatgcggcacggtccccnggacgtaggggtttgaggtggtacgtggggnggtactaccgtaacccctaccgaggaggtcggacaacgaaagtatacgactaagtaactttacgagggccgtaggggttaccaacctagtcgtaacggtcggggacgtccggtcaacgttcgacgccaacgagtctaacgattcggatcgtggacgcggactcgaccgtcgtacgaccgaacgaccggcacgttgtacttacgtggtaggaagtacggtacggtttcggaccggttccgaccgggtccgggtacgtaccggtaccgacggtacccgggg

SEQ ID NO: 99859 - DNA, 880 bp, Homo sapiens
  misc_feature: GYAE6OF02J0LWJ.40.81.H04.1.454.CMB.1.raw
tcagtctagcgactcacgaccggtgctcgatttagtagtgtagattcgcggggatcaggactcctcagttcaccttctcacaatgaggctccctgctcagctcctggggctgctaatgctctgggtctctggatccagtggggatattgtgatgactcagtctccacttcctccctgcccgtacactcctggagacgcccggcctccatctcctgcctaggtctacgtcacgacgtcctaaccctaaacgaccttaagttcgggaactttaaccgtaccctttcgtttaggtaaaactttcgggttaacccctgtacggtaaacgtaacgggaccccgtaaggggtacctaacggtacccttaccccgaaacgtaacggttccccttaagtttacgtaaaccgtttagttttaacggttttcgggggttttaacctttaacggttccccgggggttaccccggttttacccccgggggggtcccctttaagggacccggtttaacggggtttacccgtaggggttacccgggttaacccggttaaggttacccgggtaacgtttccgtaacggggttaacccaaccggttaaaggtttttactttttaaacccgtaaccggtttaaacgtaaaacgtaccgtaaacgggtacgggtaaggggtttacgggaacggacgtaaaggtaacggttaggttacgggtttagggttaacttttaacggttacgtacggtaacgttagtaccgtactaacccgttataaccggtaattcgggtcggtacgttaccgggttcgaccgtaacgggtaacgtaacgggtaacgtaacgtaaccggaccgtaaggtaccgttaggacgtacgttacgccgtaaccgttag

SEQ ID NO: 99860 - DNA, 825 bp, Homo sapiens
  misc_feature: GYAE6OF02JIRYG.40.81.H04.1.454.CMB.1.raw
  modified_base (189)..(189): a, c, t, g, unknown or other
  misc_feature (189)..(189): n is a, c, g, or t
tcagtctagcgactcacgaccggtgctcgatttagtagtgtagattcgcggggtgccctgagagcatcacccagcaaccacatctgtcctctagagaactcccctgagagctccgttcctcaccatggactggacctggagactcctcttcgtggtggcagcagccgcaggacgcccactcccgaggtncagcgtggtgcagtcgtgggctggagtgaagacgccgtggggcctcggagtaaggtcctacgagacgtaagtacttttcgacggtaaacctccgtgacgtacaaacgttactacactacaacgtcggatcggtcggaccgacgtaccccggtaggacggttacggggtttagacggttagggacgtgggggtaacgtacgtaacccgtaaccgttaaccggtagggtaacggtacggtaacctaaacggtaaacggttaaccgtacggtaaacctaacggttaacgtttacgggacgggtaccggtacgggtaacccacggttaacggtacccggtaaacggttacgggtaccgttcccggtaaactaccgtacgaaccgggtacctaaccggttagtaaccctaggttaccgtacggtaccgttaaggtaacggaccgggttaaccggtaccgtacggttaacccggtaacgtacccgggtaaactaaccggggtacccgttacggaacggtttaccggtttaaacctacggggtacggtttaaaacccgggagtttaacccggggttaaccgttttaccgggggtccctaacccgggtaaccccggggtttcgggaaccctttaaccccggggg

SEQ ID NO: 99861 - DNA, 859 bp, Homo sapiens
  misc_feature: GYAE6OF02GGGM7.40.81.H04.1.454.CMB.1.raw
  modified_base (295)..(295): a, c, t, g, unknown or other
  misc_feature (295)..(295): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaagaacgccgtggggcctcgggtgaaggttcctcccgtgacgtaaaggtnttttaccgtagggaaaacctaccccgttaggaacggacctaaaccgttaaccttaacaacttaaccgtaacgttagggaacttgggccggaccgaccggggtaccccccgtaggggtaaccgtaacgggggggttttacggaggggttacgggtaaggttgggggggttacggtaaccgttacccggtaaaacccccttaaccggaaacggggttacggggttacggggaaccgtaaaccgtaaaacggttaaccggttaccgggtaaacgtaaaccgggttaaaccgtttttaaccgggaacgggggtaccggtaacgggggtaccaacccgtacggtaccggtaacccgggttacggggaaccggtacccggttacccgaacgttaccgaacggtaaccgtaaccggtaaccgttaccgttaaacgtaacggttcggtaaccgttcggtacggaccgggtccggggtaaccgttaccggtaacccggttaccggtacgggtaaacccggtaccgtaacccggggtaccttaacggttacggtttaacgttaacggttacggg

SEQ ID NO: 99862 - DNA, 747 bp, Homo sapiens
  misc_feature: GYAE6OF02HB0QA.40.81.H04.1.454.CMB.1.raw
tcagtctagcgactcacgaccggtgctcgatttagtagtgtagattcgcgggcgtagacctttgtgtttctcgtagtctccctgctcagctcctgggctgctaatgctctggtctctggactccgagtggggatattgtgatgctcagtctccactctcctgcccgtcactccgtgagacgcccgcctccattccgtcctgcgacggttctagtcagacgtcctacctaaacacttaagtcgacttacctacgttctttagtaacgtttcggtaacctgacgaaggaacgaccgtagggactagtcccctaccgtaacgacggtctttcgttagtaatttaacgtttaggtttcggggtttacctttacggtcccgggtacccggtttacccgggtccgttaagaccgttacggttcgacgttcggacgtaggtcgactcggactcgacttacgtactttaacacgtaacgtaagtcgaggtacgggtagggtacggacggtacggaagtaaggtacgttaggttagggttaacgtttacgttaacgtcgtacgttacgtaccgtaacgttaaccttacgtaaccgtaacggttcggtaacgggtaccggttaaccggggaccggaaccgtaaacggggtcctaaagggtacgtaagtaacgacggtacggtaaccggttcggtacgtacgcgtaaccgtacgttcgttaccgttccgttacgtaacgttcccgttacccgtacccg

SEQ ID NO: 99863 - DNA, 657 bp, Homo sapiens
  misc_feature: GYAE6OF02FR96O.40.81.H04.1.454.CMB.1.raw
  modified_base (315)..(315): a, c, t, g, unknown or other
  misc_feature (315)..(315): n is a, c, g, or t
  modified_base (410)..(410): a, c, t, g, unknown or other
  misc_feature (410)..(410): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccaggtggggatattgtgatgactcagtcctccactctcccctgcccgtcacctccgtggagcgcccgcctccatcctcctgctaggtctagtcagacgtccctacctaaacacttaatgacttactacttctttagaattcggtacctgacagaacgcgagggcacgtccaccganacgtcttcgtagtattagtttacggtttggggtttaccttacggtcccgggtcccggttacccggggttcctaggtacgtggtttacgaggtcgngtaggtgctactcgtactacgtagttactttacgaattaacgtaaacgtcgtaacggtcggtaggggtacgaggacgaaggtaagtggttaggtaggtttatttacgtatgactagtcgaacctaccgtatacgtaagtggtacgggtaccggtacgggtacgtaccgggaaaggtaccgtaagggtaacggtaacgtacggaacggtacgggttaacggttcgggtacggtacccgtacgaacccg

SEQ ID NO: 99864 - DNA, 641 bp, Homo sapiens
  misc_feature: GYAE6OF02J17WE.40.81.H04.1.454.CMB.1.raw
  modified_base (194)..(194): a, c, t, g, unknown or other
  misc_feature (194)..(194): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (510)..(510): a, c, t, g, unknown or other
  misc_feature (510)..(510): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctggtctctggactccgaggtgggattgtgtgtatgactctacttcctccacctccgtccctcgcccgtcncgtccgtggacgtccgcccggcctcactcctcgtgctaggtcttgacaggcctaccttaacctaactacttacgtaggtaccttaccgttacgtcttacggtaacgtttcggtactggacaacgaaccggtcgacgtcctagtcctacccgagtacgtctagtgtaagttagttacggttcggttactccggtccgggcccgttcgggctagcggttacgtcgngtcgatgtatcgctacgtnactagttactacgatanacnggacgtcggtaggagagtaacgagtacggtagttacgtagtttagtactcgtnacgacgtactaaccgacttacaccggttatcgggtacgaccgggtcgaaccgtaccgggtaaaggtaccggtaaagtaaccggaactacggtaaccggtacgtccggtacggtaactcggttacccaaccg

SEQ ID NO: 99865 - DNA, 644 bp, Homo sapiens
  misc_feature: GYAE6OF02H1LU6.40.81.H04.1.454.CMB.1.raw
  modified_base (619)..(619): a, c, t, g, unknown or other
  misc_feature (619)..(619): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggactcctcttcttggtggcagcagccgcaggagcccactcccaggtcgcgagcgtggtgacagtcgtggggctggaggtagaagaacgccgtcgggccgtggtagaaggtctcgtgacagtatttcgtaggaaccacctgacgtaccaactacaacgatacgacgtaggagtcggtacggacgaccgggtccccgtagggaccggttaggggttagacggtggtaggtggggtgactaaccgtaaccgtacgaggacggtacgaacaaacgtaagtacgacgaacgtacgtacttggacggacgtacggacactacgcgtacgtggacgtcgacacacgagacgacgtatctagagtacgtcgtagacggacgacggtactaccgtacgtccgacgtaaccgtacgaccgtatacgttagtacgtttacggaggtacgggtaagttacggtcggttacggtcggtaccgggtcgggtaccgggtntaccggaccgttacgggaaccgggg

SEQ ID NO: 99866 - DNA, 722 bp, Homo sapiens
  misc_feature: GYAE6OF02IBR0M.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcgaggacgccccacctcccgaggtcgccagtcgtggtagcagtcgtggggctgaggtgaagagccgtggggcctcggtagaacggtcctcgtgacaacgtattttcgtggaaaaccaccgtagacgacactaactaacagtaacactggatggcccggacgacggcccccgtagggacggtaggggttttacgaaggttcggaagttggggtacggtactaccgaacccgtacaggaaggtcgacgaagtaaacgagtacacgaagtactttagacggggacgaggtaccacgtaataggtaccggtacgggaccgacgtacccttacgaccgaaggtacccgaacggtacgttaacccgttaaacacggttaacgggtaacttaccgtagggtaacccgggtaccggggtacttacgggtaccgtaaccggtacggtaacgttaacgggaccggtaccgagttacgtacgtttaagccggttaaggaaccggttaggttaacggttcggttaacgccgtaccgggtcggggacttaccggtaccggtacggtgggtaacccgg

SEQ ID NO: 99867 - DNA, 794 bp, Homo sapiens
  misc_feature: GYAE6OF02I2J9W.40.81.H04.1.454.CMB.1.raw
  modified_base (138)..(138): a, c, t, g, unknown or other
  misc_feature (138)..(138): n is a, c, g, or t
  modified_base (251)..(251): a, c, t, g, unknown or other
  misc_feature (251)..(251): n is a, c, g, or t
  modified_base (372)..(372): a, c, t, g, unknown or other
  misc_feature (372)..(372): n is a, c, g, or t
tcagtctagcgactcacgaccggtgctcgatttagtagtgtagattcgcggggactgatcaggactcctcagttcaccttctcacaatgaggctccctgctcagctccgtggggctgactaatgactctgggtctcgnggatccaggtgggatattgtgatgactcgtacgtcctcctaccgttcctccccttacggccccgtctacctccggtaggaggaccgtcccggtccttaccacttccttaccgngacgtaggttacctaggtcaggacctcctaacctaaacactaagtgtactacctcgtttagttagtaacgtttacgtcctacgaacgtagaaccggacgtacgggtctacgttcacccganacgtcttcgtaagcttagtttacggtcggtttacctaggtcccggttacccggtaccgggttctacggacgttcggttacgtacggtacggtactaggttagacctacggttacgtacccaaaggtttaacttaacccgttttaacgtaacccgtaaaggttaaccgaaggtaccggtaaacggggtacggggtaacggtacggaaccgggttaagtaagttacgggtttaagggttaccgggtttattaacgttacggtgtaacggtactaccggtaaccttacgtaaccgttaaacgtacgtttacgggaggttacccgggtaggtacccgggtaaaccggtaaggggtaaacccggaggggttaaacaacgggtaccgtaacggtccgttaaggttcggacggtacgtcccggtaaccg

SEQ ID NO: 99868 - DNA, 890 bp, Homo sapiens
  misc_feature: GYAE6OF02JO3YB.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtgggctgctaatgctcgtggtctcgtggatccaggtgggattatgtagagtgactcgtagtctccacgttcctccctgtaccccgttcaccgttccgtggaacggccgcccggtcctcgacgttcctccgtagcgaggttcctagtcgacgtcgacccttaactaacgtactaagtggtaactaccgttacttctttagtaagttccggtactcggacaaggtaacgccggtagggcctaacggttcccctacccaaggtccgtctttacgttaagtacgttttaacgttaccgggtttagggggttttaccttaaccggggtccccgggttcccggttaaccccgggggttccttaaacgggtacccggtttagggtttacccgtaacggggttcggtacggttaacgggttacggggactttaaccggaccgtttacgtaaacgtttaacgttacttttaaccggaaacgttaacgtaaacggtcgtacgggtcggtgggaacgtacggtaggtaacggtagttacggtttagggttacgtttaaccgttttagtacgggttacgacgttaccggttacgtaacccgttaacctttaaacccgttaagggttaaaccggtttgttaacccggggttaacgggtacccgggttaaccggggttaacccgggtaaaccgggtaacgggtttaaacgggtaaacccgggtttaacgaaaccgggttaacgggtaaccggttaggttaccggtaccgggttacccggtaacggttaaccccgg

SEQ ID NO: 99869 - DNA, 704 bp, Homo sapiens
  misc_feature: GYAE6OF02IMMW0.40.81.H04.1.454.CMB.1.raw
  modified_base (245)..(245): a, c, t, g, unknown or other
  misc_feature (245)..(245): n is a, c, g, or t
tcagtctagcgactcacgaccggtgctcgatttagtagtgtagattcgcggggactgatcaggactcctcagttcaccttctcacaatgaggctccctgctcagctcctgggctgctaatgctctgggtctctggatccaggtggggatattgtgatgactcattctccactcctccctcgcccgtcacctcctggagacgccgcctcatcctcctgcaggtctagtcagacgtcctacctaaanactaagtggactactacttcttagaagttcggtacctgcagaacgcgagggcagtcacacagctctagatagtagttcgggttacttagtccggccgtccgggtcctagacgtacggtttacaggtcggacgtaggtacgaacgtcgaacggttccaacgtaagttacttttaacgaacgttaaagtaaacgttacgaacggtacgggtaacggggttaacggacgggaaccgtaaagggtaacggtttacggtttagggtttacggtttaaagttttaacgtttaacggtcggttaactacgtaccgtaaccgtaaccctttacgtaaacgttaaacggttcggttagggtaccggtacgggtaccggtaaaccggtaacggggtaaccgtaacggggttaacggtaaccgtaaggtaacgacggttacgttagggtaccggtacctacggtaacccg

SEQ ID NO: 99870 - DNA, 818 bp, Homo sapiens
  misc_feature: GYAE6OF02JZBUY.40.81.H04.1.454.CMB.1.raw
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctgggaggacttcctcctttcgttgggtggcagcaggcccgcaggcgacccctacctccccgaggtcgcgagtcgtggtcgcgacggttcgtcgggggcgttggaaggtaggaaacggaacggtccggtcgggggtacccggttgggtaggtaaccgggttccttacccggtacggtaccgtaaggtacgtttttaccgaacggtaaaccccgacccgtaggaacgacctaaaccgtaactaactaacacgtaacggtcggagtcggaccggaccgtacgggaccccgttaggggtaccgggttaggggtttacggagggttacgggtaaggttacgggggtacggaaccgtacccgtaaacccgtaaccggtaggggtaacgggttacgggaacgtaaacgtaaaagggttacctaaccggtaaacggttaccgttaaccgttacgggaacgggtaccggtaaccgggtactaaaccggtagtacgggtaccgggtccgggtaccgccgtaaccgaccgttaacgaccgacgtaaccgtaacgttaccgtaacgtacgtacgtaatccgtacggaggtacggaaccggttacgtccgtaacgttaccgaacccgtaccggacgtaccgtagtacggttagttacggtaaggg

SEQ ID NO: 99871 - DNA, 700 bp, Homo sapiens
  misc_feature: GYAE6OF02JP81G.40.81.H04.1.454.CMB.1.raw
  modified_base (258)..(258): a, c, t, g, unknown or other
  misc_feature (258)..(258): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccgaggtgcagctggtgcagtcgtggggctggaggtgaagagccgtggggcctggaggaagtcctcctgctaagtatttcaggaacncctagacgcaactacacactacacgtggatcgaccggcaccggtccccgtggaacgtaggggtttcgaggtcggtaggtggggtagactaccgaaacccgtacgaggacggtacggacctaaactaaggtacaccgtacgtaaagttaacgtttacggaaggcggtacggtaccaacgtagtaccgaccggttagggacccgtacgtacgactacgagtaccacgtaacgtacgtacgtagtaccggagttaccgtagaccggtacgggtctaaccgtaccgttcgaaccggtaaccgtacgtaaccgtcgttaacgtacgtttaaacctcggtacgggtaagtaacgggttacggtaacgggttcgggtccgtaaaccggttcccggggtaacgggtacccgtcccggtaaacggtccggggtaccccgtaaacccggggg

SEQ ID NO: 99872 - DNA, 840 bp, Homo sapiens
  misc_feature: GYAE6OF02HI50Q.40.81.H04.1.454.CMB.1.raw
tcagtctagcgactcacgaccggtgctcgatttagtagtgtagattcgcggggactgatcaggactcctcagttcaccttctcacaatgaggctccctgctcagctccgtggggctgctaatgctctgggtctctggactccgaggtggggatattggtagactgtactcagtcctccactcctccctcgcccgtcacctccgtggacgaccggtccggcctcccatcctccgtgactaggtcttagtacaggtacacccttaacctaaacgtaaccgtaagtaacggtacttaaccgttaccttattttacggaaacgtttccgggtaaccttcgggacgaaacggaaccggtccggaaacggggacctaccgggttacctaaccccgtaactacggtccgtttaactttaggaacttagtttacgggttttcggggtttactacggtcccggggtacccggtcccggggtcctagtaccgtacgggtttacgaggttagggactaacgggtcggtaccgtacgttaaccggtactaaccgtttaacggttaaacttttacccaaacggttacgtaaaacttccggaacggtcgggttacggggtagggaaccggtaccgttaaagggtaacgttagggtttggttaagggtttaaatttacggtttacgtagtacgtaaccgttcgtacctaaaccttaacccggtaattacgggttaacgtttggggttaccgggacccgggttacgggtaccccggtaaacgggtaaccgtaagggtaagtaaaccgttacggaacggtaaccttacgggtaacggttcggaccgtacggacccgg

SEQ ID NO: 99873 - DNA, 681 bp, Homo sapiens
  misc_feature: GYAE6OF02JJMBI.40.81.H04.1.454.CMB.1.raw
  modified_base (165)..(165): a, c, t, g, unknown or other
  misc_feature (165)..(165): n is a, c, g, or t
  modified_base (622)..(622): a, c, t, g, unknown or other
  misc_feature (622)..(622): n is a, c, g, or t
tcagtctagcgactcacgaccggtgctcgatttagtagtgtagattcgcgggggagcagtcacccagcaaccacatctgtcctctagagaatcccctgagagctccgttcctcaccatggactggaccctggaggatcctcttcttggtgcagcagccgcaggancccactcccaggtgccagctgtgcagtctgggctggaggtgaagagccgtggggacctcgggtgaagggtcctccgtaggaccgtaagtactttcgtagggaaaccctaccccgtggaacgtctaaacctacgtaaccgtattaaccgaacgttgggaaacttcggccgggtacctaacgggtcccccttgggaaaccgtacgggggttttgaaacggtcgggtaaacgtggggggtagtaacgtacctaaaccccggtcgacggaaggttcgggacctaaacgaaaaggttctacggaaacgacggtaaaaccttttcgaaccggggctaacgggttacaccgtaatcgtacgtcggtacggtcgtcaatccgagtacgaactcggtacctaacgtacgtagactcgtggacgtacgacgtacgacctgtagacgacgcgtacatcggacttacgngtggacgtagtacgtcgtacgtcgttaacggcggtacgtcgaccgtggtccggtaacgg

SEQ ID NO: 99874 - DNA, 837 bp, Homo sapiens
  misc_feature: GYAE6OF02JMWJZ.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttcctcaccatggactggacctgggaggatcctcttcttggtgcagcagccgcgaggacgcccactcccgagggtcgcagcgtgggtcgcgagtcgtggggctaggacgggtagaaaggaacggtccggtcggggccttcgggaggaacggtcctaccgtgacgtaaggttacgtttaccgtaacggaaaacctacccgtgaaccgtacctaaacctaccgtaactaactaaccgtacgtacgggtagtccgggaccgggtaccggtaacccggtccccggtagggtaaccgggttacgggggttttacgggagggtacggggtaggggttagggggttacggaaccgttaacccgaaccccgtaaaccggaagggtagggtaaccggacgtaaaacgtaaacgtaacgtaccgaaccggtaagttaaccggttacggaacgggaccgtacgggtaccgaaacccgtaggtaccgggtaccggtaccggggtaccgtaccgtaccgtagaccgacgtaacgacctacggtacctaacgtacgtacggttacgtaccgtaggtaccgggtacgtacggtaccgacccggttagtaccggaaccggtaacccggtaccgtaccgttaaggttaccgttaaggtaccgtacgggtaacggtacgtaacgggtacgggtttaccgggtaccggttcccggaccggtcggggtaacctaacccgggg

SEQ ID NO: 99875 - DNA, 664 bp, Homo sapiens
  misc_feature: GYAE6OF02GGJ28.40.81.H04.1.454.CMB.1.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (615)..(615): a, c, t, g, unknown or other
  misc_feature (615)..(615): n is a, c, g, or t
  modified_base (626)..(626): a, c, t, g, unknown or other
  misc_feature (626)..(626): n is a, c, g, or t
  modified_base (658)..(658): a, c, t, g, unknown or other
  misc_feature (658)..(658): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtcgtggggctgaggtgaaggaagccgtggggcctcggtgaacggtctcctgcaagtntttcgtaggaaaccaccgtgagacaactactacataccagtgntaggcggccgacggccccgtgggacgtacgggggtttgcggtagggtaggtgggggtagactaccgaacccgtaccgaaggacgggtggaaccgaaaccgtaaaagttacggtaccgaacgtaaacggtaaccgtttcggaaccggggacgtaacggggtaccctaaccggtaacggtaccggtaacccgggttcggggaaccctcccggttacctacgtaccgtaacggacccgtaacgacgtttaccgtaacctaggtaacgtactcggtaacgggcgggtccggtagacggacgtacggtacgtacgagtacggctagtnacgtcgtaggntagtacgtcgtgtacgcgtcggagtgtcgagngtacgg

SEQ ID NO: 99876 - DNA, 700 bp, Homo sapiens
  misc_feature: GYAE6OF02FTNE3.40.81.H04.1.454.CMB.1.raw
  modified_base (204)..(204): a, c, t, g, unknown or other
  misc_feature (204)..(204): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggacncccactcccaggtgcagctggtgcagtctggggctgaggtgaagaagccgtggggcctcggngaacggtctccgtgactaagtatttcgagggaaaccncccgtgacgcaacgtactacatacacgtggatcggcgacgacggtcccgtaggaccgtggggtttacgaggtggaacggtggggtcgaacgtaccaacccgttacggagggtacggtcggacgtaaacgaaaggtacgtaccgtacgtaacggttaaacctttacgggaacggggtaccgtaaccggggttacaaaccgtaggttaccggaacggtacccggggtaccgtcccgggtaaccctaagtaacccgacggaacccgtaacgttaacgtaccgttaacgacgttacgggtacttacgggtcggaacgtacccgggtactacccgggtaccttaacggtacccgaacgtacccggaaccggttaccaggtttacgtattacccgtaacgggg

SEQ ID NO: 99877 - DNA, 755 bp, Homo sapiens
  misc_feature: GYAE6OF02G7QFD.40.81.H04.1.454.CMB.1.raw
  modified_base (300)..(300): a, c, t, g, unknown or other
  misc_feature (300)..(300): n is a, c, g, or t
  modified_base (559)..(559): a, c, t, g, unknown or other
  misc_feature (559)..(559): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggaccgtggaggattcccttctttcgttgggtggcaggcacgccgcgaggacgccccactcccgaggtgacgagcgtggtcgcgacgtcgtgggctaggaggtagaaagacggccgtcggggccgtcgggtaggtacggtccgtccgtcgacaagttcgtttaccgacggaaaccnccgtagacacgtaacctactacagtacacgtagagcggaccgacgtccggcccgtagggacggttaggggttgacgggtagggtaggttaggggacgtaaccgtaccgaaacccgtacggaggtaacgggtcgaacgttaaacgaacgttacgtacgtaacgtaacgttaaccgttaccgggaacgggtgtaaccgggtactaacgtaacgtacccggtacggtaaccgggtacgtccgtaccgtacgtacgacgtacnccgttacgttacgacgtacgtagtcgtacggtagaccggtaccggtattacccggcgtaccggtaacggaccggtaaccgcggttactagtttaccgttggtaacgttggaaacggtaacggttaaggccggtttacgggtccggtacggttcccggaccggggtttaccacggtcccgggtaacggtacccgggg

SEQ ID NO: 99878 - DNA, 808 bp, Homo sapiens
  misc_feature: GYAE6OF02HTYDP.40.81.H04.1.454.CMB.1.raw
  modified_base (179)..(179): a, c, t, g, unknown or other
  misc_feature (179)..(179): n is a, c, g, or t
  modified_base (210)..(210): a, c, t, g, unknown or other
  misc_feature (210)..(210): n is a, c, g, or t
tcagtctagcgactcacgaccggtgctcgatttagtagtgtagattcgcgggggtgccctgagagcatcacccagcaaccacatctgtcctctagagaatcccctgagagccttccgttcctcaccatggactggacctggaggactcctcttcttggtggcagcagccgacagggacncccacctccgagggtcgcgagtcgtgggtcncgagtcggtggggctaggaggtagaagaggccggtggggtcctcggtagtaacggtcctcgtagacagttactttcgaacgaacctcctagacgacaacttacaactactaccgtacgtggagtaccgggccgaccggtacgtaccccggttaggaccggggtttaggggtttaggagggttacggggtacggggtacgggggttacggtaccttaaaccgtaaccccggttacggaaggggttacgggtaacggtaaacgtaaaccgtacggtaacggacgtaaacgtaacggttaccggttacggaacgggtccgtaacggtccgtaacgtacgtccggtacggtacgggtaccgttaccgacgtaaccacgttacggaaccttacgtaagttaccgtaacgtacgttaggtacgtacggtacggtacggggtaccaccgttacgacgttccgggaagtaaccccgggtacgttaccggcccgttttaagtaccggtttaaggttaacggttaaccggggaaggtaacggttacgggtttacgggttaaccggtccgggtaccggggtaacccgggcggttacccggtaaccgggg

SEQ ID NO: 99879 - DNA, 836 bp, Homo sapiens
  misc_feature: GYAE6OF02HNIZQ.40.81.H04.1.454.CMB.1.raw
  modified_base (199)..(199): a, c, t, g, unknown or other
  misc_feature (199)..(199): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactggacctggaggatcctcttcttggtggcagcagccgcgaggacgcccactcccaggtgcagctaggtnactaggtcgtggggctggaggtagaagaacgccgtggggcctcgggtagaacgggtcctacgtgtacgaaacgttagttttaccgtaacgggtaaaaacctaccccgttagggtaacgacccgtaaaaaccttaaccgttaaaacctaacgttaacccgtaaaccgtttacggggtaaacgtttcgggaccggggacccgtaccgggtaccccccggttgggtaaacggttacgggggttttaagggaacggttcggggtaaggttcgggggggtaacggtaacgttaaccctaaacccggtaaccgaagggttaacggggttacggaaccgaaaacgtaaaacggtacgtaccggtaacgtaaacggttaaaccgttttacgggacggggtaccgtaacggggtacctaaaccggtactaccggtaacccgggtacgggtaaccggttacccggttacccgaacgtaccggttaaccggacccggttaaccgacggtttaacccgtaacgtacgttacgggacgttaccgtacgggacggaccgttaggaccgtccgtacgtagaccggaacgtccgacgtacgtacggacttcgagtcgacgtagtcgtaggccgtacggacgacggcgtaacgg

SEQ ID NO: 99880 - DNA, 802 bp, Homo sapiens
  misc_feature: GYAE6OF02F2UJZ.40.81.H04.1.454.CMB.1.raw
  modified_base (196)..(196): a, c, t, g, unknown or other
  misc_feature (196)..(196): n is a, c, g, or t
tcagtctagcgactcacgaccggtgctcgatttagtagtgtagattcgcgggggagagcatcacccagcaaccacatctgtcctctagagaatcccctgagagctccgtcctcaccatgactggacctggaggatcctcttcttggtcggcagcagccgcgaggacgccctactcccgagggttcacagctaggtncagtcgtggggctggaagtggaaagacgtccggtggggtcccctgggtacggtaacgggttcctccgttacggacctaaagttccttttccggtaaacggaaaaccctcccggtaggactacctaaccttacctaacctaacgttaacacggttaggacttcgggaccggtcgaacccggtccggtagggtaccgggttagggggtttacggaggtacgggtggtcggggggtacgtaacgtaccgaaacctaccggaggtaaggtcgtaacgtaaacgtaagttacgacgtaacacgttaacgttacgaccggtacgacggggtacacgttagaccgtaccgggtacgggaccggttccgtcggaaactaccgggaacggtaccgtacgttaaccgggtaacctacgttaaacgttcgggaacgtcgttaacgggacgaccggtaacgtcgtaacccgtacgtaccgaacggaacccgtacggtaccaaggttacttacgttaccgtagggtaaacgggtccggttaaggtcgggtttaccgggaacggttaccgggaccgggttaaccgggtcggtaccgggaccgttaccggggtaacccggg

SEQ ID NO: 99881 - DNA, 820 bp, Homo sapiens
  misc_feature: GYAE6OF02FYFA1.40.81.H04.1.454.CMB.1.raw
  modified_base (224)..(224): a, c, t, g, unknown or other
  misc_feature (224)..(224): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccaggtggggatattgtgatgactcagtctccactcctccctcgcccgtcactccgtggagacgcccggcctccatcctccgtgcgtaggtctagtcagacncctactaaacactaagtgactactacttcttagattcggtactcggacaacggaactccgacgggtctacgttcctaccgacgtacgtccgttacgttagtacgttaaggtttacgggttttcgggggtttaccttacgggttcccggggtccccgggttcccggggttccctaggtaaccggttgggttaccgtagggtcggacgtacgggtacggtacgtccgtaacgtacgaacttaacggtttaactttaaccgtaacgttaaacggtaaaacgttccggaaagggtcggggttaaggggtaaacgggtcggaaaccggtaagggtaaacggtttaggttagggtttacggggtttaaactttacgtacggttacggttaacgttagttacccggtaacccttaaccgttaaaccgttaaacggtaacgtttcgggaacgggttaccgggtaacccgggtaaccggaaccggtaaaggggtaacctaaagggtaacgaacgtacgtaacgacgtaccggttcggtccgaacgtccgtaccgaacgtttcgttaaccggttcgttaccgtacgttaccgttccccgttacccg

SEQ ID NO: 99882 - DNA, 768 bp, Homo sapiens
  misc_feature: GYAE6OF02IPGDZ.40.81.H04.1.454.CMB.1.raw
  modified_base (696)..(696): a, c, t, g, unknown or other
  misc_feature (696)..(696): n is a, c, g, or t
  modified_base (739)..(739): a, c, t, g, unknown or other
  misc_feature (739)..(739): n is a, c, g, or t
tcagtctagcgactcacgaccggtgctcgatttagtagtgtagattcgcggggggagagcatcacccagcaaccacatctgtcctctagagaatcccctgagagctccgttcctcaccatggactggacctggaggatcctcttcttggtgcagcagccgcaggacgcccactcccaggtcgcagctggtgcaggtcgtggggctggaggtagaagacgccgtggggcctgggtgaacggtctcctgacgtaagtcttttcgacggaaaacctacccgtaggaacgacctaaacctaacctaactaacgtaccgtacgtggaactcggacggaccgtaccgggtaccccgtaggggtaaccgggttagggggtttaggacggtggggtaaggtcggggggttacgtaacgtacccgaaaacccccgtaggtaacggtacgggtacgggaacctaaaggaaaacgttacgtaccgaaaccgtaacggttaaccgtttacggaacggggtaccggaacggggtactacccgtaaggttcggtacccgggtaacgggtacccggtccgttaaccgtaacgtccgaacggtacaaccggtacgttacctaacgtagtacgggtattccgtaggtaacggtccggaccgtcgaaccgtccggacgaacccggtacgacggcgtaagttcgtacttacgggngaacggtacggtcggtaacgggttggtacgtccggtaccgggnggttccgaccgtaccggtacggtccgggg

SEQ ID NO: 99883 - DNA, 694 bp, Homo sapiens
  misc_feature: GYAE6OF02JX1K7.40.81.H04.1.454.CMB.1.raw
  modified_base (167)..(167): a, c, t, g, unknown or other
  misc_feature (167)..(167): n is a, c, g, or t
  modified_base (219)..(219): a, c, t, g, unknown or other
  misc_feature (219)..(219): n is a, c, g, or t
  modified_base (373)..(373): a, c, t, g, unknown or other
  misc_feature (373)..(373): n is a, c, g, or t
  modified_base (681)..(681): a, c, t, g, unknown or other
  misc_feature (681)..(681): n is a, c, g, or t
tcagtctagcgactcacgaccggtgctcgatttagtagtgtagattcgcgggggatcaggactcctcagttcaccttctcacaatgacggctcccgtgctcagctcgtggggctgctaagtgctctggtctcgtggatccgaggtgggattagttgtgactgactcngtcctccactctcctcgcccgtacactccgtaggacgcgccggtcctacgtntcctcgtgaccgtaggttacttacgacgaacgtacggacccttaccgtaaaacgtataaagtcggtaactaaccttctacgtttagaacgtttacggtacctggtacgaagtaccggcggaggcctagtccaccggtacaggtccttacgttanattacgttaggttacgggtttacttccggtccgggtcccggttacccggggtcctaacggacggtttaccgggtacgtacggttcggacgttagtgggactacggtaacttcgaaactagtttacgtttaacccgagtaaacgtaaattcggagtagggtaaggtacggtaggaacggtaagtaagtggttaggttaggtaattcgttagtacgagttacgtcgtaacgtacctaagtactaagtcgtaggacgttacggaccgtaccgtaggtaccgaaggtaacgtacgagtacgactggttacgngactacgctactg

SEQ ID NO: 99884 - DNA, 778 bp, Homo sapiens
  misc_feature: GYAE6OF02GB7OE.40.81.H04.1.454.CMB.1.raw
  modified_base (221)..(221): a, c, t, g, unknown or other
  misc_feature (221)..(221): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctctgggtctctggatccgaggtggggattattgtgatcgactcagtctccactctccctgcccgtcactccgtggagcgccggcctccatcctccgtnacgtacggtctacgtcaagacctccttaccaaacaactaacgtcgtaacttactacttcttagtagttcgtactgacgagaacgcgacggtcagtcctaccacgtactcttctagtattagtttacggtttacggggtttacttacggttcccggggtacccgtttccccgggggttacccttacgggaaccggttacgggtttaccgtagggttacgggcgttaacggtcgggtaacgttacctacgggtttacaacggtttaacgttttaacttttaacccggtaaattaaacggttaaaacttccggtaacgggttcggggttacggggtacgggaaacggtacggaaacggtaggttaaacgggttagggtttaacgggttaatttttacgttaagcgttacttacggtaccgtaaccgttaccttaacctaaacgtacgttcgggttacgggtacgggttaccggtaccgggtaacggaaaccggtaagggtaacgggttaacgaagtacggtaacggacgttaaggtccggtacgtacccggtcgtaaccg

SEQ ID NO: 99885 - DNA, 759 bp, Homo sapiens
  misc_feature: GYAE6OF02JP632.40.81.H04.1.454.CMB.1.raw
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
  modified_base (617)..(617): a, c, t, g, unknown or other
  misc_feature (617)..(617): n is a, c, g, or t
  modified_base (660)..(660): a, c, t, g, unknown or other
  misc_feature (660)..(660): n is a, c, g, or t
  modified_base (693)..(693): a, c, t, g, unknown or other
  misc_feature (693)..(693): n is a, c, g, or t
tcagtctagcgactcacgaccggtgctcgatttagtagtgtagattcgcgggggagcatcacccagcaaccacatctgtctctagagaatcccctgagagcctccgttcctcaccatggactggacctggaggatcctcttcttggtcggcagcacgccggcacggagccccactcccgaggtcnccgagccgtggtgacaggttcgngggggtctggagggtcgaagtaacggcgtcggggcctgggacggtaggtcctccgtnacgtaagtntttcgaccggaacctccgngacaacctaactactacncttacgcggtaggntacggcggacgaccgtccccggtgggaaaccggttggggtttacgngggtacgggtaggtcggggggtcgtaaccttaccccgaacccgtaggacggttacgggtcgggaaactaaaccggaaaggttaccgtcgaaacggtaacgttaaaccgtttgggaaacgggacttaacggggaccctacggtaacgttcggtaaaccgggtcgggtaaccgtcccggtaccgatacccggagtaacccggaacttacgaaccgttaagtcggtacgtaatcgggacggtaccgggngtacccgttaacgggtcctacgggttaacgcccgggttaaacnccgggtacctaaagttccgttaagcgttacggngtaaaggtccgtgggtacgtcggtaccggcggtagggtccaacgggttacgacggtacggccgggg

SEQ ID NO: 99886 - DNA, 708 bp, Homo sapiens
  misc_feature: GYAE6OF02GNYNG.40.81.H04.1.454.CMB.1.raw
  modified_base (168)..(168): a, c, t, g, unknown or other
  misc_feature (168)..(168): n is a, c, g, or t
tcagtctagcgactcacgaccggtgctcgatttagtagtgtagattcgcgggggtgccctgagagcatcacccagcaaccacatctgtcctctagagaatccccagagagctccgttcctcaccatggactggacctggaggatcctcttcttggtggcagcagccgnaggagcccactcccgaggtcgcagcgtggtgacacgtcgtggggtctggaggtacgaagaacgccgtaggggcccttgggtagaacggtccttccgtagaccgaagtacttttcgacggtaaaaccacccgtaggtacgacaactactaacgactaccgaacgttggactcggacggcgtaccggccccgtaggaccggtagggtttcgaggttacggaggttcggggtacgaacgtccgtaacctacggtagtacgggttacggacttaacgaacgttacgtacgaactacggtaacgtttcgaagggtaccgtacggtaaccacgttagcggtaccggtaggaacccgtgtacccgaacgttcgacgtaccctacgttcgtaccgtaacttgttaacgggattcggtaacggcggaacgttacggtacctacggtaccggagaccgttacgacggtacccgtagtaccgttaggttactaacgtcgggtaaacgcggggttactcggtaacggccggtaacgggtcgggactacccgg

SEQ ID NO: 99887 - DNA, 887 bp, Homo sapiens
  misc_feature: GYAE6OF02IA5M2.40.81.H04.1.454.CMB.1.raw
tcagtctagcgactcacgaccggtgctcgatttagtagtgtagattcgcggggatcaggactcctcagttcaccttctcacaatgaggcctccctgctcagctcctggggctgctaatgctctgggtctctggatccagtggggatattgtgatgactcagtctccactctccctcgcccgtcacctcctggagagcccggcctcattcctcctgcaggtctagtcacgagtccctactaaacacttaatggaacttacctactactttcgtaaagttcggtactacgtacaaggtaacggcccggtaagggcctaacggttccttacccgaacgacgttaccgtttacgtttacggaacttaacgtttaacggttcgggggttttaccgtttaacgtcccgggggttcccggttccccgggggttacccctagggtaccgtttaacgggttaccgttagggtaccgggtaccgtaacgggttcggggtaactttaccggacggttaacgaaaccgttaacggtttaaactttttaaaccgacgtttaaaacgtaaaaacgttacgaacgggtaacggttaacgggggtacggtaaaccgggacggtaaagggaaaccggtttaaggtttcgggtttaaaaggggttactttttaaacgggttacgtaaggtaccgtaaacgttacccggttaaactaaccccgtttaaccttaccggttaaaaccgttcgggtttaggaccggggttaacccggggttccgggaaacccggtaaaaccggggggttaacccaaacgggggttaaacggtaaacgttaacccggaaacggtaaccggtaacccggttgggtaccggttaccggtcgtaacccgtaacggttaacccg

SEQ ID NO: 99888 - DNA, 627 bp, Homo sapiens
  misc_feature: GYAE6OF02IRWX1.40.81.H04.1.454.CMB.1.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactcctccctcgcccgtcacctcctggagacgccggcctccatctcctagccaggtctagtcagacgcctacctaaacactaagtggaactacttacttcttagaagttcggtacctgcaagaacgccgagggcngtctccacngtctctagtatattgttgggttctacggtccgggtccgtcccgggtccnggtactggttcaggtggcaggtggatcgtagtacagtattactttaccaaagttaactaagtcgaaggtcgggtaaggggtacgggaggaacgtaaggtaacgttaggttggttacggttaatttacgtatagtacgtataccggtactaacttacgaactagtgttacggcggtacggaccggacgtaaacgggaccgtaaggtacgaactacggacgtaacgtacggtggcgtacgtacacactacggtacttcgttacctacgttactcccgtacccg

SEQ ID NO: 99889 - DNA, 823 bp, Homo sapiens
  misc_feature: GYAE6OF02HQXU4.40.81.H04.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (713)..(713): a, c, t, g, unknown or other
  misc_feature (713)..(713): n is a, c, g, or t
tcagtctagcgactcacgaccggtgctcgatttagtagtgtagattcgcgggggtgccctgagagcatcacccagcaaccacatctgtcctctagagaatcccctgagagctccgttcctcaccatggactgggacctggaggatcctcttcttggtggcagcagccgcaggagcccactcccaggtgcagcgtggtncagtcgtggggcnggaggtgaagtaacgcgtcggggacctcgggtggaaaggttctaccgttgaccgaaaggtactttaccgttaacgggaaaactaccccgttggaacgtacctaaaaccgttaacctaaacgtaagtaacccgaacgttacgggtaagttcggaccgggaccgtaccggacccccgtgggtaaaccggttaggggggttttaccgaaggttacgggtaaggtaggggggtacgtaacgttaacccgaaacccccgtaaaccggaagggaacggggtttccggtaaacgaaaaaccggtaaaaaagggttttaacgaacccggggtaaacctaaaacgggttaaaccccttttttacgggaaacgggggtaacggtaacggggttaacccgaaacgtaaaccgggttaaccgggtacccgttacgggggtaacccggtacccggttacccggtaaacttacggaccggaaccggtaaacccgtaacggttaaccccgttaaganagactacgagaagacgagtagtagaacgacgaagtacgaacgtacgacgagtaccgtaagtacgtaacgtaacgtagtacgtacgtaactaacgtaacgtacgtagaacg

SEQ ID NO: 99890 - DNA, 901 bp, Homo sapiens
  misc_feature: GYAE6OF02GD5LS.40.81.H04.1.454.CMB.1.raw
tcagtctagcgactcacgaccggtgctcgatttagtagtgtagattcgcggggactgatcaggactcctcagttcaccttctcacaatgaggctccctgctcagctcctgggctgctaatcgctcgtgggtctgtggaatcctaggtggggattattgtgatgacctctattctccactcctcccgtgcccgtacacctaccgtggacggacgcccggtacctccgattcctaccgtgaccgtaggttccttaggtccgaagtacgtccccttaaccctaaaaacaaccgttagtacggtaacttaaccttaccttacgttttaagtaacgtttccggtaacctgacgtaacggacgtcccggaagggtccttacgtacccttacccgaacgtaccgttcttcgtttagaacgtttagtttacggtttcggggtttaaccttacggtcccgggggttccccggtttaccccgggggttaccctacgggttaaccgttacggggtttacccttaaggggtccggtaacgtacgggttaaggtaccttaccggttacgtacctaaaccggtttagttaacccgtttaactaacgtaacgtaaaacgtccgaagggtaacccgggtaggggtaacgggtacggtaaacgtaaggggtaaatttcgggttttaacggggttagtttaaactttttacgggttaacccgttaaggtaccgttaacgttaccggtaaacccttaaccccgtttaagttaaaacccggtaacggtttaacggttacgggttacccgggtaacccgggtccggggtaaaaccgtaaacggggtaacgtttaaaccgggtaacgtaacggtacgtaaaccggtcggttaaaccggtcgttacggtacttacggtaacccc

SEQ ID NO: 99891 - DNA, 833 bp, Homo sapiens
  misc_feature: GYAE6OF02HKMUC.40.81.H04.1.454.CMB.1.raw
  modified_base (592)..(592): a, c, t, g, unknown or other
  misc_feature (592)..(592): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggacgcccactcccaggtgccagcgtggtgcagtcgtgggctaggaggtgaagagccgtgggcctcggtagtaacggtcctcgtagacgtaacttacgtttcgaacggaaaccctaccgtagacgaacctaaacctactacctaactaaccgtacgtacggtacgtccgggaccggaccggtaccccggtaccccggttaaggggtaacggggtttacggggtttaggtacgggttaggggtaaggggttcgggggttaacgtaacccgttaaaccccgtaaacccgtacggaacggggtacggtaaccgtaacctaaacgttaaacggtaccgtaacggtaaacgttaaaccgttaaccggttacgggaacggtaccggtaacggaccctagtaacgtccggtaccggtacgggtccctacggtaaccgtntaccggaacgtaccgaacgttacgtaccttaaggtagtaccggttactacgggagtaccggttacgaccgttaccacggttaccgtaccgaacccggtacgtacccgtacgttaacgtacgtttaacgttacggtaaggtaaccggtaagtccccgggggtttagttaccgggcccgggtttaaccgtccccggggaggtttacccgaaccgggcccgggttacgggccccggtaaaccgg

SEQ ID NO: 99892 - DNA, 667 bp, Homo sapiens
  misc_feature: GYAE6OF02FKXFC.40.81.H04.1.454.CMB.1.raw
  modified_base (333)..(333): a, c, t, g, unknown or other
  misc_feature (333)..(333): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggacgccccactccccagggtgcagctggtcgcagtcgtggggctggaggtgaagagcgtgggccgtggtgaaggtctctgacaagtatttcgtacggaaccaccgtgacaccaactaactacatacacgtggntggcgcgaccggcctggacgtagggttgaggtggagtggggtgactaccgtaaacccgtacgaaggtacgggtacggacctaacgtaaagtacgtacggaaactaacggttaacgtttacggaaggggtaccgtacgggtaccaaccgtacgtacggtacccgggtacgggaccggtccgtaacccgtataccgacgtaccaagttaaccgttactaccgtaagttcggaacgttcgtcggtacggtaccgggtaacttcggtaacccgttaggtaccggtaaccgacggtaacccgggtacctacggtttaacggttaacgttacgtaacggg

SEQ ID NO: 99893 - DNA, 649 bp, Homo sapiens
  misc_feature: GYAE6OF02IWL1P.40.81.H04.1.454.CMB.1.raw
  modified_base (258)..(258): a, c, t, g, unknown or other
  misc_feature (258)..(258): n is a, c, g, or t
tcagtctagcgactcacgaccggtgctcgatttagtagtgtagattcgcggggggtgccctgagagcatcacccagcaaaccacatctgtcctctagagaatcccctgagagctccgtttcctcaccatggactggacctggaggatcctcttcttggtggcagcagccgcaggagcccactcccaggtgcagctggtgccagtctggggctggaggtgaagaacggccgtagggggcctcgggtgaacgggtctccngaccaagtatttctaggaaaccacccgtgacgaccgtaaactaacctaactataacctaacgtcggattggcgggacacgggccccgtaggacgtaaggggttttcgaggtaggagtggggtaggactaccaaacccctacgaaggacggttacggacaacgaaacgtatacgaacaggtaactttcgaacgggacgagggtccaaccgagtacgaccggtgggacgtccgtacaatccgacgacgaactcgtacctaagtacgtaagggacttcgtacgtacggcggtaacgtcggaaccgtacggacgaacgacgaccgtcacgtagtacttaacgagtaaggtaacgtagtacggttgggttacgcggttaccggagggtcctaacgg

SEQ ID NO: 99894 - DNA, 672 bp, Homo sapiens
  misc_feature: GYAE6OF02IF84S.40.81.H04.1.454.CMB.1.raw
  modified_base (136)..(136): a, c, t, g, unknown or other
  misc_feature (136)..(136): n is a, c, g, or t
  modified_base (168)..(168): a, c, t, g, unknown or other
  misc_feature (168)..(168): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
tcagtctagcgactcacgaccggtgctcgatttagtagtgtagattcgcgggcgtagactttgtgtttctcgtagtctccctgctcagctcctggggctgctaatgctctggtctctggatccagtggggatattntgatgactcagtctccactctccctgcccgtnactcctggagacgccggcctcatctctgcaggtctagtcagacgcctcctaaaacgactaatggaatactactctttagaatttggtacctgctaagaacgtccagggccagttcacctacacgctcttgactattaagttcgggtttcttagtccggccgtaccgggtcctgacgngttcagtgcagtgacncagcanagtactttanacgtagaaatcagtacgagggtaggagacaagtaacgngttacggtagggttatttattacgttggacctagtacgtacctaaaccttactaaactaaaccgttggttacggtcgggtaaaccggggtaccgggaaccggtaaaccggggtaaccgtaaaggggtaaacgggtaaacttaaccggaacgtacccggtaaacggttagggtaacggcccgtttaacggaccctaaaccccgttgtacccggtttacgttacctttaccgttaccccgtttaccccggttacccccg

SEQ ID NO: 99895 - DNA, 871 bp, Homo sapiens
  misc_feature: GYAE6OF02IM3JV.40.81.H04.1.454.CMB.1.raw
  modified_base (140)..(140): a, c, t, g, unknown or other
  misc_feature (140)..(140): n is a, c, g, or t
  modified_base (715)..(715): a, c, t, g, unknown or other
  misc_feature (715)..(715): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaactcccctaganacgctccgttccacaccagtcgacgtacggacgtgggaacggtacttcctcgtttcgttagggtgacgagacgacgcccgagaacggaccgaccctaccgtacccgtaggtcgacgacggtccggtaggtacgaccgtacggtcgggtacggggcttagggacgggttaacggaaaggtaaccggtcccggtacggggtacccggttacgggtaacggaccggttaccgtcggtaacggaaccgtaacgttacgtttacgaaccggaaaccctccggtaagacgaaacctaacctaccgtaacgtaacgtaaccgtagtagacgcggtacggaccgtaaccggtcccggaggtacgggttagggttacgtagggtagggtagggtacgggttaacgaacccgttaacccgtaacccggtagaacggtacggtaacggaaaccttaaacgtaaaagttaccggaacgtaaaccgtaacggtttaaccgtacgggaacggtaaccgggtacgtaacggaacccttaagggtaccttaacccggggtaacggaacccggttacgaacccggttaaacncccggttaacgacccgtaaacgtacgtaaacgttaaagttaacgaagtttccggtaaaggtaccgggaccggttaccggtaaacgttcccggtaaacgtcccggttaaccgaccgggttaacgtaccggtattaaccgggtattacccggttagga

SEQ ID NO: 99896 - DNA, 759 bp, Homo sapiens
  misc_feature: GYAE6OF02GXO3D.40.81.H04.1.454.CMB.1.raw
  modified_base (210)..(210): a, c, t, g, unknown or other
  misc_feature (210)..(210): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
tcagtctagcgactcacgaccggtgctcgatttagtagtgtagattcgcgggggtgccctgagagcatcacccagcaacccacatctgtcctctagagaatcccctgagagcttccgttcctcaccatggactggtacgtggaggatcctctttctggtggtcagcagccgcgaggacgccccacctcccgaggtcgcagcgtggtcacngtccgtggggctaggagggtagaacgaacgcggtcggggtccttgggngtaacggtcttccgnganagtacttcgtaggaactacccgtgacgacaaacctactaacataaccgacgtgtagtcgaccggtacgaccggtacccgtacggacggttacggggttagtaggtacgggtaggggtaggggtacggacgttacccgtaaccgtaccgagggtacgggtggaaccgaaactaaacggtagtaccggtaaagaacgtaaaccggtttcgaacgggtcgggtacggacgtaccacggtacggtacccgggagggtcccgtacggtaccacgtaacccgtacgaccgaacgttacgaccttacgacgtaggtacttaccgaggtacggaccggttacgaccggtaccgtaccggtacgtaccgggtaccgtaccggtaccctaggttacgttaccggtttagttaaccggaggttaaacgcgggtttaaccgggttcggttaaccggcccgggttaaaccggggtccggttacccggtaacccggg

SEQ ID NO: 99897 - DNA, 679 bp, Homo sapiens
  misc_feature: GYAE6OF02JUP99.40.81.H04.1.454.CMB.1.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggagatcctcttcttggtggcagcagccgcaggagcccactcccaggtcgcagcgtggtgcagtctggggctgaggtgaagacgcgtgggcctggtagaacggtctcctggccaagtnttacgacggaaacncccgtgagacaactactacagtacacgtggactcggacggaccncggtaccctaggacggttaggggttagaggtcgggaggtcgggggtacgtacgtacccctaaaccggtcgtaagggacgggtccggacaaaccgtaaagttacgaacgaacgtaacgtaaccgtttacgaagggtccgaacggttaccaaccgtagtaacgggtcccggtagggtaccgtaccgaccgtacgtagaccgacaaccgtacgtaccgtagacgtcggtaacttcggaggtaacggccggttacgacggtaccgagttaccgaacgttaacgccggtactagtacgttactacggacgtacggaagttccgggaataccggcgttacgaaccggccggtaacgcccggtagtacccgggtcgaccggg

SEQ ID NO: 99898 - DNA, 601 bp, Homo sapiens
  misc_feature: GYAE6OF02JFJYE.40.81.H04.1.454.CMB.1.raw
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatccctgagagctccgttcctcaccatggactggacctggaggatcctcttcttggtggcagcagccgcaggacgcccactcccaggtgcagctggtgcagtctggggctggagtgaagagccgtggggcctcggtaggacggtcctcctgaccgaagattttcagggaaaccncccgtagacgacaactactacatacnctggntggcgcacggccctggacgtaggggttnaggtggngtggggtgacgtccaaccctacgaggnggtggacagaaacgtancgaacagtacgttacgaggcgaggtccacgtagttaccgaccggtagggtaccgccgtcgacgtacgaccggactaccgacgttacctacgtaagtcggacgttagtacgagggtaccggtacgtcggaacccgtcgtacccggtaacggaccctaaccgggtcctagttacgttacgttaggtacggg

SEQ ID NO: 99899 - DNA, 751 bp, Homo sapiens
  misc_feature: GYAE6OF02I4Y0H.40.81.H04.1.454.CMB.1.raw
  modified_base (134)..(134): a, c, t, g, unknown or other
  misc_feature (134)..(134): n is a, c, g, or t
  modified_base (225)..(225): a, c, t, g, unknown or other
  misc_feature (225)..(225): n is a, c, g, or t
tcagtctagcgactcacgaccggtgctcgatttagtagtgtagattcgcggggactgatcaggactcctcagttcaccttctcacaatgaggctccctgctcagctcctggggctgctaatgctcgtgggtctntggatccaggtgggatattgtgatgactcagtctccactcgtccctcgcccgtcacgtccgtggacgacgccggcctccatcctcgtgacncggtactagtcaagacgcctaacgtaaacagtaactagaactactacttctttagtagttcggtaacctgacgaaggaaccgacgacgggactacggtcctaccgaactacggtaccttacttagtaacttaagtttacggtttacgggggtttacttaaccggttccgggtacccgggttacccggggttaccccgttaggaaccgttaacggtttacgaaggttcgggaacgtagtacggtactacggacgtaacgaccgtaagttaaccgttttaacaacgttaaagtaaaacgtccgtaaagtcggttagggtaccggaaggaccgaagtaaagtacgttagggttaacggtttaagtttaacgtacgtacgtacgtaacgtacgaaccgttaaccttaacgtaaacgtaaagttaccggtaggttaccggacgggtaccggaacggaaaccggggtaacgaagggttaacgtaaacgtaggaaacggtaccgaaaggttcggtaacggtcgttaacggacc

SEQ ID NO: 99900 - DNA, 808 bp, Homo sapiens
  misc_feature: GYAE6OF02FW6T5.40.81.H04.1.454.CMB.1.raw
tcagtctagcgactcacgaccggtgctcgatttagtagtgtagattcgcggggactgatcaggactcctcagttcacctttctcacaatgaggctccctgctcagctccgtggggctgctaatgctcgtgggtcctcgtggtactccgtagggtgggtattgtttgtggtaattcgaaccgttccgtaacgtccctaccctaaccttcccttcccccgtccggtcccccgttcctaccgttcccgtagggacggtaccggcccggtccctccgtacttcccgtaccgtcgtccgtacggttctacgtcgagaccgtccctaacctaactaccttaagtggtaacttacttacttacgtttacgtaacgttcggtaccgttaggaccgtaacggaaccggtaccgacgggtactacggtcctaccacgtacgtcgttatagtagtttacgttcggtttcggtttcgtacggtcccgggtccccggttaccggggtacccgtcgggttaaccgttccgggttacgtacggtacggtcctaagggtaggtacctacggtaccgttacgaacgtttaacgtttaacgttaccgttaaccggtaaattaacgttaccggacggtacggggtaggggtacggtacggacggtaaggtacgttaggttaggttacttacggttttattacgtgacttacgacccgttactaacttaacgtaactacggtcgttaggtaccgggacgaccggtaggaacggtaccggtaaggttaacggaagtcggtaacgcgttacggtcggtgaccgtgtaccg

SEQ ID NO: 99901 - DNA, 716 bp, Homo sapiens
  misc_feature: GYAE6OF02GWESS.40.81.H04.1.454.CMB.1.raw
  modified_base (192)..(192): a, c, t, g, unknown or other
  misc_feature (192)..(192): n is a, c, g, or t
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (659)..(659): a, c, t, g, unknown or other
  misc_feature (659)..(659): n is a, c, g, or t
  modified_base (664)..(664): a, c, t, g, unknown or other
  misc_feature (664)..(664): n is a, c, g, or t
  modified_base (670)..(670): a, c, t, g, unknown or other
  misc_feature (670)..(670): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggagactctcttctggtggcagcagccgcaggacgccccactcccaggtcgacagctgggtncgagtcgtgggctgaggtcgaagagccgtgggtcctggngaacggtctcctgacgaatnttcgacgaaacctccgtagacgaccaactactacaacgtacagtggactcgggcgacgtccggtccccgtaggaccggtagggggtttacgaggtagggtacgggtaggggtacgtacgtaacccgtaaccccgacggaggtacgggtcgtaaccgaaacgtaacgtacgtaaccggtacgtaaacggttaaccggtttacgacggggaccgtacgggtaccctaacgtaaccgtaccggtaaccgggtacggggacccctacccggtaccgtacgtacggtaaccgtacccggtaaacgtaccggttccgttaaaccgtaacgggtcggtttaacgtaccgttacgggaccgggaccgggtccggttacgggaaaccgttaaccggggccttaacgtaacgggtacnggacncggtancggtgtagacgagcgtcgtacgacgcgacgtacgtacgcgtcgtcg

SEQ ID NO: 99902 - DNA, 796 bp, Homo sapiens
  misc_feature: GYAE6OF02HCM0X.40.81.H04.1.454.CMB.1.raw
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcgttggtggcagcagccgcaggacgcccactcccagggtgcagtccgtggtgcgagtcgtggggctggacggtgaaaggacgccggtaggggccgtcgggtagtaacgggtccttccgtgtaacgaagtcttttacgaacggtaaacctacccgttaggaaccgtactaacctaacgtaactactaaccgacgttaggacgttggcccggacgaaccggccccgttagggacggttaggggtttgaacgggtttggacgggttggggtacgtactacccgtaaacccgttacgacggtacggtcgaacgtaaacgtaaaggttaaccggtaacgaaaaccgtaagggtttaaccttacgggtaacgggaccggtaagggttacccaaccggtaagtccgggaccggtaaacgggtccgggtaacccgccgttaacgtacgaaccggtcgtaaactcggttaacctaacggtggtaacgtagtcgtacgtaccgggaacgtaccgtaccgtccgtaccgttaacggacgtaaccggaccgtaacgttattaaccgtaggttacgttaggggtaaccggaggtaaccggttagggttcggaaccggttccggtacgggtaccggtcggaacggtaccgtgggacccggtaacccggg

SEQ ID NO: 99903 - DNA, 917 bp, Homo sapiens
  misc_feature: GYAE6OF02GCA8V.40.81.H04.1.454.CMB.1.raw
  modified_base (739)..(739): a, c, t, g, unknown or other
  misc_feature (739)..(739): n is a, c, g, or t
tcagtctagcgactcacgaccggtgctcgatttagtagtgtagattcgcggggatcaggactcctcagttcaccttctcacaatggaggctccctgctcagctccgtggggctgactatgcttccgtgggtcctcgtggactccgtaggtggggtaattagttgtgtatcgtactcgtagttcctcccacttccgtcccgtcgccccgtctaccttcccgtagggacgaccggtcccggtccttacctagttccctccgtcgaccgttaggtaccttaagtccgaaggtccgtacccttaacctaaaacgtacttaaacgtcggtaacttaaccgttactttacgtttagttaacggtttcggtaaccgtagacgaacggaccggtaccgtacggggtacctaaccggttacccaaccgtaccgtacgttccgttaagttaacgtttaactttaagggttttacgggtttccggggttttaacgtttacggggtacccccgggggtttcccggttacccccgggggttcctacggtaaacgggttccgggttaggttacgggtcgtaacggtacggtagggtacctaacgttaacgtacgtaaccgttttaaacgttttaacgttaacgtaaacgttaaacgtaaacgttaccggaacgggtaaggtaacgggggtacgaaccgggttagaaaacggttggtttaagggtgggttttaaacggttatttaacgttaccngggttaacttagtaaccgtaaccctttaacgttaaacctaagggttacgttgggtaccggggtaacgtcccggggtaccggtaaacgggtaacgggttaaaccgggtaagggtttaaccgaaacggttacggaaacggtccgtttagtacgggtccggactacgggacccttacgttc

SEQ ID NO: 99904 - DNA, 724 bp, Homo sapiens
  misc_feature: GYAE6OF02GFCG2.40.81.H04.1.454.CMB.1.raw
  modified_base (195)..(195): a, c, t, g, unknown or other
  misc_feature (195)..(195): n is a, c, g, or t
  modified_base (269)..(269): a, c, t, g, unknown or other
  misc_feature (269)..(269): n is a, c, g, or t
  modified_base (357)..(357): a, c, t, g, unknown or other
  misc_feature (357)..(357): n is a, c, g, or t
  modified_base (535)..(535): a, c, t, g, unknown or other
  misc_feature (535)..(535): n is a, c, g, or t
tcagtctagcgactcacgaccggtgctcgatttagtagtgtagattcgcgggggaggagcatcacccagcaaccacatctgtcctctagagaatcccctgagagctccgttcctcaccatggactgacctggaggatcctcttctaggtggtcaggcagccgcaggtacgcccactcccgaggtcgcagctggtncagtcgtggggactggaggtagaagaacggtccgtgggggcctcgggaggtaacggtctacgtcgactaaggtntttccggtaggaaacctaccgtgaggacctaactactacactacacgtaggatacggcggaccacggcccgtaggacgttcgggtagnggtgggacgtggggtacgagtttaccgaaacccggttacgaggtacgggtacgtacgtaaaccgaaaagttcgaccggaaagtacgtaacgtttgaacgggtgacgggtacacgtacgttacgacgttacgggaaccgtccgtacacgttacgacgtacgaaccgtagttaacaccgngttacgacgtacgttaggaccgaccggttagtaccgtacgtaccgtaccgaacgggaaccctacgggtaccctaagtaccgttttacgaccgtttacggggtaacggaacgttaaggtacccgggttagtccggggtttaacgacccgggttcgggggactttacgggaccgttcgggtaaccccgggg

SEQ ID NO: 99905 - DNA, 917 bp, Homo sapiens
  misc_feature: GYAE6OF02F8FB6.40.81.H04.1.454.CMB.1.raw
  modified_base (912)..(912): a, c, t, g, unknown or other
  misc_feature (912)..(912): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaactcccctgagagcttcccgttcctcaccagtggactcggaccgtggaggacttcctctttcgttggtcggcagcacgccgcgaggacgcccacctcccgagggtcgcgagcgtggtcgcgacgttcggtggggtcctaggtaggtaggtaaacggaacggtcccgggttcgggggtcccggttcggggtaacgggtaaaccgggttccgtcccgtacggtaccggtaaaggtttacgttttaccggtaaacgggtaaaaccccgtacccggtagggtaaccgtaaccgtaaaccttaaccgtaaaccgtaacttaaccgtacgttacggtacggttcgggtacccgggaccggacccggggtacccggttacggggtaaaccggggtttagggggtttacgggtaacgggtacgggttacgggttacggggggtaacgtaaccgttaaccccggtaaacccccggttaacggaacggggtacggggtaaccggaacccgtaaacgtaaaaaccgggttacgttaacccgggtaaccgttaaacggtttaaccgtttaacggggaaccgggaccggttaaccgggtaccttaaaccggtagttaacccgggtaccgggtacgggtacccggtacccgttaaccgccgtaccgggaacctaaccgttaaccgtaccggtttaaccgtaacgtaggttaaccgggtacgtccggtacgggaccgggtttcccgggacggttacgggaacggaccgggtacggtcctaagggttcgagtacgcgagnggtac

SEQ ID NO: 99906 - DNA, 711 bp, Homo sapiens
  misc_feature: GYAE6OF02FV2ED.40.81.H04.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (286)..(286): a, c, t, g, unknown or other
  misc_feature (286)..(286): n is a, c, g, or t
  modified_base (375)..(375): a, c, t, g, unknown or other
  misc_feature (375)..(375): n is a, c, g, or t
  modified_base (704)..(704): a, c, t, g, unknown or other
  misc_feature (704)..(704): n is a, c, g, or t
tcagtctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatccctcttcgttggtggcngcagcccgngaggacgcccctacctcccagggtcnccgagcctggtgcagttcgtggggctgaggtgaagagccgtggggcctggagtaggtcncctgacagtattcacggaaaccacctagacactaactactacactacacgtgacgtgcggtcgtacgcccgtaggacgttaggggttanacggtggaaggttgggtacgtacctaccctaaaccccggtacgtagggtaacgggtcgaaccgaaacggtaaaacgttcgtaacccggtaaaccgtaagtttaacccgggtttacgggaaacggggcccgtaacggggttacccaacgtacggttaccgggtacccggtaaaggggcccgtacctaccccgtagtaccggacgtaaccgtaccgtaacggttaacctaaccgtaggttccgtaaccgttcgtagggacccggtacccgggttaagtaccgtaacccgtaggttccgaacgcccgtaacggtcctacgtttcggtaattntaacggg

SEQ ID NO: 99907 - DNA, 751 bp, Homo sapiens
  misc_feature: GYAE6OF02G0AC9.40.81.H04.1.454.CMB.1.raw
  modified_base (680)..(680): a, c, t, g, unknown or other
  misc_feature (680)..(680): n is a, c, g, or t
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcgttggtcggcagcgagccgcaggacgcccctacctcccgaggtcgcacgcgttgggtgcgtaggttcgtcgggggtactggaagggttaggaaaggaacggcccggttcgggggcccgttcgggtaggaaacgggttccttcccgtggaccgaaagttacttttacgaccgggtaaaccaccctagacgacaacctactactactactacgtaggacgtggcggtccgacggtccccgtagggacggttagggttgacggtgggtaggtgggtcgtacgtaccaaccgtcgaaggcgtacgacgtaacgtaagtacgtacgaacgtaagttacgttacggtagggcggtagggtacccacgtacggtaccgtcggtacgggtccgtacgtcccagtaccgaggtacctacgtaggttaccacgtacggtttagtaacgtcgtaggacggtccggtacgtcccggtacacggtaccggtaccgaccgacccggtattggtaccgttagttaacggtagggtaacggcggttaacggnggtttacgggccggttacccggtacggggtacccggtacggtacgggtcccggtaccggtaacccgggggg

SEQ ID NO: 99908 - DNA, 890 bp, Homo sapiens
  misc_feature: GYAE6OF02HP081.40.81.H04.1.454.CMB.1.raw
tcagtctagcgactcacgaccggtgctcgatttagtagtgtagattcgcgggggagagcatcacccagcaaccacatctgtcctctagagaatcccctgagagctccgttcctcaccatggactggacctggaggatcctcttcttggtgcagcacgccgcgaggacgcccacctcccgaggtcgaccgaggccgttgggtacgcgtaacggttccggttacggggggtccttgggaagggttacggaaaggtaacggtccgggtacgggggtcccgttacggggttacgggtaaacgggttccttacccggttacggaaccgttaaaggttaacttttaccggtaaaccgggtaaaacccctacccggtaacggacgtaaacccgtaaaccgttaaccgttaaacgtaaccgtaaccgtaacggttacggtacggttaccgggacccgggaccgttaacccggggtcccccggttaagggggttaaccgggtttaggggggttttacggtaacgggttacggggtacggggttacgggggttacgtaaccgttaacccgtaaacccggtacggtaacgggtcgggtacggtaaccgtaaacgtaacggtacgtaacgtaacgtaacgttaaccgttacggacggtaccggtacggtaccaaccgtacgtaccgggtaccggtacgggaccgtacgtaccgtacgtaccgacgacgtacgtacgtaccgtactacggtacgtacgtacggtacggacgtaccggtaacgtccgtaccgttcgaacgaccgacggacgtctaacgttcgttagtcggtaggaacggtaacgtacggtacggttcggacggtaccggtcggccggtccgtaacggaccggtacggtaccggg

SEQ ID NO: 99909 - DNA, 782 bp, Homo sapiens
  misc_feature: GYAE6OF02JKPHS.40.81.H04.1.454.CMB.1.raw
tcagtctagcgactcacgaccggtgctcgatttagtagtgtagattcgcgggcgtagactttgtgtttctcgtagtctccctgctcagctcctggggctgctaatgctcgtgggtctctggatccagtggggatattgtgatgactcagtctccactcctccctgccctcctactcctggagcggccggccctcctctcctcctgactaggtctagtcagacgcctacctaaacactagtggtactactactcgtttagtaacttggtaccttgacctagaacggcccgtaggctacgtcctccgacgcgtcttcttagtacttagttaggtttgggttcttacgtccggggtccccggtccggggtcccttacggtacggttacggtttaccggacgggtttcgggacttaacgggggttcgtaaacggttccggtaaccgttacgaaccggtaaactttaaacgttttttaacccgaaaccgtttaaaggaaaacccgttccggacgggtacggttacggggggtaagggaagggtaccggaagtaaggtacgtttagggttttcggtttaagtttagttacgtctacgttcgttaacggtacctaaccggttaccgtaaacctaacggttcgggttacggttaccgggacccgggtaacgggaccggttaaccgggtaaccggtaggtaacgtaagtacggacggaacgtacggaggttacggtacgtccgtaccgacgtacgttacgttccgttactaccgttcgtaccgttacccgg

SEQ ID NO: 99910 - DNA, 798 bp, Homo sapiens
  misc_feature: GYAE6OF02I836J.40.81.H04.1.454.CMB.1.raw
tcagtctagcgactcacgaccggtgctcgatttagtagtgtagattcgcgggggtgccctgagagcatcacccagcaaccacatctgtcctctagagaatcccctgagagctccgttctcaccatggactggacctggagatcctcttcgttggtggcagcagccgcaggacgcccactcccaggtgcagcgtggtgcagtcgtgggctagaggtgaagacggccgtcggggtcctcggtagaacggtccttaccgtggacgtaagttactttaccgtacgggtaaaacctaccgttacggaacgtaacctaaaccgttaactaaccgtaattaaccgacgttaagggtacgtacggccgggtaaccgaccgggtacccccggtagggtaaccgggttagggggtttcgtaacgggttagggtaagggttcgggggttagaacgtaacccgtaaacccgtaacggaacggtaacgggtacggaacgtaaacgtaaacgtacgtaaccgaacgtaacgttacgttacggaagggtaccgaacgggtacctaacgtcgacggtaccggagggtaccgtacggtaccctacgtacgacgtaacgtacgtacttaccgtaactacggagttacgtaccgggtacgaccggtccgtacggtacgtaccctaggtacggtaacgtaccgaccgttaccgtagttaccggttaagttaccgttaggggaacgttaacggaccgggtttaaccgggttagggtaccggtacccggttaccgggggcggttacccgttaacccgggg

SEQ ID NO: 99911 - DNA, 740 bp, Homo sapiens
  misc_feature: GYAE6OF02G9LGN.40.81.H04.1.454.CMB.1.raw
  modified_base (599)..(599): a, c, t, g, unknown or other
  misc_feature (599)..(599): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtgcagcacgccgcgaggacgcccacctcccaggtcgcagtcgtggtgcgtagtcgtgggctggaggtagaagacgcgtcgggccgtggtagacggtcctcgtgacaagtcttcgaggaaccaccgtagacgacctaacttactaacgtactactaacgtggtaacgtcggccggaccgaccggtaccccgtaggggtaccggtagggggtttcggaggtggagggttggggtacggaacgtaccccggaaacccgtaacgacgggtaggtacggaacctaaacgtaaacgttactaccggaacgttaaccgttaacgttttacggaacgggtacgggtaaccggttacccaaccgtacggtttaacccggaccccgggtaagggtcccggaccccggttaactacccggtacgtaacggtaccgtaaccgtactcgtaaccgttagtacggtntacggtacggacgtaccgtagtaaccgcgtaacgtcgaactacggacactacggtgtaccgttagagggtacggtaacgcggttacgtcggacggtaccggtcggacgggttcgaccgttacgcgggtaccgtaccccggg

SEQ ID NO: 99912 - DNA, 671 bp, Homo sapiens
  misc_feature: GYAE6OF02F73G4.40.81.H04.1.454.CMB.1.raw
  modified_base (590)..(590): a, c, t, g, unknown or other
  misc_feature (590)..(590): n is a, c, g, or t
tcagtctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcacgccgcaggacgcccactcccaggtgcagcgtggtcgcagtcgtcggggctggaggtgaaaggacgccgtcggggcctcggaggaacggtcctcctgacgaagtatttccgtacggaaacctacccgtgaacgaccaaacgtactacacttacacgttaggatggacggacgaccggtaccccgtagggacgtaggggttcgaaggtgggtagtgggggtacgacgtacccgaaacccgtacgagggtacggtacggacaaacgtaaagtacgacgaacgtaacgttaacgttacggtacgggacggtacggtccaacgtacgtacggaccggtcgggaccgtcgtaccacgtccgagaccgacgtacgttctacgacgttggtactcgtaggacggaccggtacgttccgtaccgtgtacgaaccgacgtaccgngtagttacagtcgaggtacggaaggtcgtacggtcgtaacgccggtccggtacgggcctcgaccggtcggccgggtaacgg

SEQ ID NO: 99913 - DNA, 663 bp, Homo sapiens
  misc_feature: GYAE6OF02IGAVX.40.81.H04.1.454.CMB.1.raw
  modified_base (263)..(263): a, c, t, g, unknown or other
  misc_feature (263)..(263): n is a, c, g, or t
  modified_base (390)..(390): a, c, t, g, unknown or other
  misc_feature (390)..(390): n is a, c, g, or t
  modified_base (431)..(431): a, c, t, g, unknown or other
  misc_feature (431)..(431): n is a, c, g, or t
  modified_base (501)..(501): a, c, t, g, unknown or other
  misc_feature (501)..(501): n is a, c, g, or t
  modified_base (610)..(610): a, c, t, g, unknown or other
  misc_feature (610)..(610): n is a, c, g, or t
  modified_base (629)..(629): a, c, t, g, unknown or other
  misc_feature (629)..(629): n is a, c, g, or t
tcagtctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctcccctgccccgtcaactccctggagagcccggcctaccatccgtaccctgcaacgggtctaagcaggatccctcctaaaacacctaaagtggaactacttacctntttgaatttggtacctgcagaaacgccaagggcaggtctaccgacagtcctcgtgaatattattggggtttacttacggtcgggcccgttacccggggtccctagaccgtagggtttcaggttcganaggtggaatccagtcccgaataagtcttttaaccagttaanaaaagtcaagcgtagggtaggaagcgtaaggaagattggtacgggaattttaccgtatagtacccgtaancggtaccaaacgtctaaaccggaaacttagtaggtacgacgggtcggaccctaaaggggaacctaaacggggttagaaaagttccaacgggacgaaaccgtttgggacnccggttacggacaaccctntaacgttccgtaacttctagtacccttaccccgg

SEQ ID NO: 99914 - DNA, 787 bp, Homo sapiens
  misc_feature: GYAE6OF02JZ2EB.40.81.H04.1.454.CMB.1.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (566)..(566): a, c, t, g, unknown or other
  misc_feature (566)..(566): n is a, c, g, or t
  modified_base (695)..(695): a, c, t, g, unknown or other
  misc_feature (695)..(695): n is a, c, g, or t
tcagtctagcgactcacgaccggtgctcgatttagtagtgtagattcgcggggactcgatcaggactcctcagttcaccttctcacaatgaggctccctgcctcagctccgtgggctgctaagtcgctctgggtctcgtggactccgaggtgggatattgtgatgactcgtagtctccnctcctcccgtgcccgtaccnctccgtgggaacgnggcccggtcctaccgtattccgtcctgccgtaacggtcgtacgtaccaggtaccgtcccttaaccctaaacggtaacttaagtcggtaacttaccgttaacttcggtttaagacgttttaccggtaaccttggaccgacggtaaacgcccgtaagggtcctacgtcctaaccgacgctaccgttctagtataacgttgtttcggggtacttcggccggtaccgttacccggcttaggtaaccgtgggtcacggtacgtcgtagtaccgggtactcgacggttcgtaacgtaaggtttactaacgtaaacgtaacggtaaactccgtgggttacgtaagggggtcgtaaagggnggtaaacgttggaaaggttttccgggttaaggtattttaacgggttacgtacgaacgttacggaaccttacccgtaaacgttaaccttaaccggtaaaggtttccggtaacgggtacggtaacccggtntaacccggggtaaaccggacgtaagggtaaacggtaccgaacgggtaacgtacggttaaacgcgggtttacgtacccggagtttaaacccgg

SEQ ID NO: 99915 - DNA, 224 bp, Homo sapiens
  misc_feature: GYAE6OF01DE3RW.41.35.D02.1.454.CMB.1.raw
  modified_base (215)..(215): a, c, t, g, unknown or other
  misc_feature (215)..(215): n is a, c, g, or t
  modified_base (221)..(224): a, c, t, g, unknown or other
  misc_feature (221)..(224): n is a, c, g, or t
tcagtctatactatcacgaccggtgctcgatttagcacacgatagttgggtttggggccagggaacccaggtcaccgtctccccagcctccaccaagggcccatcggtcttccccctggcgccctgctccaggagcacctccgagagcacagcggccctgggctgcctggtcaaggactacttccatagtatagactgagcgggctggcaaggcncatagnnnn

SEQ ID NO: 99916 - DNA, 222 bp, Homo sapiens
  misc_feature: GYAE6OF02G5IXI.41.35.D02.1.454.CMB.1.raw
  modified_base (220)..(222): a, c, t, g, unknown or other
  misc_feature (220)..(222): n is a, c, g, or t
tcagtctatactatcacgaccggtgctcgatttagcacacgatagttgggtttggggccagggaacccaggtcaccgtctccccagcctccaccaagggcccatcggtcttcccctggcgccctgctccaggagcacctccgagagcacagcggccctgggctgcctggtcaaggactacttccatagtatagactgagcgggctggcaaggcgcatagnnn

SEQ ID NO: 99917 - DNA, 417 bp, Homo sapiens
  misc_feature: GYAE6OF02GUXWI.41.35.D02.1.454.CMB.1.raw
  modified_base (407)..(407): a, c, t, g, unknown or other
  misc_feature (407)..(407): n is a, c, g, or t
  modified_base (413)..(417): a, c, t, g, unknown or other
  misc_feature (413)..(417): n is a, c, g, or t
tcagtctatactatcacgaccggtgctcgatttagcacacgatagttgggttgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcaactggctcgacccctggggccagggaaccctggtcaccgtctcctcagcctccaccaagggcccatcggtcttccccctggcaccctcctccaagagcacctctgggggcacagcggccctggctgcctggtcaaggactacttccacgtctactgctgagcgggctggcaaggcncatagnnnnn

SEQ ID NO: 99918 - DNA, 175 bp, Homo sapiens
  misc_feature: GYAE6OF01EHJLJ.3.15.B04.1.454.CMB.1.raw
  modified_base (167)..(175): a, c, t, g, unknown or other
  misc_feature (167)..(175): n is a, c, g, or t
tcagagacgcactccacgaccggtgctcgatttagacagtatatatccgcgggcacgaccggtgctcgatttagtagtgtagattccgcgggctggcaaggcgcatagctgcctggtcaaggactacttccgagtgcgtctctgagcgggctggcaaggcgcatagnnnnnnnnn

SEQ ID NO: 99919 - DNA, 190 bp, Homo sapiens
  misc_feature: GYAE6OF01CG8P8.3.15.B04.1.454.CMB.1.raw
  modified_base (167)..(190): a, c, t, g, unknown or other
  misc_feature (167)..(190): n is a, c, g, or t
tcagagacgcactccacgaccggtgctcgatttagacagtatatatccgcgggcacgaccggtgctcgatttagtagtgtagattccgcgggctggcaaggcgcatagctgcctggtcaaggactacttccgagtgcgtctctgagcgggctggcaaggcgcatagnnnnnnnnnnnnnnnnnnnnnnnn

SEQ ID NO: 99920 - DNA, 189 bp, Homo sapiens
  misc_feature: GYAE6OF01DIMO0.3.15.B04.1.454.CMB.1.raw
  modified_base (167)..(189): a, c, t, g, unknown or other
  misc_feature (167)..(189): n is a, c, g, or t
tcagagacgcactccacgaccggtgctcgatttagacagtatatatccgcgggcacgaccggtgctcgatttagtagtgtagattccgcgggctggcaaggcgcatagctgcctggtcaaggactacttccgagtgcgtctctgagcgggctggcaaggcgcatagnnnnnnnnnnnnnnnnnnnnnnn

SEQ ID NO: 99921 - DNA, 193 bp, Homo sapiens
  misc_feature: GYAE6OF01ENROS.3.15.B04.1.454.CMB.1.raw
  modified_base (167)..(193): a, c, t, g, unknown or other
  misc_feature (167)..(193): n is a, c, g, or t
tcagagacgcactccacgaccggtgctcgatttagacagtatatatccgcgggcacgaccggtgctcgatttagtagtgtagattccgcgggctggcaaggcgcatagctgcctggtcaaggactacttccgagtgcgtctctgagcgggctggcaaggcgcatagnnnnnnnnnnnnnnnnnnnnnnnnnnn

SEQ ID NO: 99922 - DNA, 155 bp, Homo sapiens
  misc_feature: GYAE6OF01ANUX1.3.15.B04.1.454.CMB.1.raw
  modified_base (128)..(155): a, c, t, g, unknown or other
  misc_feature (128)..(155): n is a, c, g, or t
tcagagacgcactccacgaccggtgctcgatttagacagtatatatccgcgggctggcaaggcgcatagctgcctggtcaaggactacttccgagtgcgtctctgagcgggctggcaaggcgcatagnnnnnnnnnnnnnnnnnnnnnnnnnnnn

SEQ ID NO: 99923 - DNA, 174 bp, Homo sapiens
  misc_feature: GYAE6OF01ELJ41.3.15.B04.1.454.CMB.1.raw
  modified_base (167)..(174): a, c, t, g, unknown or other
  misc_feature (167)..(174): n is a, c, g, or t
tcagagacgcactccacgaccggtgctcgatttagacagtatatatccgcgggcacgaccggtgctcgatttagtagtgtagattccgcgggctggcaaggcgcatagctgcctggtcaaggactacttccgagtgcgtctctgagcgggctggcaaggcgcatagnnnnnnnn

SEQ ID NO: 99924 - DNA, 172 bp, Homo sapiens
  misc_feature: GYAE6OF01A5EEE.3.15.B04.1.454.CMB.1.raw
  modified_base (167)..(172): a, c, t, g, unknown or other
  misc_feature (167)..(172): n is a, c, g, or t
tcagagacgcactccacgaccggtgctcgatttagacagtatatatccgcgggcacgaccggtgctcgatttagtagtgtagattccgcgggctggcaaggcgcatagctgcctggtcaaggactacttccgagtgcgtctctgagcgggctggcaaggcgcatagnnnnnn

SEQ ID NO: 99925 - DNA, 166 bp, Homo sapiens
  misc_feature: GYAE6OF02GK7PQ.3.15.B04.1.454.CMB.1.raw
  modified_base (149)..(149): a, c, t, g, unknown or other
  misc_feature (149)..(149): n is a, c, g, or t
  modified_base (151)..(166): a, c, t, g, unknown or other
  misc_feature (151)..(166): n is a, c, g, or t
tcagagacgcactccacgaccggtgctcgatttagacagtatatatccgcgggcacgaccggtgctcgatttagacagtatatatccgcgggctggcaaggcgcatagcgggctggcaaggcgcagagcgggctggcaaggcgcatagngnnnnnnnnnnnnnnnn

SEQ ID NO: 99926 - DNA, 189 bp, Homo sapiens; identical to SEQ ID NO: 99920
  misc_feature: GYAE6OF02FOMEK.3.15.B04.1.454.CMB.1.raw
  modified_base (167)..(189): a, c, t, g, unknown or other
  misc_feature (167)..(189): n is a, c, g, or t

SEQ ID NO: 99927 - DNA, 171 bp, Homo sapiens
  misc_feature: GYAE6OF02FZ22C.3.15.B04.1.454.CMB.1.raw
  modified_base (167)..(171): a, c, t, g, unknown or other
  misc_feature (167)..(171): n is a, c, g, or t
tcagagacgcactccacgaccggtgctcgatttagacagtatatatccgcgggcacgaccggtgctcgatttagtagtgtagattccgcgggctggcaaggcgcatagctgcctggtcaaggactacttccgagtgcgtctctgagcgggctggcaaggcgcatagnnnnn

SEQ ID NO: 99928 - DNA, 583 bp, Homo sapiens
  misc_feature: GYAE6OF01BDOD7.47.73.G07.1.454.CMB.1.raw
tcagagctcacgtacacgaccggtgctcgatttagctctacgctcagggggcaagaagtctctctcagtccaggacaccagccactggacctatgagggtccctgctcagcgtcctgggacctcctgctgctctggctcccacgataccagatgtgaccagtccagaatgacccagtctccatcctccctgtactgcatctagtaggagacactagtcaccatcacttgccggctaacgtcgagacgcattaacagcgtattaatggtatacaccagaaccaggaacgccctaactcctgatctatgctgcatccagttgcatagtgggtcccacgtcgtagttcagtcggctacgtggactcgtagggacgagtatttcactctccgaaccatcgaagtccagtctagctaaccgtgtaacgtagtttacgcgtaacgttacgtaccgtagtacctaacgtacggtacgttaccggtaccccgtacgtaccgttttacggcccgtaggggacccctaaacggtcggaacctacgtaccgtaaaccgtaacccttacggtacggtaccgtcgtccgtaacccg

SEQ ID NO: 99929 - DNA, 575 bp, Homo sapiens
  misc_feature: GYAE6OF01AKCNY.47.73.G07.1.454.CMB.1.raw
tcagagctcacgtacacgaccggtgctcgatttagctctacgctcagggggcagaagtctctctcagtcaggacacagcatgggacactgagggtccctgctcagcttcctgggactcctgctgctctggctcccagataccagatgtgacatccagatgacccagtctccatcctcctgtctgcatctgtaggagacacagtcaccagtcacttgccgggcgagtcgaggacattagcaattatttagcctggtatcaggcagaaaccagggaaagttcctaagctcctgatctatgtacatccacttgcaattcggggtccatctcggttcagtggcagtggatcgtgggacagatttcactctcaccatcagcagccctgccacgtccctaggaacgtactagttacgactaaacctttaatttaaccttacgttaactaaaaacgttaactaaacctaaggtaccgccccggtactaccgtaaccgttttccgggaccgggtaacggggacccgtaaagggtcgggaaggtaacgttacgtaaaaccggtaaccgttgggtacggtaccgg

SEQ ID NO: 99930 - DNA, 482 bp, Homo sapiens
  misc_feature: GYAE6OF01AULWS.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcagtcaggacattagcaattatttagcctggtatcagcagaaaccagggaaagttcctaagctcctgatctatgttacatccactttgcaattcggggtccatctcggttcagtggcagtggatctgggacagatttcactctcaccatcagcagcctgcagcctagaagatgttgctaacttattactgtacaaaattataacagtcgacccgctacactttcggcggaggaccaaggtgagtatacaaacgactgtggtacg

SEQ ID NO: 99931 - DNA, 560 bp, Homo sapiens
  misc_feature: GYAE6OF01EO8D0.47.73.G07.1.454.CMB.1.raw
tcagagctcacgtacacgaccggtgctcgatttagctctacgctcagggggcagaagtctctctcagtcaggacacagcatggacatgagggtccctgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtgggtcccatcaaggttcagcggcagtggatctgggacagatttcactctcactatcagcagcctgcagcctagaagtattttaggaactttattatttgtacaacgtaggggtaactacggttttccccgcttccgtaccctttcgggacggtaggggacccaaagggttgggaagtaagtacggaaaaaggtaaccgttgggtagggcttaggaccaaccctaagttccgttggttcctttacccg

SEQ ID NO: 99932 - DNA, 512 bp, Homo sapiens
  misc_feature: GYAE6OF01CGUCV.47.73.G07.1.454.CMB.1.raw
  modified_base (219)..(219): a, c, t, g, unknown or other
  misc_feature (219)..(219): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggngagtcagggcgttgcaatgctttggcctggtttcagcagacacgagggaagccctaagcgcctgatctatggtgcatacactttgcaaagtgggtcccatcaaggttcagcgcagtaggtcgtgggacagagtcactctcactatcagcggctgcagcctgagtattctgactaacttatactgtctacagtatgatcgtcttacccgtcggtaccttttcgggacccgtaacggggtacccgaagggtacggtaaaacgtaccgtaaaacgtaacgtaggtcgggctaccgg

SEQ ID NO: 99933 - DNA, 487 bp, Homo sapiens
  misc_feature: GYAE6OF01BLM9M.47.73.G07.1.454.CMB.1.raw
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagcaattatttagcctggtatcagcagaaaccagggaaagttcctaagctcctgatctatgttacatccactttgcaattcggggtccatctcggttcagtggcagtggatctgggacagatttcgactctcaccatcagcagcctgcagcctgaagatgttgctaacttatactgtacaaaaatntaacagtcgccccntcacgtttcggcggagggccaagggtggaagtatacgaaacgactggtggtaccg

SEQ ID NO: 99934 - DNA, 564 bp, Homo sapiens
  misc_feature: GYAE6OF01DLOW0.47.73.G07.1.454.CMB.1.raw
  modified_base (194)..(194): a, c, t, g, unknown or other
  misc_feature (194)..(194): n is a, c, g, or t
tcagagctcacgtacacgaccggtgctcgatttagctctacgctcagggggcagaagtctctctcagtcaggacacagcatggacatgagggtccctgctcagctcctggggctcctgttgctctggttcccaggttccagatgcgacatccagatgacccagtctccatcttctgtgtctgcttctgtagganacagagtcaccatcacttgtcgggcgagtcagggtattagcaactggttagcctggtatcaacagaaaccagggaaacgcccctaacctcctcatctctactgcactcctacttttgactaaaggtcggggtacccagtaccgaaaggttcaaggcggcaggtggatcgtgggacagtatttcacttctacactatcagcagcctgcagcctagaagtattttaggaactttattattgtacaacgtagggtaacctcgtttacccgcttaccaccgttcgggacggtaacgggaccgtaagggtcggaagtaagtaaggaaaagtacgtggtacggctacgaccaacctagttccgttgttccttaccg

SEQ ID NO: 99935 - DNA, 510 bp, Homo sapiens
  misc_feature: GYAE6OF01ERXVG.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcagtcaggacattagcaattatttagcctggtatcagcagaaccagggaagttcctaagctcctgatctatgttacatccactttgctaattccggggtccattctcgttcagtggcagtggatcgtgggacagtattcactctcaccatcagcagcctgcagcctagaagtatgttcgactaacttattactagtaactaaaatataacagtcgccccgtatacctaccgtttcgggacgggacgggaccgaagggtaggaagaactacgaaaacgacgttggtggtaccg

SEQ ID NO: 99936 - DNA, 610 bp, Homo sapiens
  misc_feature: GYAE6OF01DWJPB.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttggccgggcgagtcaggacattagcaattatttagcctggtatcagcagaaaccagggaaagttcctaagctcctgatctatgttacactcctactttgactaacgttcggggtccctattccgttcggttactaggtggacgaggtggtatcgtagggactagtatttcactctcacctatcacgcacgtcctgaccacgtcctagaacgtattgttacgaacttaactttactttaacgttagttaaactaaaaacttaacgtaaccgtacggttacccgtaccccgtacttaccgttaccggtttccggggaacggggtaacggggtaaaccggtaaacggggtacggaaacgtaacgtaaaccgtaaaccggtaaccgttgggtcgggtaacccg

SEQ ID NO: 99937 - DNA, 837 bp, Homo sapiens
  misc_feature: GYAE6OF01DBA9O.47.73.G07.1.454.CMB.1.raw
tcagagctcacgtacacgaccggtgctcgatttagctctacgctcagggggcgagaagtctctctcagtcaggacacagcatggacatgagggtccctggctcagctcctgggactcctgctgctctggctctcaggtgccaggatgtgacacccagatgacccagtcctccatccctccctgtctgcatcgtagtaggagacagagtccaccatcacttgaccaggcgagtcaggacattagactaacttattaaattggtatacagcaagaaaccgaaggaaacgcccctaagcctacctgactctaacgtatgacaactaccctaagtttacggaaacgtacggggtaccctaagtaccgtaaagggtttcgaacggttacggaaaggtgggaacgttacggtaggggtaactaaggttaacttttttaacctttaccgaaccctaagttaccgtaacggtaccctaacggtacccttaggacccgtaacgggtacccgttaagggtaaacgtaacgtttaaccgtttacgggtaaccctaaaacggttaacgtttaaacggtttaaccgtttaaccgggttaaccgtaaaaccgttaaccgggttaaactttaacccgtaaaccgtttaaaacccgtttaccccccgtttaaaccccccgttaaccccggttttttaccccgggggaaccccccccggtttaaggggggtaaaacccccttaaaacggggtttaaccgggtaaaccctttaaaccggttaaaacccccggtaaaaacccggttaaaccggttaggggttaaacccggttcccggttaaccggtaaacccccgg

SEQ ID NO: 99938 - DNA, 509 bp, Homo sapiens
  misc_feature: GYAE6OF01ADEZB.47.73.G07.1.454.CMB.1.raw
  modified_base (219)..(219): a, c, t, g, unknown or other
  misc_feature (219)..(219): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggnagtcaggacattagcaattatttagcctggtatcagcagaaaccagggaaagtcctaagctcctgatctatgttacatccacttgcaattcgggtccatctcgttcagtggcagtggatctgggacagtatttcactctcaccatcagcagcctgcagcctgaagatgtgactaacttattactagtaactaaaatataacagtcgcccgtctacctacgtttcgggacgggtaacgggacccgtaagggtacggaagtacgtacgaaaacggtacttgggtcggtaccg

SEQ ID NO: 99939 - DNA, 639 bp, Homo sapiens
  misc_feature: GYAE6OF01CMM98.47.73.G07.1.454.CMB.1.raw
  modified_base (219)..(219): a, c, t, g, unknown or other
  misc_feature (219)..(219): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggngagtcaggacattagcaattatttagcctggtatcagcaagaaaccgagggaaagttcctaagctcctgatctatgttacatcctacttgactaaggtcggggtaccctagtacaaggtttcaggcggacaggtaggtcgtgggacagagttcacttctctactatcaggccggtacctgccacgtccgtagaagtactttcgtagtacctaaacgtttactttaaccgttcgttaccgttacctaaggtttacttacggtacgttaccgtaccctttacccccggttccgggttaacccgtttttacccggggaaccccggtaaacgggggtaaaccccgtaaaggggttaaccgggtaaaaacgttaccggaaaaacccggttaacgttagggttacggaccgttccggtaaaccccg

SEQ ID NO: 99940 - DNA, 513 bp, Homo sapiens
  misc_feature: GYAE6OF01B9GH5.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcagtcaggacattagcaattatttagcctggtatcaacagaaaccagggaagttcctaagctcctgatctatgttacatccactttgcaattcgggtcccatctcggttcagtggcagtggatcgtgggacagtatttcactctcaccatcagcagcctgcagcctgaagatgtgactaactttattactgtaactaaaaattataacagtcgccccgtctccgtactttccgggacggtagggaaccgtaagggtacggaagtaagtaccgaaacgaacgtcggtggcgtacgg

SEQ ID NO: 99941 - DNA, 499 bp, Homo sapiens
  misc_feature: GYAE6OF01E15GZ.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagcaattatttagcctggtatcagcagaaaccagggaaagttcctaagctcctgatctatgttacatccactttgcaattcggggtccatctcggttcagtggcagtggatctgggacagtatttcactctcaccatcagcagcctgcagcctgaagatgttgctaacttattactgtacaaaatataacagtcgccccgtctcctaccgtttcggacgggaacgggaccaagggtggaagactacgaaaacggactggtggtaccg

SEQ ID NO: 99942 - DNA, 553 bp, Homo sapiens
  misc_feature: GYAE6OF01APYE0.47.73.G07.1.454.CMB.1.raw
  modified_base (194)..(194): a, c, t, g, unknown or other
  misc_feature (194)..(194): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacacagtcaccatcacttggccggcgagtcaggacattagactaattatttagcctggtatcagacaagaaaccgaggggaaacgttacctaaagctcctagatactatgttactatacctatttcgactaacgttccggggtccctagttccgtcggttctagtggcgtaggtggtatcgtggactagtactttcacttcctacacctatcacgcacgcctgcacgctagaagtntgttanactaacttattaactagtaactaaaatactaacgacgtcgcccgtactaccgtaccgttcgggacggtaacgggacgtagggtagaacgtaactacgaaacgtacgtggtggtaccg

SEQ ID NO: 99943 - DNA, 578 bp, Homo sapiens
  misc_feature: GYAE6OF01AH42Z.47.73.G07.1.454.CMB.1.raw
  modified_base (198)..(198): a, c, t, g, unknown or other
  misc_feature (198)..(198): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccactggagaaatagagatgacgcagtctccagccaccctgtctgtgtctccgaggggaancgccaccctctcctgcagggccagtcagagtattagcagcaacttagcctggtaccagcagaaccgtgggcacggctcccgaggcctccgtcatcctagtggtcgcactcccgaccgacgggcctacgtcggtactcccgagccctaggttcaggtcggctagggtcgggtcgtgggactaggtacgttcactcgtccacactcgacgcacgcctgctagtctagaagttatttgacttaattttagttactgtactacgtactaagttaattaacgtaacgtcggaccttccggtccgttaccggaccggtaacgggactaccgggtacgtacggtaacgtaaacgttaaaccggtaagttacggtcggtcgtaaccgg

SEQ ID NO: 99944 - DNA, 572 bp, Homo sapiens
  misc_feature: GYAE6OF01EMI0J.47.73.G07.1.454.CMB.1.raw
  modified_base (412)..(412): a, c, t, g, unknown or other
  misc_feature (412)..(412): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctcctgtctgcatctgtaggagacacagtcacatcacttggccgggcgagtccaggacattagactaattatttagcctggtatcagcagaaaccgagggtaaagttcctaagctcctagattctatgttacattccactttgctaagttcggggtcccatctcggttcaggtggcaggtggatcgtagggtacagtactttccacttctcacctatcaagcagcctgcagcctagaagtntcgttgactaactttattactagttaacaaaattactaacgtagtaccgtccccggtacttaccgtaaccgttttccggggaccggtaacggggtaaccccgtaaaggggttacggaaacggttactaaacccgtaaacggacgttgggtacgggtaccc

SEQ ID NO: 99945 - DNA, 522 bp, Homo sapiens
  misc_feature: GYAE6OF01D47LL.47.73.G07.1.454.CMB.1.raw
  modified_base (385)..(385): a, c, t, g, unknown or other
  misc_feature (385)..(385): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttggccgggcgagtcaggacattagcaattatttagcctggtatcagcagaaaccagggaaacgcccctaacctcctgatctatgctgcatccagtttgctagtaggtcggggtcccatctaggttcaggtgcaggtggatcgtgggacagatttcactctcacatcagcagtcngcaactgaatatttgctaacttctactgtacaacagtacgttaccggtaccccgtataccgttttaggacccgtaaggggaccctaaacgtcggaacctaataaccgtaaacggtaactaggtcggactggaacccg

SEQ ID NO: 99946 - DNA, 589 bp, Homo sapiens
  misc_feature: GYAE6OF01CX6YB.47.73.G07.1.454.CMB.1.raw
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
tcagagctcacgtacacgaccggtgctcgatttagctctacgctcagggggcagaagtctctctcagtcaggacacagcatggacatgagggtccctgctcagctcctgggactcctgcttctctggctcccagataccagatgtgacatccagatgacccagtctccatcctccctgtctgcatctgtagagacacagtcacatcacttggccgggnagtcaggacattagcaattattagctgtatcagcaagaaaccagggaaaagttctaacgctcctagatctacgatgcatcaattggaaacngggtaccatcaaggtcaagtggaagtgatctgggacagtattttactcaaccatcagtcagtcctaggacagcctagaacgtataagtttcgactaaacatttaacttactacgttacaaacgtagtaactactaacttaacttcccttaccccgttaaacgtttccccgggtacccgttaggggtaaaccctaaaagggttacgggtaaatttaaacgtaaccgtaaaaacgggttaaacccttaggttaccgggtaacttcgggtaaccctaaacccg

SEQ ID NO: 99947 - DNA, 696 bp, Homo sapiens
  misc_feature: GYAE6OF01C258T.47.73.G07.1.454.CMB.1.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
tcagagctcacgtacacgaccggtgctcgatttagctctacgctcgagggggcagaagtctctctcagtcaggacacagcatggacatgagggtccctgctcagctcctgggactctgctgctctggctccagactaccagatgagacatccaagactcgacccagtctccactcctccctgtcagctatcgtgaagganacacagtcaccatcacgttcgccgggacagtcgaggactattagactaaattattagcctggtancgaagacgaaacgaaaaccgagggtaaaactttccgaaacgctcctagacttactaagttgttaacacgttacctaactttttggaccgttaaacggtttccgggaccctaagttccggttccggtttacgaaagggtcggaacgtagggttgggtaaactccggtaggggaaacctaggttaacttttcccgaaatttcccaacccaataaaccggttcaaccgtaaccggaaggttacccctacgacgtacgtacgtacgtaacgtacgttacgttacgtaacttaacttaacgttaacgtaaacgtaaactaaactaacgtaacgtacgtaccgtacccgtaccgtaccgttaccggttaccggtacggaacggtaacggtaacggtaaggtaacgtaacgtaacgtaacgtacgtacggtacgtacg

SEQ ID NO: 99948 - DNA, 523 bp, Homo sapiens
  misc_feature: GYAE6OF01A1JMZ.47.73.G07.1.454.CMB.1.raw
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctctcagataccagatgtgacatccagatgacccagtctccatccctcctgtctgcatctgtaggagacacagtcaccatcacttgccgggcgagtcaggacattagctaattattagcctggtatcagcagaaaccgaggaagtcctaagctcctgatctatgttacatcctactttgctaagttccgggtcctagtctcggtcagtgcagtgntcgtggacngtacttcactctacaccatcagcacncctgcagtcctagatatgtgactaacttattaactgttaactaaaatactaacgtagtcgaccccgtataccgtacgtttccgggacgggtaacgggaacctaagggtcggtaacgtacgtaaccgtaaacggtacgtggtaccgg

SEQ ID NO: 99949 - DNA, 731 bp, Homo sapiens
  misc_feature: GYAE6OF01ASHMP.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtccaccatcacttggccgggcgagtcaggactattagctaattatttacgccttggtatcgagacctaacggaaaccgaaggggtaaacgtttacccgtaaacggccttacccgtaggtaacttacttaacgttacggtttaacctaacttacccgttaacttttacggtaccgttaaacggtttcccgggggttacccccttagttacccgtttaccgggtttaccgtagggttacggtaccgtaagggttcggtaacgttcggtacggggtaactacggttacttttccaaccgttcctacctaacccgtataccgacgtaccgtacgtcccgtgaccgacgtcccgttaaggaacgttacgttcggttacggtaacctttaaactttaacgtttaacgttaagttaaacctaaaaagttactaaaccgtcgtacccggtccctaccgttaccgtaccggtttccggggacggtaacgggtaccgtagggtacggaacgtacgtaacgaaacgtacggtggtcgtaccg

SEQ ID NO: 99950 - DNA, 877 bp, Homo sapiens
  misc_feature: GYAE6OF01EDQ7I.47.73.G07.1.454.CMB.1.raw
  modified_base (787)..(787): a, c, t, g, unknown or other
  misc_feature (787)..(787): n is a, c, g, or t
tcagagctcacgtacacgaccggtgctcgatttagctctacgctcagggggcagaagtctctctcagtcaggacacagcatggacatggagggtccctgctcagcctccgtgggacctcctgctgctctggctcccagataccagatgtgacatccagatcgacccagtcctccatccctcctgtctgcatcgtaggtaaggacaccacgtacgtacccaacctacttaccgtaccggttcgggcccgggggaccggtaacggttaccgaaacgggtaactaaacgtttaacggtaacctttaaaagtttttaaccgttttacggacccgttagggttaactacgaacggaaccgaaaacggtaaaacccggtaaaggggttaaaaccgtttacccgttaaacggtcccttacccgttagtacttttacttaacgtttaaccgtttaacctaacctttacccctttaacgttttacggaaccgtttaacccgggtttccggggttacccctaagtttcccggtttaccggtttacggaacggggtttcggacggttagggttacgggttacgttacgggtaccggggtaacttacggtttaacctttacccgtaccttacccgtacctaaaccgtactaccgaacgtccgaaccgtcccgtagacccgtaccggtacgttaacggtaaacgttcgtttacgtttaacgtaaccgtttaaaccttttaacgttaacttaagttaaaaccgttaaaactacggtaccgtaacccgtccgtaccccgttnttacccggtttacgggtccggggaagggtaaccgggtaaaccgaggggtacgaaacgtacgaaaccggtaacgtcggttgaccggtaccg

SEQ ID NO: 99951 - DNA, 615 bp, Homo sapiens
  misc_feature: GYAE6OF01DVNDI.47.73.G07.1.454.CMB.1.raw
  modified_base (220)..(220): a, c, t, g, unknown or other
  misc_feature (220)..(220): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttggccgggnagtcacgacattagctaattatttagcctggtatcagcaagaaaccgaagggaagttacctaagctctgatctatgttacatcctattttcgactaacgtttccggggtaccctattcgttcggttacaggtggacgtaggtggatcgtgggactagtatttcactctcaccatcagcacgcctgcacgcctagaagtagttagttcgtaactaacgtttaattaacgttagttaaaactaaaacttaacgtaactacggttacccgacccccgtacgttaccgttaaccggttttccggggaaccggggtaacggggtaacccggtaaaaggggttacgggaaacggttaaccgtaaaccgtaaaccggtaaccgttcgggtacgggtaacccg

SEQ ID NO: 99952 - DNA, 798 bp, Homo sapiens
  misc_feature: GYAE6OF01DPTZZ.47.73.G07.1.454.CMB.1.raw
tcagagctcacgtacacgaccggtgctcgatttagctctacgctcagggggcagaagtctctctcagtcaggacacagcatggacatgagggtccctgctcagctccgtgggactcctgctgctctggctcccagataccagatgtgacatccagatcgacccagtcctccatccctccctgtctgcatctgtaggacgacacacgtcaaccagttccaccgttcgggcccgggtcgtaacggtcgtagggtcgttcgacgtaaagttcgtcgttttcggcctttggtttaccacggaccaacggaacccgaacccggaacgggggaaacccggtacccccgtaaaggccccgtacccgtaggtaccttaccgttaagtcgggtactactaacgttaaccttaccgtttaggaaccgtaaacgggttccgggtaccctaagttacgaacggttcgacggtacggacgtagggtacggtacgtacgggactaggtacgttaccacgttacctactaacgttactacgacggccggtactcgaacgtaccgtccgtaagtaaccgttcttcgtaacgtaacctttaacgtttaaccgttacgttccgtttaacctaccgtaagttacgtacgaaccgtttacccgttacccgttaacccccggttacgggtttaacccgggttacccgggaaccccgggttaaacggggtaaacccggttaaaggggttaaaaccggtaaaacccgttaaaccgggaaaaccggtttaaggtttccgggtaaccggttcgtaaaccccgg

SEQ ID NO: 99953 - DNA, 649 bp, Homo sapiens
  misc_feature: GYAE6OF01C79OS.47.73.G07.1.454.CMB.1.raw
tcagagctcacgtacacgaccggtgctcgatttagctctacgctcagggggcagaagtctctctcagtcaggacacagcatggacatgagggtccctgctcagctccgtgggactcctgctgctctggcctccagataccagatgtcgacactcagatcgacccagtcctccacttccctcctgtctagctagttcgtaggtacggaacacaacgtagtaccaacctatccgtacgttcgggaccggagtacgtacgaaggtactaattacgacttaattacgttacgccgttagtactacgaagtacgaaacggtaaaaccggtaaggtaaccttaccaaacgtcctaccgttagtaccttacgttaagttacgtacgtaccttaaccgttacgttacgaacggtttaaccggttccgggcccttaagttcccggttacgtacgtcggtagtacgtaggtcgacgttgaacgggtatacgttacttctactcgtactacacgtacacgtacacgtacctgacgacgtacagtacgtactgtactactaattacgtactacgtaaactaatacgtacgtactacccgtcctcgttaccgcggttacggagtacggacgtaggagacgtacaacgtacggatgtcgtacg

SEQ ID NO: 99954 - DNA, 799 bp, Homo sapiens
  misc_feature: GYAE6OF01AH9NU.47.73.G07.1.454.CMB.1.raw
tcagagctcacgtacacgaccggtgctcgatttagctctacgctcgagggggcagaagtctctctcagtcaggacacagcatggacatgagggtccctgctcagctccgtgggactcctgctgctcgtggcctcccagataccagatgtgacatccagatcgaccctagtcctccactccctccctgtctgcatctggtaggacgacacacgtccaccatcctacgttcggccgggcgagtacgaaggtaactattacgacttaactttacgtttacggccgttaggtactacgaacggaccgaaacggtaaaaccgtagggtaaacttacctaaagtcctctagtaacttcgttaacgttcttaacctaccgttaccttacgtttcggtaaccgtaaccggttttcccggggtaccccttagttccggttaccgggttacgtacgggtcggtacggtagggttcggtaaggttccgggtaagggtaccttaacggttaccttttacccacctttacccgtaaccgtaacccgtaacctaacggacggtaccgtaccgtcccgttaagacccgtaaccggtcgtaaagggtaacgttaggtttaccgttaacgttaactttaaaccgtttagtttaaccttaaacggttaaaacctaaaacgttaccgtaacccgtccggttacccgtacccgttccgttaaccggtaaccggggtttccgggaaccgggtaacgggtaacccgtaagggttacggaaccgtaacctaaccggtaaaccgtcgttggtccggtaacccg

SEQ ID NO: 99955 - DNA, 729 bp, Homo sapiens
  misc_feature: GYAE6OF01AGTQN.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagacttccaccggagactatttggttttgacacagtcctccacgccctacccttgttcctttcggtcctaccggaaggggaaagacgcccacccctcctccgtgccgacgggcctagtccgaggtagttggttcgggactaggtaccttaacgttacgccgttacggtaacccaacgaacgtaaacccgtcggacccgacggtccctacccggacggtccttcctacgacttctagtgactcgactacgtaccgaacggacgggcccacggtcgccaccgtcccgacgcccgtaggttcgaggtcggactaggtcgtacggtcggtagggaacctacggtaccttactacctctacccaaccgtacttaccgacgaccgtaacgcccgtaaggccgtaccgttaaggtaaacctttgtttaccgacttttaacgttttactacggtggtcctaacgggtctaaccggttacgtaacgcccgtaaccggtcccggttcctaccgttcccggtaacgggttccgggggaaccgggtacgggtaccgggtaggggtaccgagtaccggtaagacccggtaacggtcgttggggtacctcg

SEQ ID NO: 99956 - DNA, 715 bp, Homo sapiens
  misc_feature: GYAE6OF01EKQXW.47.73.G07.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
tcagagctcacgtacacgaccggtgctcgatttagctctacgctcgagggggcagaagtctctctcagtcaggacacagcatggacatgagggtccctgctcagctcctgggactcctgctgctctggcctcccagacgaccacgtggaagaaatagtgatcgacgcagtctccagcccacccgtgtctgtcctcgtccgaaggggaancgcccactatctccgtggtacggccgtanagtagtatagctatcaacgttcgccgtaggtaccagcaaggacgtaccgtgggaccacggtcctacccggaggtcccttcctactaacgttcctagtagtacgtcggtacccgtacccaccgggacgggtccctacggtttccggttacccaggtccgtaggttcaggtcggcgtaggtccgcggtacgtaggggactacggtacgttcctaccgtcctaccgactaacgttacccaaacgtaccgtccttacggaccgtaggtttaccgtaagttaaacgtttcgtttttacgacgttttagttttaacttcggttagtaccgtacgttaacttaagttaacgtaacctaacgtttacccggccggtacccgttacccgtaaccgttaaccccgttaccggggaaaccgtaacgggtaacccacggtaacggtaacgaaacgtttaaacgttaaaccggacgtttgggcgtacccg

SEQ ID NO: 99957 - DNA, 785 bp, Homo sapiens
  misc_feature: GYAE6OF01DVEWV.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatcgaccagtcctccatccctccctgtctgcatctaggtaggacgacacagtccacctagtccacgttcggcccggggtacaggtccgtacggggtcgtttaggactaaagttcgtccgttttcgggccgtttagggtttaccacgtacgaacgaccggaaccggaacggggaaaccggtaccccgtaaacggcccgtaccgtagtacgttccgtagttgggtacgactaacttactacgtttacgacggtaaacggttcgggtacccgtacgtacgtaacggttacgaggtccggtacgtaagggttacggtacggtagggtaacgtaggtaacgttacgtaccttacgtaccgtaacgtaactcgaaccggccggtacccgtcgaccgtaccgggtacctaggtaacgttactttaccgtacgttaaccttaacgttttaacgttaccgttcggttaaccttaccgttaacgttacgttaggtaacgttcccgttaccgtttaccccgggttacggtttacccggttacccggtaaacccgggtaaccggggtaaaccggtaaacggggttaacggaaaaccgttaaccggaaaaccggtacggttacgggttacggtccgtaacccgg

SEQ ID NO: 99958 - DNA, 714 bp, Homo sapiens
  misc_feature: GYAE6OF01EYZ0V.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatcgacccagtctccatcctccctgtctgcatcgtgtaggacacacagtccacctatctacgttcggccgggcagtcgaggactagttagactaatttactttacgccttaggtactcgagacaaggaaaccgtaaggggtaacttaccgtaacgccttccgtagtacttaccttatacgttactacttacctactttcgacttaacggtttccggggtccctagttccgttcgttacgaggtcggacgtaggtggtacgtcgtacgggtactaggtttacttaccgtacctcgtaccaaccttactacacgtaccacgtccgtagaccgtacggtacctaggttaaacggtttacgttttacggttaaatttacgtttaagttacgttaaccggtaaaacggttaccgggtttaaaccttacccggttttaccccgaccgtttacccggtaaccgggtttaccggggacgggttaaaccggggtaaccgtaaaggggtacggtaaaggtaacgtaaacggtaaacggtacggtacggtagtaccgtacgtcccgtaacg

SEQ ID NO: 99959 - DNA, 818 bp, Homo sapiens
  misc_feature: GYAE6OF01BAMGI.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagtatgtgacatccagatcgacccacgtccccatccctccctgtctgctatcgtaggtaggacacacacgtcaccatccacttcggccgggtcgacgtcgaaggactattaacgactaaactttagtttacgccttaggtacttaccacggtaccaaacggaaaaccggtaaacgggggtaaaccgttacccgtaaacggtaccttacccgtaggtaacttaccgttaacgttacggttaactaacttcccgttaaccgttttcggtaaccgttaacggtttacccgggggtaccctaacgtttacccgtttaccgggttaactaagggttaacgggtaaacggttcgggtacgtttaccgggtaaggggtaaccgttaacgttacttttaccgtaacccttctttaaccccaacctacgttaacccgaacgtccgtaaccggtcccgttagaccgtaccgtaaccgtaaggtaacgttacgttcgtttaaccgtacttaaacgttttaattaaccgtaacgtaaaactaaaacgttaactaacgttacggtacccgtccccgtacgtttaccttaaccgggttacgggaccgggtaacgggtaaccggtaagggtaacgggacggtaaccgtaaaccggtaaaacggtacgttagggtacgtaaggtccggtaacccg

SEQ ID NO: 99960 - DNA, 619 bp, Homo sapiens
  misc_feature: GYAE6OF01EKBK6.47.73.G07.1.454.CMB.1.raw
  modified_base (194)..(194): a, c, t, g, unknown or other
  misc_feature (194)..(194): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacacagtccacctatcacgttcggccgggcgagtcaggacattagctaattattagcctggtatcagcagaaaccagggaacttcctaagctcctgactctatgttacattccatttcgactaacgttccggggtaccctataccgtaaggttcaaggtggctaggtggattccgtagggactagtacgttcacgtctcacctatacagtctacgtctcgacctaaccgtagtaagttacttttacgaccttaaactttactaccgttacgtaaccgtaaacgttacggtaaccggtttaacccggttaccccgttaacgtttaccgtttttaccggaccggtaacgggtaaacccgtaaacggttacggaaactacgttaaccgaaacgtacgttacggtggaccttacggaccacccgttacg

SEQ ID NO: 99961 - DNA, 640 bp, Homo sapiens
  misc_feature: GYAE6OF01C1S7B.47.73.G07.1.454.CMB.1.raw
  modified_base (226)..(226): a, c, t, g, unknown or other
  misc_feature (226)..(226): n is a, c, g, or t
  modified_base (456)..(456): a, c, t, g, unknown or other
  misc_feature (456)..(456): n is a, c, g, or t
tcagagctcacgtacacgaccggtgctcgatttagctctacgctcagggggcagaagtctctctcagtcaggacacagcatggacatgagggtccctgctcagctcctgggactcctgctgctctgctcccagataccagatgtgacatccagatcgacccagtcctccatccctccctgtctgcatctgtaggagacagagtccaccatcacgttcggccggganaagtcaagacgactaattaacagacgttaatttaaagttggtatacaccgaagaaacccgaagggtaaccacccctaacctctagacttctagtcgctcgactactccgtagttcacgtagtacgggttcgggtaccctagttcgtagttcaaggttcggacgttaggcggtattcggaggtactagttactttccaacttcctcgaaccctagtcacgtccgtagtccncgaacctaacgtagtaacttagtttccaacttaacttactacgtgtaccaacggtacgtttaaccggttacccccgtaaccgttaacgttacggttaccggaaccggaacgggtaaccctaaacggttacggaaactaccgtaaaccaaaccgggtagtaccggttagacctaccgcctaaccg

SEQ ID NO: 99962 - DNA, 861 bp, Homo sapiens
  misc_feature: GYAE6OF01B7EIZ.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggacctcctgctgctctggctcccagataccagatgtgacatccagatcgacccagtcctccacgttccctccctgtctcgctatcgtaggtaagggacacactacgtaccaacctattaccacggttcggccggggtacacggtcgaggaactagttacgactaagtttagttaccgtccgttagtactcgacgtacgaaacggtaaaaccgaagggtaaaccttcgtaaacgtcctaccgtagtaacttacgttaagtacgttaactacttaccgttacttcgaaccgttacggttccggggtacctacgttccggttacggtacgtacgggtcggtacggtaggttacggtacgttacgggtacgggtacgttacggttaactttaccctacctttacccgtaacccctaccgttaaccggtaccctaacgggtaacccgaccggttacccccgttaggaaccccggtaaccggttaccccgttaaaggaacccggtttaatttcgggttaaccgttaacttttaaaacggttttaccttaaaccgttaacgtaaaaaccttttaaaagtaaccgttaaccgttaccggttaaccccggttaccccgttaacgtaacccgggtttaaccggggtcccgggtaaacgggggtaaacccgggtttaacccgggtaaacgggtaaacgggttaaccgttaaaccggttaaaccgtaaaaacgggtttccggtttagggcccgttaaaccccg

SEQ ID NO: 99963 - DNA, 744 bp, Homo sapiens
  misc_feature: GYAE6OF01D0BPW.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctgctcccagactaccagatgtgacatcagatcgacccagtcctccactccctcctgtctgcacgtctaggaggacaccacacgtcacctactccgtacgttcgggccgggacgtagtaccgaaggtactaagtttacgaacttaagttttaagtttacgaccgttaggtactacgacgacggtaaaacggtaaaaccggtaaggggttaaacgtttacccgtaacgtccttaccgtagtacttttacgttaacgtttacgttaaactaccttaccgttaagttttcgaaccgtttaacgggtttcccgggtaacccttagtttaccggttccggttaacgtacgggttacggacgtagggttcggtaagttccgggtagggtaaccttagtttaacttacctacccttaccgtaccaaccttatacgaaccgtactaccggtcctggtacccgtacgtaccggtaagtacgttattacggttacgtaacctttaacggttttaactaacgttaagtaaacctaaaagttacctacggtacgtcccacctcgttaacgtccggtacggacgggaggtacgaaggtccgtaaagtactaaaccgaaggtacgtcggtgaccg

SEQ ID NO: 99964 - DNA, 770 bp, Homo sapiens
  misc_feature: GYAE6OF01CYHGG.47.73.G07.1.454.CMB.1.raw
tcagagctcacgtacacgaccggtgctcgatttagctctacgctcagggggcagaagtctctctcgagtccaggaccacgagtcagtggtacattgaggtccctgctcagctccgtgggactcctgctgctcgtggcctcccagactaccgagtatgtgactattaccgagactcgacccgagtctccactcctccctgtctgctagtcggtagtaggagacaggtcgtccgacctatccgtacgttcggccggataacgtcaaggcctactaacttaacgtcgtaacgtttaaagtttaacgttgtaactaaccgacgaaacgaaaccggaacgggtaacccctaccccgttaaccgtccgtagaccttacgtaagtcgtcgtacgtaccgtacgttccgttaggttaccgagttacggtttacggggtaccgggttactaacggtttagttacggttacagggttcgacgtaggttacggtacgtcgggtaacggtcttaaacgtttccctaaccgtcccttaccgaaccctaacgtacgtaaccgacgtaccgtacgtacgtaaccgaacccgttaaaccgttagttaacgtttaccttaacgaactttaaccgtactacgttacgtaacgaacgggttaccgttaaccggttacccgtaacccgttacgttaccgttaccggaccgggtaaaccgaaaccgtaagaccggtaaacttaacccgaaacggtaaacgtaccgtcggtacggcctaagtccccgtaacg

SEQ ID NO: 99965 - DNA, 747 bp, Homo sapiens
  misc_feature: GYAE6OF01BY21Q.47.73.G07.1.454.CMB.1.raw
  modified_base (162)..(162): a, c, t, g, unknown or other
  misc_feature (162)..(162): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggttcccaggtgccaggtgtgacatccagatgacccngtctccatcctccctgtctgcatctgtaggagacagagtccacatcacttggccgggcgagtcgagggcttgcaagtgctttggctggttcagcagacaccgtagggaacgcccctaaggccgcctagataccgtagtcggtcgactaactacctactttcggaacgtaaaggtccggggtaccctaagtaccgtaaaggttcgaacggccgggtacgaacgggttagggtaccgtacgggaacgtacggtacgttccgacgttctacccgtaactaacgttcgaacgggtcccgggtccttacggaccgtacgtcccggtaagtaacgttacttacgtacgtaccttaaaccgtttacgttaccgttacgtacccgttacctaaggtttacgttaaccgtacgttacccgttacccccgttttaacccggttaccgggtttaaaccccggttttacccgggaaaccccggggtaaaaccggggttaacccggtaaaaggggttaaaccggtaaaaccgttaaacccggtaaaacccggttaacggttacgggtaaccgggtactaccgggtaaccctaaacccg

SEQ ID NO: 99966 - DNA, 778 bp, Homo sapiens
  misc_feature: GYAE6OF01AQG1Q.47.73.G07.1.454.CMB.1.raw
  modified_base (560)..(560): a, c, t, g, unknown or other
  misc_feature (560)..(560): n is a, c, g, or t
  modified_base (760)..(760): a, c, t, g, unknown or other
  misc_feature (760)..(760): n is a, c, g, or t
tcagagctcacgtacacgaccggtgctcgatttagctctacgctcagggggcagaagtctctctcagtcaggacacagcatggacatggagggtccctgctcagctccgtgggactcctgctgctctcggcctcccagactaccagtatgtgactactaccgagtactcgaccctacgtcctcctactccctcctgtctcgtactatcgtaggtaggacacacgtacgtacacctactccgtacgttcggaccgggacgtacgtacgaacggactaagttagtaacttaatttacgttacgtaccgttgtacgtacacgaaccgtaaacggaaaccggtaaacgggttaaaccgttaccgtaacgttccgttaccgtagttacgttaacttacgtttaaccgttaactaccgttaccgtttacgtttacggaaccggtttaaccggtttccccgggtaaacctacggttacggttaacggtacggtaagggtaacggtagggttacggtacgttacgggtacggtaaactttacgtttaccttttaccttaccgaacctnaccgtagtaccgtacgtactacggactacggtacgtaagtataacgttactaacgttactaccgttaactcggaactaccgtaaggtaacgtttaaccggttaacccgttaccgtacggtttacgttaccgggaacgtaaaccggtaaaccgtaacgtcggtaacctaaacggtaaccgaaccggttaagtcgggtaacncgtactctacgtcgttgg

SEQ ID NO: 99967 - DNA, 759 bp, Homo sapiens
  misc_feature: GYAE6OF01CVNW5.47.73.G07.1.454.CMB.1.raw
  modified_base (234)..(234): a, c, t, g, unknown or other
  misc_feature (234)..(234): n is a, c, g, or t
tcagagctcacgtacacgaccggtgctcgatttagctctacgctcagggggcagaagtctctctcagtcaggacacagcatggacatgagggtccctgctcagctcctgggactcctgctgctcgtggcctcccagactaccagatgtgacatccagatcgacccagtcctccactccctccctgtctgctatcgtagtaggacacacagtaccactatctacgtcgggccggngacgtacgaggactagttacgactaatttattacgccttaggtactacagtaccaacgaaacgtaagggttaacttaccgtaacgtaccgtcctagtacttacgtaagttcgtaacctcttaccgtacttcgtaccgttaccggtttacccggggtacctacgttccggttacggtttacgtacggtcggtaccggaggttacggtacgttccgggtaggtaacccgttagtttactttaccctaccttacctaccgtaaccctcgttaccgaacggtaccgacccgttccgtaacggtaccgtaccggtaccgtaagggtaacgtaccggtttaagggttaacctaaccttttaaacggtttaacctttaaaccgttaacgttaaaccgttaaaaactaacgtaaccgtaacggtacccgttaccccgtaccgtttacgtacccgggtttacggggaaccggttaacgggtaccggtaacggacggtaacgtaacgtaacgaacgttacggtggtcggtacccg

SEQ ID NO: 99968 - DNA, 729 bp, Homo sapiens
  misc_feature: GYAE6OF01DX7VC.47.73.G07.1.454.CMB.1.raw
tcagagctcacgtacacgaccggtgctcgatttagctctacgctcagggggcagaagtctctctcagtcaggacacagcatggacatgagggtccctgctcagctccgtgggactcctgctgctctggcctcccagactaccagatgtgacatccagatcgaccctagtcctccactccctccctgtcctgcattcgtagtaggacgacacacgtccacctatcctacgttcggccgggcgtagtcgaacggtactaagttaacgtacttaaagtttacgtttaacgccgttaggtactcgaacgtaacgaaacggaaaaccgtaaggggtaaactttacctaaacggtccttaccgtagtacttcgtttaagttacgttactaccttacctacgtttgactttaacggttcccgggtaccttacgttcccgttcgggttacgtaaggtcggtacgtaggttgggtacgttaccggtagggtaacttacgtttactttaccacccgtttacctacctaacccgtagtcctaacgaccctaccgtcgtcgacgacgtccgtaagaagtattacgtactaacgtaatacgttaattaccgtacgtaacgtaacttacgttaactaacctaacttacccgtttcccgtaaccccgtttcgttaccccgggtacccggtaacggtaaccgtaaagtaccgtaacttaacgtaacctaaacggtcgttggtacg

SEQ ID NO: 99969 - DNA, 674 bp, Homo sapiens
  misc_feature: GYAE6OF01D6YSX.47.73.G07.1.454.CMB.1.raw
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccatcggagtaagttgtgttgacacagtcctccagcccaccttgtctttcgtctaccgaggggaaancgccctaccctctccgngcgacgggccagtcagaattacttccacttccttacttacgccttacggtaacccaaacaacgtaaaaccgtggtaccgacggaccctccccgacggtccctccgtactacttacctagtcgaactgacctaactacccgaaaggacgggccctaacgtcggacctacgtaccccaaggtaccgtagttacgaggtcggactaggtggaacgttcggacgggaacctacggtacctttaccgtaccttccgtaccaaccgtattccgaacgtcccgtaacgtaccgttaacggaccgttacccttaagggtaaactttcgttttacggaccttttaacgttttactacgttacgtctagcctaggtaccgtacgacctcgtccgtctacgtccgtacgttcgggcgggtacggtcggaggggtacagacgtacgacggacgtacgtgcggtcg

SEQ ID NO: 99970 - DNA, 732 bp, Homo sapiens
  misc_feature: GYAE6OF01EFXWH.47.73.G07.1.454.CMB.1.raw
  modified_base (117)..(117): a, c, t, g, unknown or other
  misc_feature (117)..(117): n is a, c, g, or t
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagagctcacgtacacgaccggtgctcgatttagctctacgctcagggggcagaagtctctctcagtcaggacacagcatggacatgagggtccctgctcagctcctgggactccngctgctctggctcccagataccagatgtgacatccagatgacccagtctccactccctcctgtctgctatctgtacgganacacagtccaccatcacgttcggccgggngacgtcaaggactagttacgacttaatttagtttacgccttaggtactcagaccaacggaaaccgaagggtaaacgttaccgtaaagccttacctagtacttacttaacgttacgttaacctacttccgttactttacggaccgttaaacggtttcccggggtacccttagttccggttcggttacgtacggttcggtacgtagggtaggtacgtaccggtagggacttagttactttaccgtacctacgtacctaacctactccgaacgtccaccgtccgtcgaccgtacgtaccgtaaggtaacgttagttcgggttaactacgtttaaacctttaacgttaacttaacgttaaaacgttaaaattaacccggttaacgtacccgttacccgtaccccgttacgttaacccggttacccggtttaacccgggacggggtaacggaaccggttaaacgggtcggaaagtaccgtaaacggtaaccgtacgtcgggtacggtaccg

SEQ ID NO: 99971 - DNA, 807 bp, Homo sapiens
  misc_feature: GYAE6OF01EC43R.47.73.G07.1.454.CMB.1.raw
  modified_base (108)..(108): a, c, t, g, unknown or other
  misc_feature (108)..(108): n is a, c, g, or t
tcagagctcacgtacacgaccggtgctcgatttagctctacgctcagggggcagaagtctctctcagtcaggacacagcatggacatgagggtccctgctcagctccngggactctgctgctctcggctcccagataccagatgtgacatccagatcgaccagtctccactcctcctgtctgctatcgtaggtaggacgtacacgtactaccactaccgtacgttacggtcggaccggacgtacgtacggacggtaactaaggttactaactttaacgtttacgttaccgtacggttacggttactacgaagtaaccgaaaaccggtaaacgggtaaaccggttaccgttaaccgtaccgtccgttactagtacttacttaacgttactaactccgttacttacgttacgagttacccggtccgtactcgttacggtcgtagtacggggctacggtaggtgtacggtagggtacgtaagttactttaccgtacttacccgtacctaccgtaacgtactacccgaagtacggtaccgtaccgtacggtaacgcccgttaaagacggttacgtttaccggtttacgaaccgttaaccgttttaacgtttaccgttaaacggttaaactttaaaaaccgttaagtaaacccttacggtaaccccgtccccgtaaccgttaccgttaaacccggggtttacgggtaacccgggggtaacggggttaaacccggggttaagggaaccggttacggtaaaaccgtccggttaaaaaaccggtacccggtttagtacccgggcgttaaacccgg

SEQ ID NO: 99972 - DNA, 800 bp, Homo sapiens
  misc_feature: GYAE6OF01E0J0B.47.73.G07.1.454.CMB.1.raw
  modified_base (291)..(291): a, c, t, g, unknown or other
  misc_feature (291)..(291): n is a, c, g, or t
  modified_base (790)..(790): a, c, t, g, unknown or other
  misc_feature (790)..(790): n is a, c, g, or t
tcagagctcacgtacacgaccggtgctcgatttagctctacgctcagggggcagaagtctctctcagtcaggacacagcatggacatgagggtccctgctcagctccgtgggactcctgctgctctcggctccagataccagatgtgacatccagtactcgaccctagtcctacctactccctccctgtactgcctatccgtaggtaaggaacgactactacgtccacctatccgtacgtcggccgggcgagtacgaggactattagacttaattacttcgaccgtgtacncagaccaacgaacgacgggtaacttactacggtcctacgtagtactacgttactacgttactaccttccgttaacttcggtaaccttaaccggttcccggttaaccctacggttccgttacggttcgaggttccggtacgtaggttacggtacggttcggtaccgggttactaacgtttaccgttactaccgttacccgtaacgtaaccctattaacccgacgtacgtaccgttccgtaagtcccggtaaacgtacccggttaggttaaacttttaccgggtttactaaaccggttaaacccttttttaacgtaaacccggtttaataaaaaccctttaaaagtttacccggtaacgtaaccccgggttaccccttccccggtaacccggttttaacgtacccccggggtttacggggaaaccgggtaaccgggtacccgggttaaaggtccgtaaaccggtaccctaaaacggtacggtttaccggaggttacccggngtaaaccccg

SEQ ID NO: 99973 - DNA, 815 bp, Homo sapiens
  misc_feature: GYAE6OF01CL85T.47.73.G07.1.454.CMB.1.raw
tcagagctcacgtacacgaccggtgctcgatttagctctacgctcgagggggcagaagtctctctcagtcaggacacagcatggacatgagggtccctgctcagctcctgggactcctgctgctctggctcccagactaccagatgtgacatccagatcgacccagtcctccactccctcctgtctgcatcgtgtaggactacatacgtccaaccatcacgttcggaccgggtcgtacggtcgaacggtactaagttaacggaccttaaagtttacgtttacggtacccgttaggttaactaccgtacggaaccgtaaacggtaaaaacccggtaaaggggttaaaacggttacccgtaaacggtcccttaacccgttaggtacttaaccgttattacggttacctacttaccgttacgttcgtaccgttacggttcccggggtacctacgtccgttaccggttcgtacggtcgtacggtaggtacggtacgttaccggtcgggaactacggttactttaccgtacgttaccgtacccaaccgtacgtaccgtacgtaccgtaccgtacccgtaccggaccgtaccgtaccgtaacggtaacgttacggttaccgttacggtaacctttaacgtttacgtttaaccgtaagttaaaccgtaaaacgttaacgtaacgtaccgttacccgtaccccgtaccgttaccggtacccgggtttaccggggaaccgggtaaccgggttaaccgggtaaccgggtaacggtaacgtaaccggttaaccggtaaccggtaaccggtcggtaccggttacccg

SEQ ID NO: 99974 - DNA, 739 bp, Homo sapiens
  misc_feature: GYAE6OF01DZLL0.47.73.G07.1.454.CMB.1.raw
  modified_base (186)..(186): a, c, t, g, unknown or other
  misc_feature (186)..(186): n is a, c, g, or t
tcagagctcacgtacacgaccggtgctcgatttagctctacgctcagggggcagaagtctctctcagtcaggacacagcatggacatgagggtccctgctcagctccgtgggactctgctgctctgctcccagataccagtatgtgacatccagatcgaccagtcctaccacttccctcctgtccngtcacttcgtaggtaagacgacacgtacgtaccacctatccgtacgttcgggaccggggcgacggtaacgacggtaacctaagttacgtaacttaaatttaacgtttaccgtccgtttaggtaactacgaacgtaccggtaaaaccgaaaaccgggtaacgggttaaaaccgtttaccgtaaacgtcctaccgtagtacttaccttattacgttactacttaccttacgttacgacgttaaccggttcccgggtacctagtttcccgttacggttacgtacggtcggtaaggtagggttcggtacgttcggtacgggtaagtcgtttaacgtttcctaacccgtaccgtacctaacccgttacgtaccgtacgaccgtaccggcccttggaacctccggtacgtaagtacgtagttcgtaactaacttactttagtaacgtagtaaaaccttaacgtactaacgtcgtacccgtacctcttaccggtacgggttcgaaccggggtaaggtacgaaggttcgaaacttacgaaaccgtagtacggtgtagtccg

SEQ ID NO: 99975 - DNA, 826 bp, Homo sapiens
  misc_feature: GYAE6OF01CJ2W2.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctcgtggctcccagataccagatgtgacatccagatcgacccagtcctccactcccgtccctgtctgctatctggtaggacgacacagtcaaccatctacgtcggccgggtgagtcgaagactaattacgactaaatttatttaacgccttaggtactacgagtacgaaacggaaaaccggtaacgggtaaacgtttacccaaaggtcctacctagtaacttacttaattacgtaactacttaccttacgttagtaccgtaacggtttcccggggtaccctaacgttccgttacggtttacgaggttcggaccgtaggtcggtacgtacggtacgggtacgtacggttactttaccaccgttacctaaccgtaaccctacgttacaacgtacccgtacggtacccgttaacggacccggttaccggtaaccgttagggtaaacgttaacgggttttacggttaacgtaaacccttttaaaacgtttttaccgtttaaaaccggttaaacggtttaaaaacccaaaaaaggttttaacccgttaaccggtaaacccggttccccggtaaacccccggttcccgtttaaacccgttaacccgggggttaacccgggtaacgggggaaccgggttaaacgggttaaggggtaacgtaaacgggtaaacctaacccggtaaaacgacgggtttacgtaccggggtaacc

SEQ ID NO: 99976 - DNA, 708 bp, Homo sapiens
  misc_feature: GYAE6OF01AR2KG.47.73.G07.1.454.CMB.1.raw
tcagagctcacgtacacgaccggtgctcgatttagctctacgctcagggggcagaagtctctctcagtcaggacacagcatggacatgagggtccctgctcagcctcctgggactcctgctgcctgacgtccacagactacgatgtcgtacactacacgagtacgtaccgacgtactcctactccgtccctcgtcgtctcactacgtcgtacggaagaccacaacgtcgtacccactctaccgtcggtccgggaccggtactacgacgaccggtaatagtacgtaactttaacgtttaggttaccgtacggttagtactaccgaacgtaacgaaaacccggtaaacgggtaaacgggttacccttaaacgggacctcgttacggatcgttaactacggttactactaccgtactttagtacgacgtttaaccggtccgatctcggtcgaacgtggtcacggttagcgtacgtgggaactacgggtattaccgtacgacttaccgacctacgtacgtacgtaacgtccgtacgtaccgacgtacgtaccgtagtaacggcgttagtccgtaacgtactttaacgttaacgttaacggtaaactaaactaaacgtttacgacgtaccgttacccggctaccgttaccgtcgggtcgggaaccggtacgtaacggacggtacgaacaccgtaacgaacgtgaggtcgtacg

SEQ ID NO: 99977 - DNA, 717 bp, Homo sapiens
  misc_feature: GYAE6OF01AB72E.47.73.G07.1.454.CMB.1.raw
  modified_base (642)..(642): a, c, t, g, unknown or other
  misc_feature (642)..(642): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatccctcctgtctgcatcgtgtaggagacacagtcaccatccacttcggccgggtacaggtccaggacctagttacgactaacgtttatttacgccgttaggtactcgacggacaacggtaaaccggtacggtaaacgttcctaaacgccttacccgtgtaacttcgttaagttacgttaacctacgttaccttacgttttacgaccgttaaaccggtttcccggggttacccctagttacccggtttacggtttacggtaacggtttcggggaaccgtagggtttacgggaacgtttcgggtacgggtaaaccgttagtttaccgttttaacccgaccctttaccgtaaccctaacccgtaacgttaccgacgtcccggtaacgtcccgtaggaccgtacgtaccgtaggtacgagtttcgtacgtaacttaactttacgtacttaagaaactaactaacgtacaccgtaccnccgtacctagttacccggttcgggacgaacgggtaccgaaggtcgaacgtacgtacaaaggtcgttggacgtccg

SEQ ID NO: 99978 - DNA, 799 bp, Homo sapiens
  misc_feature: GYAE6OF01BSH2D.47.73.G07.1.454.CMB.1.raw
  modified_base (189)..(189): a, c, t, g, unknown or other
  misc_feature (189)..(189): n is a, c, g, or t
  modified_base (528)..(528): a, c, t, g, unknown or other
  misc_feature (528)..(528): n is a, c, g, or t
tcagagctcacgtacacgaccggtgctcgatttagctctacgctcagggggcagaagtctctctcagtcaggacacagcatggacagtgagggtccctgctcagctccgtgggactcctgctgctctggcctccagactaccagagtgtgacatccagtatcgacccagtctccactccgtcctgtctncacttgtagtaaggacgacactacgtcaccatcctacggttcgggcccgggagtacggtgaacggtaactacgttaacgtaacttaaacgtttagtttaccgaccgttaggttacgtaccgaaacgtaccggaaaacggaaaaacccggtaaggggtaaccgttaccgtaacggtccgttaccgtagtacttacgttatacgttacctacttacccgttactttacgacgttaaccggttaccgggtaccctgttcggttaccggtcgtacgtggacgtacgggtacgtaacggtacgggtacggtaacgtacggtttacttactaccttccacctacncgttaacgacgtcctaacgtccgtcgtaacccggtacgtacggtaacgttaacgttaacgttcggtttaaaccggtaattttaaacccggtttaaaccttaaacgtttaaacgtaaaaacctttaaaaacttacccgggtaaaacgttcccgtaaccggttaccccttacggtacccgttaccgggggtttaaccgggaacgggtaaccgggtacggtaacggtaggaccgtaaacggaccgtaaaaccgggtgttacggtaccggtaccg

SEQ ID NO: 99979 - DNA, 745 bp, Homo sapiens
  misc_feature: GYAE6OF01ELA31.47.73.G07.1.454.CMB.1.raw
  modified_base (160)..(160): a, c, t, g, unknown or other
  misc_feature (160)..(160): n is a, c, g, or t
  modified_base (535)..(535): a, c, t, g, unknown or other
  misc_feature (535)..(535): n is a, c, g, or t
tcagagctcacgtacacgaccggtgctcgatttagctctacgctcagggggcagaagtctctctcagtcgaggacacagcagtggacatggacgggtccctgctcagcctccgtggacctctgctgctctcggtcctccagactacagtactgggggtanacactcgaagtagtccgtaaccctacgtcctacctaccttccccttcccgttgtccgtacgactacgttcggtaggtaacggaacgaccgtacctaccgtacccaacctacgttccgtacgggttccgggaccggggtacgtaaggttacggtaaggttaacgtacgtaccgtacgttaggtaccgtacgtagtactaacgaacgaacgaaaccggtaacggaaccctacctacctcctactactcctactacgtcactactaccgttattacggaacgtacgggtccggtactacgtacgtacgtcacggcggtcgaggtacggtataggacgtagttacgttacttacgtactaccttacgtacttacgtacncgtaacgcctcgtacaacgggtctaacggtaagttacgtttaagtttacggttaactttagttacgttaactaacggtaaaccggtagttacccgttccgttccgtaccgtaccgtaccgggtagggtacgggtaccgacgggtaggtacggtaacgaaggtaaacgtaacggtcggacgggttacgaccgtatacccgtgttccgtacg

SEQ ID NO: 99980 - DNA, 731 bp, Homo sapiens
  misc_feature: GYAE6OF01CEAY7.47.73.G07.1.454.CMB.1.raw
  modified_base (563)..(563): a, c, t, g, unknown or other
  misc_feature (563)..(563): n is a, c, g, or t
tcagagctcacgtacacgaccggtgctcgatttagctctacgctcgaggggggcagaagtctctctcagtcaggacacagcatggacatgacgggtccctgctcagctcgtgggctcctgctgctctggcctcccagataccagtattgtgacatccagatcgaccctagtcctcctacctcccttcccgtgtcctgactactcgtaggtaaggacgaaccacgtacgtacctaacctataccgtaccgttccggggacccgggaggtacgtcgtaacggtactaagttaacgtaacctttaaatttacggttaccgtacgttacgggtatccgtaacgaacggaaacggaaaaccggtaagggtaaaccttcgtaacgtcctcgtagtacttacgtactacgttacgtacttaccgtacgttcgtaaccggttaccggttccgggtaccttaggtcccggtttgtacggtacggtcggttaacgtcgggtacgtaacgtcgggtacgtaacgtcgtttacttacgtacccttctaccgactactcggacaccgtcgtaccgntaccgacgtacgtagtattacgttgttactacgttaacttagtaaccttaagtaactaaagttactaccgtccgtacccgaccgtccgttaccggttacggtaccgggacgggtaaacggtacgggtacggtaagaactaccgaaagttacgaccggtagtcggtacc

SEQ ID NO: 99981 - DNA, 792 bp, Homo sapiens
  misc_feature: GYAE6OF01DKEIS.47.73.G07.1.454.CMB.1.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (568)..(568): a, c, t, g, unknown or other
  misc_feature (568)..(568): n is a, c, g, or t
tcagagctcacgtacacgaccggtgctcgatttagctctacgctcgagggggcagaagtctctctcagtcaggacacagcagtggacagtcggacgggtccccgctacacggtcctcccggtgggggtccttcccgttggttcgccgtttccgttacgggttccccgtaggttaccagtattcggacgaactacgtccgaagtactaccgaccctagtccctactacttccgttntacggtnttccgttggtctttacggngggaacggaatacgacgtacgtacctaacgtactaaccgggtgttaggccggggacaacgtcgtaacgtcttaaacgtagtacgttaaactttattacgtacgttagtaacctacgtaacgaacgtaaacgaaacggtaacgttaaccggtaacctacgtacctcgtacgtactacgtacttatacacgttacttaacgtcgacgtaacgtacggtcctagtacgttacggtccgtaggtacgtacgtaggtacgtcgtaaccggtggtaaccgtaggttaactacgtaccttactaccacgtaacncgacgactaccggttacgacgtacgacggtaacctagtaacgtacgttagtaacctagttaaacgttataacgttaactaacgtaaactacgggtacctaccgggtacctacccggttaccgtagggtttacccggacgggaacggtaacccgtaggtaaaacggacggtaacaacggtaaaccgaaggtaacgtacgtacgtataaccgtacgacgttaacgg

SEQ ID NO: 99982 - DNA, 629 bp, Homo sapiens
  misc_feature: GYAE6OF01BPNKQ.47.73.G07.1.454.CMB.1.raw
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
tcagagctcacgtacacgaccggtgctcgatttagctctacgctcgagggggcagaagtctctctcagtcaggacacagcatggacatggagggtccctgctcagctccgtgggacctcctgctgctcgtcggcctcccgagactaccagtatcgtagaccatccgagactccgaccctagtcctaccctacgttcccttccctgtctagcctatcgtaggtaaggacacctacgacgtaccacctatccgtacgtccgggccggacaggtacaggtaactatagacttaattgttccgactggtacngaacgacgaagaacggtagtaactcagtcctgtntacttacgtattcgaactcgtcctattcgacgttacgtccgactagtcgtagtcgaggtctacgtggctaggtacgtagtactagttactcgtacctacgtacctacgtacacgcgtaccgtacgtcgctaccgacgtagacggtacgttcgtacgtaacttacgttaacgttaattaacgtaacgtaaaactaacgttaccgacgtccctaccgtcctacgttaccggttacggacggacgtaacggtacggagttaccgaggtaacgacgagtcgtcgcgtaccg

SEQ ID NO: 99983 - DNA, 782 bp, Homo sapiens
  misc_feature: GYAE6OF01BT25O.47.73.G07.1.454.CMB.1.raw
  modified_base (121)..(121): a, c, t, g, unknown or other
  misc_feature (121)..(121): n is a, c, g, or t
  modified_base (583)..(583): a, c, t, g, unknown or other
  misc_feature (583)..(583): n is a, c, g, or t
  modified_base (596)..(596): a, c, t, g, unknown or other
  misc_feature (596)..(596): n is a, c, g, or t
  modified_base (728)..(728): a, c, t, g, unknown or other
  misc_feature (728)..(728): n is a, c, g, or t
  modified_base (766)..(766): a, c, t, g, unknown or other
  misc_feature (766)..(766): n is a, c, g, or t
tcagagctcacgtacacgaccggtgctcgatttagctctacgctcagggggcagaagtctctctcagtcaggacacagcatggacagtgagggtccctgctcgagcctccgtgggcctccngactacctcgtggtccgtccggaggtcaccgagtattggtacgactactccgaagtactaccgaaccctaagttcctacccgtaccttccccgttccctgttcctacgtctacgttcgtagggtaacggaacgaaccgtaacggacgtacccaacccgtacgtaccgtaccgttcggggaccggtaaccaaaggtaccgaagaacggtacctaaccgttaaacgaacggttagttaaactttttaaacggttgttaacctaaccgtaaaccggaaaaccggaaaaccggtaacccgggaaaaccccgtacccccctttaaccgtacgtaccgttactacgttacgtccggtactaccgtacctacggttacccgtgtttacgacgtacgtacggttaccggttactaagttaccgttaaggtcgaggtcgtaacgtggtagtctaggagtacttagtctacnctacctacactanactcgactacgtacgacctaaacgtacaacgttatttacgttactaacgtactcttaacgtctaacgtacgtaacgttaaccgttacccgttaaccgttagttaccggtaccgcgtaaaccgcgtaacgtanaacgtacgtaacccgtaaacgtcgtaacggtccgtacncgtaaacctcgtaccg

SEQ ID NO: 99984 - DNA, 502 bp, Homo sapiens
  misc_feature: GYAE6OF02HZP7Y.47.73.G07.1.454.CMB.1.raw
  modified_base (197)..(197): a, c, t, g, unknown or other
  misc_feature (197)..(197): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccatcggagaagttgtgttgacacagtctccagccacctgtctttgtctccaggggaaanagccaccctctcctgcagggccagtcagaatattcactcctacttagcctggtaccaacagaaacctggtcaggctcccaggctcctcatctatgatgcatccaacagggccactggcatcccagacaggttcagtggcaggtgggtctgggacagacttcactctcacatcagcagcctagagcctgaacgtactttggtacttttatactgtcagcagtcgtgtacgttctggtcctccgctcctacgtttcggcggtagggaccgagggtggagagtacgaaacggactggtacgcgtgacc

SEQ ID NO: 99985 - DNA, 472 bp, Homo sapiens
  misc_feature: GYAE6OF02GKLPL.47.73.G07.1.454.CMB.1.raw
tcagagctcacgtacacgaccggtgctcgatttagctctacgctcagggggcagaagtctctctcagtcaggacacagcatggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtgatctggacagattttacttcaccatcagcagcctgcagcctagagatattgcaacatattactgtacaacaatatcataatctcccactttcggccctgggaccaagtgatatacaacgactgtgctgacc

SEQ ID NO: 99986 - DNA, 544 bp, Homo sapiens
  misc_feature: GYAE6OF02HAMY0.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcagtcaggacattagcaattatttagcctggtatcagcagaaaccagggaaagttcctaagctcctgatctatgttacatccactttgctaacttcggggtacccagtccttcggtttcaggttggcagttggatcgtaggggacaggtagttcacgtcttcgaacctataccaacaccctgaccagccctgatgtattttcgcgtacttattactgtaaccaaagtacttaatagtacgtaccttccgtacggttcgtcccgtagggtaaccaagttggaattcggtaacaacggtaacctggtacggtacgtacgactaacccg

SEQ ID NO: 99987 - DNA, 567 bp, Homo sapiens
  misc_feature: GYAE6OF02ILD5U.47.73.G07.1.454.CMB.1.raw
  modified_base (388)..(388): a, c, t, g, unknown or other
  misc_feature (388)..(388): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcacatcacttgcggcagtcaggacattagcaattattagcctggtatcagcaagaaaccgaggaaagttcctaaagctcctgatctaatgttacatcctacttgtacaaacgtttcggggtaccctaagtctcgggtttcaaggtggcagttggatcgtagggacagtatttcaactctcacatcanctagcctagcagccttagaaacgtatggttgactaaactttacttaacgttgtaaacaaaaaattacttaaacaacggttccgaccccgtactactaaccggttttcgggacgggtaacgggtaacccgaaaggttgggaacggtactaacgaaaaccggaacttcgggtaggtaaccg

SEQ ID NO: 99988 - DNA, 525 bp, Homo sapiens
  misc_feature: GYAE6OF02I73HN.47.73.G07.1.454.CMB.1.raw
  modified_base (397)..(397): a, c, t, g, unknown or other
  misc_feature (397)..(397): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagcaattatttagcctggtatcagcagaaaccaggggaaagttcctaagctcctgatctatgttacatccactttgctaattcggggtcccatctcggttcagtgcagtggatctgggacagtatttcacttctcaccatcacgcagcctagcacgcctaggaanattggttgctaacgtttattacctagttactaaaaacttattaaacagtaccgcccgtactactaccgtttcgggacggtacgggaccgaaggtggtaacgataccgaaacgaacgtaggtggtaccg

SEQ ID NO: 99989 - DNA, 555 bp, Homo sapiens
  misc_feature: GYAE6OF02FNF5A.47.73.G07.1.454.CMB.1.raw
tcagagctcacgtacacgaccggtgctcgatttagctctacgctcagggggcagaagtctctctcagtcaggacacagcatggacatgaggtccctgctcagctcctggactcctgctgctctggcttcccagataccagtatgtgacatccagatgacccagtctcatcctccgtgtctgcatctggtaggagacacagtcaccatcacttgccgggcagtcaggacattagcaattatttagcctggtatcagcagaaaccagggaaagtcctaagctccgtgatctatgttactatcctactttgctaattcggggtccctatctcggttcagtcggctagtggatcgtgggactagtactttcactctacaccatccacgcaacgccctagcacgtcctagaagatgttcgactaacctttattacgttagtaactaaaattactaaactaagtcgaccccgtagtaccgtaacgtttcgggaccggtaacgggtaaccgtaagggttacggaacgtacgtaaccgaaacggtacgttaggtacggtaccg

SEQ ID NO: 99990 - DNA, 551 bp, Homo sapiens
  misc_feature: GYAE6OF02H487F.47.73.G07.1.454.CMB.1.raw
  modified_base (351)..(351): a, c, t, g, unknown or other
  misc_feature (351)..(351): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcacatcacttgccgggcgagtcaggacattagcaattatttagcctggtatcagcagaaaccagggaaagttctaagctctgatctatgtacatcctacttgctaacttccggggttcctatcttcggttctaggtggctagtggatcgngggactagtatttcactctccacatcacgcacgcctgccacgtcgtagaacgagtagttgactaaacgtttattaacttagttaactaaaaattataaacagtaccgaccccgtacttccgtaccgttcgggaccgggtagggtaacccgtaaggggtcggtaacgtacgtaaccgaaacggtacttcgggtagtaccgg

SEQ ID NO: 99991 - DNA, 505 bp, Homo sapiens
  misc_feature: GYAE6OF02IGFMO.47.73.G07.1.454.CMB.1.raw
  modified_base (435)..(435): a, c, t, g, unknown or other
  misc_feature (435)..(435): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcagtcaggacattagcaattatttagcctggtatcagcagaaaccagggaaagttcctaagctcctgatctatgttacatccactttgctaattcggggtcccatctcggttcagtggcagtgatcgtgggacagtatttcactctcacatcagcagcctgcagcctagaagtatgttgctaacttattactagtacaaaatataaacagtcgcccnctacctacgtttcggacggacgggaaccgaaggtaggacgtacgtaccgaaacggaactggtaggtaccg

SEQ ID NO: 99992 - DNA, 526 bp, Homo sapiens
  misc_feature: GYAE6OF02I66XS.47.73.G07.1.454.CMB.1.raw
  modified_base (399)..(399): a, c, t, g, unknown or other
  misc_feature (399)..(399): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagcaattattagcctggtatcagcagaaaccagggaattcctaagctctgatctatgttacatctacttgactaagttccggggtccctatccgtcggtttcagtggcagtgatcgtgggacagtactttcactctcaccatcagcacgcctgcagcctgaaacgtntagttgactaactttattactgtaactaaaatataaacagtcacccgtactactaccgtttcgggaccggacgggaaccgtaagggtacggaacgtactacgtaaaccgtaacgttggtaggtaccg

SEQ ID NO: 99993 - DNA, 540 bp, Homo sapiens
  misc_feature: GYAE6OF02JC57R.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctcctgtctgcatctgtaggagacacagtcaccatcacttgccgggcagtcaggacattagcaattattagcctggtatcagcaagaaaccagggaaagttcctaagctcctgatctatgttacatccactttgactaattcggggtcccatctcggttcagtggcagtgatcgtgggacagtattcactctcaccatcagcacgcctgcacgcctagaagtatgttcgactaactttacttactagtaactaaaattataaacgagttacgaccccgtacgtaccgtacgtttccgggaccgggtaacgggaaccctaagggttacggaagtaacgtaaccgaaacggtaacgttaggtacggtaccg

SEQ ID NO: 99994 - DNA, 520 bp, Homo sapiens
  misc_feature: GYAE6OF02JAKK1.47.73.G07.1.454.CMB.1.raw
  modified_base (398)..(398): a, c, t, g, unknown or other
  misc_feature (398)..(398): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagcaattatttagcctggtatcagcagaaaccagggaaagttcctaagctcctgatctatgttacatccactttgcaattcggggtcccatctcggttcagtggcagtggatcgtgggacagtatttcactctcacctatcacgcacgccttgcagccctgaagtntgttgactaactttacttacttgtacaactaagttatacaattaactcctaccctacgtttccggcccttacgggaaccctaagttaggacttactaaccaaacgtactacggttggtaccg

SEQ ID NO: 99995 - DNA, 506 bp, Homo sapiens
  misc_feature: GYAE6OF02GQJ71.47.73.G07.1.454.CMB.1.raw
  modified_base (194)..(194): a, c, t, g, unknown or other
  misc_feature (194)..(194): n is a, c, g, or t
  modified_base (419)..(419): a, c, t, g, unknown or other
  misc_feature (419)..(419): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacacagtcaccatcacttgccggcagtcaggacattagcaattattagcctggtatcagcagaaaccagggaaagttcctaagctcctgatctatgttacatccactttgcaattcggggtcccatctcggttcagtggcagtgatctgggacagatttcacttctcaccatcagctagcctgcagcctgaagatgttgactaacttattacctgtacaaaattntaaacagtcgccccgtatccacgtttccggacggacggtaaccaacgggttggaacgacgttacgaaacggtacgtgtacggtaccg

SEQ ID NO: 99996 - DNA, 733 bp, Homo sapiens
  misc_feature: GYAE6OF02IS098.47.73.G07.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctcctgtctgcatctgtagganacacagtcaccatcacttgccgggnagtcaggacattagctaattattagcctggtactcgagacaacgaaaccgagggtaaacgttacctaaaggcttacctagtaacttcctaagttcgttaacacttacctaacgttttgacctaaacgtttccggggtaccctaagttccgttcggtttacgaacggttcgggacctaggttacgggtaattccggttagggaaccgtaaggttacttttaccgtaccttaccgttaccgtaacctagttaccgaacggaccgtaaccgtcccgttacggtaccgacgttacccgtaaggtaaacgtcgttacggtttaacgaccgttaaaccttttacgttaaccgttacggttaaaaccttaaaaagtttaaccttaaacggtacgttacccggtaccccgtacgttaaccggttaacccggtttccgggaccggggttaacgggaacccgttaagggttaccggtaacgtaaccgttaacgtaaaaccgggtacgttacggtacggttaccgg

SEQ ID NO: 99997 - DNA, 508 bp, Homo sapiens
  misc_feature: GYAE6OF02FUHPN.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcagtcaggacattagcaatatttagcctggtatcagcagaaaccagggaaagttcctaagctcctgatctatgttacatccactttgcaattcggggtccatctcggttcagtggcagtggatctgggacagatttcactctcaccatcagcagcctgcagcctgaagatgttgcaactttattactgtactaaaaatataaacagtacgccccgtatacgaccttttcgggaccggtaacgggaaccctaagggttcggaagactaccgaaacgaactggtaggtaccg

SEQ ID NO: 99998 - DNA, 639 bp, Homo sapiens
  misc_feature: GYAE6OF02H20NN.47.73.G07.1.454.CMB.1.raw
  modified_base (170)..(170): a, c, t, g, unknown or other
  misc_feature (170)..(170): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggcctcccagactaccagatgtgacatccagatcgacccagtccncactcctcctgtctgcatctgtaggagacacagtcacatcacgttcggccggcgagtcgaggactattagactaatttattacgccgttaggttactacaaacgaaacgaaaaccgaacggggaaacctacccccttaaacctcctacacttcctactactgacctatccctatttcgaacgtaaacggttcgggaccctagtacgtaacggttaccaggccggacaggtggacttcggtacgggactagtactttccacttctactactactcgacgcgtacgcctgacctacggtcctaggtaagtttagtttacgtaaactttagttacttacggtaaccgaacggtaacgggttaaccttccgtttccgacttccgtaccgttcgggaccgggacggaaccggtagggtacggaacgtagtaaacggtaaagtacggtggtacggtacgtacgaccctacttacg

SEQ ID NO: 99999 - DNA, 505 bp, Homo sapiens
  misc_feature: GYAE6OF02GEMFE.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagcaattatttagcctggtatcagcagaaaccagggaaagttcctaagctcctgatctatgttacatcactttgcattcgggtccatctcggttcagtgcagtggatcgtgggacagtactttcacctctcaccatcagcacgcctgcagcctgaagatgttcgactaactttattactagtaacaaaattataaacagtccacccgctactacgttcgggacggacgggaaccaagggtaggacgagtacaaacggaacgttggtagtaccg

SEQ ID NO: 100000 - DNA, 548 bp, Homo sapiens
  misc_feature: GYAE6OF02IKVQN.47.73.G07.1.454.CMB.1.raw
  modified_base (198)..(198): a, c, t, g, unknown or other
  misc_feature (198)..(198): n is a, c, g, or t
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtagagacacngtcaccatcacttcggccgggcgagtcaggacattagcaacttatttaaagttgtatcagcaagaaaccgagggaaacncccctaagctcctgactctaacgntgactatacctaagtttacggaaacgacgggtacccaagtcgaaaggttcagtaggaagtgaatcgtagggactagttacttttacttacactatcagcagtctgacagctagaatatattgacaatattattactagtacaactagtatacaattaactcctaccctacgtttccggacccgttaggaacctaaaggtcgtaactaacgtaccgaaacgtacgtgtacggtactacggactaaccg

SEQ ID NO: 100001 - DNA, 528 bp, Homo sapiens
  misc_feature: GYAE6OF02HZUHA.47.73.G07.1.454.CMB.1.raw
  modified_base (387)..(387): a, c, t, g, unknown or other
  misc_feature (387)..(387): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccggcagtcaggacattagcaattattagcctggtatcagcagaaaccagggaaagttcctaagctcctgatctatgttacatccactttgctaattcggggtcccatctcggttcagtgcagtggatcgtgggacagatttcactctcacatcagcagcctgcagcctgaagntgttgactaacttattactagtacaaaattataaacagttcgacccccgtatacctaccgtttcgggaccgggtacggggtaacccgaaagggttcgggaagtacgttaaccgaaaaccggtaacttacggtacggtaccg

SEQ ID NO: 100002 - DNA, 567 bp, Homo sapiens
  misc_feature: GYAE6OF02IPW70.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacacagtccaccatccacttggccgggcgagtcaggacattagcaaattatttagcctggtatcagcaaggaaaccgaaggggaaacgttacctaagctcctggatctatcgttacatcctactttgactacgttccggggtcccacttccgtcggtttacgagttggactaggtggtatcgtgggactagtatttcactctcaccatcagcacgcctgcagctagagtatcgttgactaactttattactagtaactaaaattaactaaactaacgtcgacccgtcttaccgtaacgtttccggacgggacgggtaaccgtaagggtacggtaacgaacgttaaccgaaacggtaacgttggacggtaccg

SEQ ID NO: 100003 - DNA, 584 bp, Homo sapiens
  misc_feature: GYAE6OF02HSNDT.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttggccgggcagtcaggacattagcaattattagcctggtatcagcaagaaacgagggaaagttcctaagctcctgatctatgttacactcctacttgctaacgtttccggggtcctatccgttcggttacgtaggtggcaggtggatcgtagggacagtactttccactctacaccatcacgtcacgtcctgcacgcctagaacgtattgttgacttaaactttattaacttacgtaaactaaaaattaactaacgaacggttacgaccccgtacttaccgtaccggtttccgggaccggggtaacgggaaccggtaagggtacgggaacgtaacgtaaccggtaaaaccggtaacgttcggggtagtcccgg

SEQ ID NO: 100004 - DNA, 566 bp, Homo sapiens
  misc_feature: GYAE6OF02HQ0AB.47.73.G07.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccatcggagaagttgtgttgacacagtctccagccacctgtctttgtctcaggggaaangccacctntcctgcagggccagtcagatnttcactctactagcctgtaccaanagaacctggtcaggctccgagctcctcatctagtggtcncactcccaccgagggcccacgtggtactccccagcctagggttcaggtcggctaggtcgggtcgtgggacagtacttccactcctacgacctatcagcaacgctaagacgtccgtagtaacgttacgtttcggttaacttttaacgttacgtgtactagcgtaggtcgttagtacgttcgtcggtcccttccgctcgttcgttcgggcggacgggtaccggagggtcggaacgtaacgtaaccgaacgtacgtggtacggtctacggacctacgtacg

SEQ ID NO: 100005 - DNA, 771 bp, Homo sapiens
  misc_feature: GYAE6OF02FFNRL.47.73.G07.1.454.CMB.1.raw
tcagagctcacgtacacgaccggtgctcgatttagctctacgctcgagggggcagaagtctctctcagtcaggacacagcatggacatgagggtccctgctcagctcctgggactcctgcttctctggctcccagataccagatgtgacactccagatcgacccagtctccactccctcctgtctgctatcgtaggaggacacacagtaccacctactcgtacgttcggccgggtacgtagtccgaaggtacctaagttaacgacttaaacttttgtacgtccgttagggtactaccgaacggtaccgaaaccggtaaaccggtaaggggttaaacctttccgaaacggtcccttaacctaggtaacctttaccttaacgttaccgttaactacctttcccttaacggtttcgaaccggtttaaccggggttcccggtacctgttccggttacggttacgagggttcggacgtagggtaggtactacgggtacggtaactacgttacctttaccgcctacctacaacctacgttaccgacgtacccgtaaccgccgtacggaccggtaaccgtacggttaattacgttacgttacctaaactttaaactttaacgtacttaaacgtaaaaccttaaattaaccggtaccgacccgtcccggtacctacgttacccgggttcgggacggggaaccggtaacgggtaacgtaacggggtacgtaaccgtaacgttacccggaacggttcgcgggtaccgtaccgtaccgtacc

SEQ ID NO: 100006 - DNA, 635 bp, Homo sapiens
  misc_feature: GYAE6OF02HGCYJ.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcagtcaggacattagacaattattagcctgtatcagacaagaaacgaggaacgttacctaagctcctgatctatgttacactcctactttgactaacgttccgggtaccctagtccgttcggttcgtaggtcggtacgtagtcggtacgttcgtacgggtacagttactttcgtaccttaccgtacctaccctaataccgacgtaccaccgtcctcgtacgaccggtccgtagaacgtagttagttacgtaaccttaaactttacttaacgttaagttaaactaaaaacttaacgttaaaccgacgttacccgaccccgtaccttaccgtaccggtttaccgggaccggtaacgggtaaccggtaacggttaggaacgtaacgtaaaccgtaaacggtaacggttacggtggtaccg

SEQ ID NO: 100007 - DNA, 760 bp, Homo sapiens
  misc_feature: GYAE6OF02IXE6Q.47.73.G07.1.454.CMB.1.raw
  modified_base (223)..(223): a, c, t, g, unknown or other
  misc_feature (223)..(223): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggcctcccagataccagatgtgacatccagatgacccagtcctccatcctccctgtctgcatctgtaggagacacagtcaccatcacttcggccgggngagtcaggacctattacgactaatttatttacgccgttggtatcagacgaagtaaaaccgagggtaaacgttaccgtaaagcctacctagtactaccttagttacgttaactaacttaccgtactttacgtacgtaaacgtttcccggggtacccctagttaccgttaccggtttactacggttcggtaccgtaaggttacggtaacttccggttaggggtaactaagggtacttttacctaccgttaccttaccgtaaccctacgttacgaacgtaccgtaacggtcccttacggccgtaacgtaccgttacggtaaacgtaacgttcggttacgtaaccgttaaacctttaacgtttaacgttaacggttaaaaccttaaaaacttaaccgttaaaactaccgggttaacccgtccccggttacttacccggttaaccgtttaacccggggaaccgggttaaccgggtaaaccggaacgggttaacggtaaggtaaccgtaacgtaaacccggtaacgttaggtaccggtaccgg

SEQ ID NO: 100008 - DNA, 531 bp, Homo sapiens
  misc_feature: GYAE6OF02FKXJW.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccaggcgagtcaggacattagcaactattaaattggtatcagcagaaaccaggaaagcccctaagctcctgatctacgatgcatccaatttggaacaggggtccatcaaggttcagtggaagtggatctggacagattttactttcacctatcagcagcctgcagcctagaagtatattgactaacattattactgtacaactagtatcaattaactcctacccctacgtttccggacccgttacgggaaccctaaaggtcggtaacttaacgtaaccgaaaaccggtaaccgttggtacggtacgtacggtaacccc

SEQ ID NO: 100009 - DNA, 707 bp, Homo sapiens
  misc_feature: GYAE6OF02IUQK5.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctcgtggcctccagactaccagatgtagactactccagatcgacctagtcctccactccctcctgtctgctatcgtaggtaggacgacacgtacgtaccaacctactcctacgttcgggacccgggcgtacgtacgaacggaacctaagttaacgaccttaaattttacgtttacggccttagggtactacgagaccgtaaacgtaaacccggtaaggggtaacgtttaccgtaaggtcccttaccgtagtacttacttacgttacgttaacctactaccttacgtttacgaccgttaacggttccggggtaccctagttcggttaacggttctaggtcgacgtaggtcggtactcggtagggactaggttactttcgaccttctaccactactacgtacgcgtacgtctacgacctaaccgtagtaacgttactttacgaccttaacttacgttactcgtacaacgtagtacgtttaacccggtaccttacgtacgtttcggacccgtaagggtaaccctaacggtacgtaacctaacgtaaccgtaaacgtacgttcggtaccggtactacgtacctacttacg

SEQ ID NO: 100010 - DNA, 726 bp, Homo sapiens
  misc_feature: GYAE6OF02HJ623.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcgagggcgttgacaaagtgtctttggccttggtttcagcagacacgagggacgccctaagcgcctgatctagtgtgcatactactttgactaaaggtcgggtaccagtacgtaaggttcaggcgcgtaaggtaggtccgtagggacaggtacgttacaccttactctaacttagtacgaacggtccggtaccttacggccgtaacgtacccgtaggaaacgtacttaacgtttacggaacctaaacgttaacgtttaacttttaaccgttacgtaacccgtaaaacgttaacggtttaaacttaacccgtaaacgtttaaacccttacccccgtttacccccccgtttaacccgggttttttacccccggggaaccccccggttttaaacgggggtaaaacccccgtttaaaaacgggggtttacgggttaaaccgtttaaaccgttaaacccggtaaaaaacccggtttaaccggtttacgggttaacccgggttaacccgg

SEQ ID NO: 100011 - DNA, 670 bp, Homo sapiens
  misc_feature: GYAE6OF02I7QJN.47.73.G07.1.454.CMB.1.raw
tcagagctcacgtacacgaccggtgctcgatttagctctacgctcagggggccaagaagtcctctcgtcagtccaggacacagcatggacatgagggtccctgctcagctcctggtactctgctgctctggctccagataccagatgtgacatccagatcgacccagtctccactcctcctgtctgcatcgtgtaggcgacagagtccactatccaccttcggaccgggactaagtcagacgactattaacgagacgtaactttaagtgtaacgtaccaacgaagaaaccggaacgggaaccgtaccccttaaccgtctaggatccgtatcgacgtcgactactccgtagtttcgcgtaacgtacggtcgggtacccctagtacgttacggtacgaggttcggacgtaggtcggtaacgtcgtagggaacctagtaccgtttaccgacttaccgaccaacctactaccgaacggtctacggttcgacggaacctaaccgttagaacgtttacttccggaaccttaaacctttcgggaacttagtaaccgtaagttacggtaaccggtttacccgtaccgttacgttcgttaccgggacggtaaccggtacgtaacgtacggaccttaagtaaccgtaacgtaccgttgggaccgtccggtagccctaacg

SEQ ID NO: 100012 - DNA, 551 bp, Homo sapiens
  misc_feature: GYAE6OF02FUYLE.47.73.G07.1.454.CMB.1.raw
  modified_base (219)..(219): a, c, t, g, unknown or other
  misc_feature (219)..(219): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggnagtcaggacattagcaattatttagcctggtatcagcagaaacagggaaattcaagctctgatctatgttacatcctacttgactaagttcggggtacccattctcggttcagttggctagtggacttcgtagggactagtatttacacgttctaccaccgtatcacgacagcccgtgaccagtaccgtagaacgtattcgtcgtactaactttattacttagtaactaaaaatactaaacgacgtcgtaccccgtctacctacggtttcggacggtacgggaaccgtagggtacggagtacgtaaccgaaacgtacgttaggtcgtaccgg

SEQ ID NO: 100013 - DNA, 560 bp, Homo sapiens
  misc_feature: GYAE6OF02FYIDT.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtccaccatcacttggccgggcagtcaggacattagctaattatttagcctggtatcagcagaaaccgaagggaaagttcctaagctcctgatctatgttacatcctacttgactaacttcggggtccctatcttcggttcagtgctagtgatcgtggacagtattcactctcacctatcagcacgcctgccacgtcctagaagtattcgttgactaacttattacgttagttaactaaaattaataaacgtaacgtaccgtaccccgtacttaccgtaccggtttcgggaccgggtaacggggtaaccgtaagggtacggaagtaacgtaaccgtaaacgtacgttacggtaggtaccgg

SEQ ID NO: 100014 - DNA, 587 bp, Homo sapiens
  misc_feature: GYAE6OF02HQ55V.47.73.G07.1.454.CMB.1.raw
  modified_base (221)..(221): a, c, t, g, unknown or other
  misc_feature (221)..(221): n is a, c, g, or t
  modified_base (452)..(452): a, c, t, g, unknown or other
  misc_feature (452)..(452): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatccctccctgtctgcatctgtaggagacagagtcaccatcacttggccgggngagtcagggcgttgcaaatgtctttggccttggttcagcagacacgagggaacggccctaagccgctgatctatggtgacatactactttgacgtaaaggtcggggtacccagtacgtaacggttcaggcggacgtaggtagggtccgtagggacctaggacgtttccgacttccgtccaacttagtccgacggtccggtacccttggaccgacgtaccgtaggtaacgtnttccgacgtaacttaacctttattacgtcgttcctaccgtaagttctagacttccgtacctttacccgtcggttaccgttcggacccgtaagggaccctaaggtacgtaactacgaaacgtacgtggtcgctacg

SEQ ID NO: 100015 - DNA, 529 bp, Homo sapiens
  misc_feature: GYAE6OF02F80M9.47.73.G07.1.454.CMB.1.raw
  modified_base (219)..(219): a, c, t, g, unknown or other
  misc_feature (219)..(219): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggngagtcaggacattagcaattatttagcctggtatcagcagaaaaccagggaaagttcctaaagctcctgatctatgttacatccactttgcaattcggggtccatctcggttcagtggcagtggatcgtgggacaggatttcacgtctcaccatcacgcagcctgcagcctgaagatgttgctaacttattacttagtaacgtaaaaaattataaacgtagtacgtccccgtctactaccgttttccgggacgggtaacggggaaccgtaagggttacggagtactaccgaaacgtacttagtcgtaccg

SEQ ID NO: 100016 - DNA, 580 bp, Homo sapiens
  misc_feature: GYAE6OF02IMP4Z.47.73.G07.1.454.CMB.1.raw
  modified_base (199)..(199): a, c, t, g, unknown or other
  misc_feature (199)..(199): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacngtcaccatcacttggccgggcgagtcaggaccattagcaatttattagcctggtatcagacaagaaacccgaagggtaaacgttacctaaggtcttacctagatcttaatcgttacaacgtcctaactttcgactaacgttccggggtcctatccgttcggttacaggtcgcgtagtggatcgtgggacagtattcacgtctacactntacagacngtcctgctacgcctagaaagtgtagttcaacctaatttacttaacttagtaaacgtaaaaattactaaacgtacgtccgacccgtactaccttacggttccggacgggtacggtaaccgaagggttagaacgtaacgtaacgaaccgtaacgttcggagtaccgg

SEQ ID NO: 100017 - DNA, 549 bp, Homo sapiens
  misc_feature: GYAE6OF02IR6E7.47.73.G07.1.454.CMB.1.raw
  modified_base (195)..(195): a, c, t, g, unknown or other
  misc_feature (195)..(195): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctagtagganacacagtcaccatcacttgcggcagtcaggacattagctaattattagccttaggtatcagcaagaaaccagggaaacgcccctaacctcctgatctatgctgacataccaagtttggaaactcggggtaccagtacgaagttcagtaggaagtggactgtgggactagtacttttaacttcaactatacagactacgcctgacacgtcctagaagattatgacaaactatattactgtaacaacagttatactaagtaacttcctaccctaccgtttcggaccccgttaagggaaccctaaaggtagtactaattaccgaaaacgtaccgttaggtaccggtactacgtaacc

SEQ ID NO: 100018 - DNA, 632 bp, Homo sapiens
  misc_feature: GYAE6OF02H1JWO.47.73.G07.1.454.CMB.1.raw
  modified_base (253)..(253): a, c, t, g, unknown or other
  misc_feature (253)..(253): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgaccccagtctccatcctccctgtctgcatctgtagagacacagtcacatcacttgcggcgagtcaggacattagcaattattagcctggtatcagnaagaaccaggaattcctaaagctcctagatactatagttacattacctactttcgtactaaacgtttccggggtaccctaacgttcgttccggtttcgtaacggtttcggacgtacggttaggtactacggtcgggtaaccgaacggttaacttttcctacgttaccctaccaaccttagttacacggcaacggtccttcgactacgaccgttagaagtacgtagttagaccttaaactttacttacgttacgtaaactaaaaacttaataaaccgtagtccgtaccccgacttcgtaccgtttacgggaccgggtacgggaaccgtaagggtacggtaagaacgttaaccgtaaacggaactttaccggtaggtaccg

SEQ ID NO: 100019 - DNA, 980 bp, Homo sapiens
  misc_feature: GYAE6OF02HDH6D.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggcctcccagataccagatgtgacatccagatcgacccagtctccattccctccctgtctagcattctggtagagaccacgacgttccaacctatccgtaacgttcgggacccggggtacaacggttccgaacgggtaacctagtttaacggaccttaaagttttacgtttaacggccgttagggttaactacgaacggtacctaaaacgtaaaccgtaaggggttaaaaccttccgtaaacggtcccttaccctttaggaacctttccgttaagttaccggttaacctacgtttaccccgttaagttttccggaacgtttaaacggttccggggttacccctaagtttccggtttaccggggtttacaaacgggttcggggtaacctaaaggggtttccgggtaatttacccggtaggggggtaaaccctttacggggttaacctttttacccggtaaccctttaccgttaacccctaaacccgtttacggccgtaaaccggtccgttaaaccggggttcccttaaggaccccgtttaaccgggtaaccgttacgggtaaacggttaccggtttaacgggtttaacccgaaaccgggtttttaaaacccctttaaggtttttaaccggaaaccccgtttaaaatttaaaaaacgggttacccgttaaaaccggtacccggttaccccggtaccccggtttaaccgttacccggggttttaccggtttaaacccggggggaaccgggttttaaaccccggggaaagtttaaccgggggtaacgttaaacccggttaaacggttaaacccgggttaaaacccggttacggtttccgggtaaggggttaaccccccg

SEQ ID NO: 100020 - DNA, 605 bp, Homo sapiens
  misc_feature: GYAE6OF02G1F14.47.73.G07.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtagganacacagtcaccatcacttgccgggnagtcaggacattagcaattatttagcctggtatcagcagaaaccagggaaagttcctaagctcctgatctatgttacatcctactttcgctaatttcggggtccctatcctcggtttcagtggcagtgatcgtgggacagtntttacactctcaccatcancacgcctgcagcctagaacgattgttacgctaactttacttactacggttaacctaaaaattacgtaaaaccgtaagttacccgtacccccgtacgttacccgttaaccgttttcccggggaaccggggttaacggggtaacccgtaaacgggggttacgggaacggttaacgttaacccggtaaaacccggtaaacccggtttaggggtaccggttaacccggg

SEQ ID NO: 100021 - DNA, 683 bp, Homo sapiens
  misc_feature: GYAE6OF02HZY83.47.73.G07.1.454.CMB.1.raw
  modified_base (363)..(363): a, c, t, g, unknown or other
  misc_feature (363)..(363): n is a, c, g, or t
  modified_base (506)..(506): a, c, t, g, unknown or other
  misc_feature (506)..(506): n is a, c, g, or t
  modified_base (544)..(544): a, c, t, g, unknown or other
  misc_feature (544)..(544): n is a, c, g, or t
  modified_base (650)..(650): a, c, t, g, unknown or other
  misc_feature (650)..(650): n is a, c, g, or t
tcagagctcacgtacacgaccggtgctcgatttagctctacgctcagggggcgaggaagtctctctcagtcaggacacagcatggacatgagggtccctgctcagctcctgggactcctgctgctctggcctcccagactaccagtatggtgaacatccaagtatcgacccagtcctccatccttccctgtctgcctatctggtaggagaccacagtccaacctactctacgttccgggcgggggtaccgtacggttacgacggtaacgttacgttaacggtacctaaaagttttacgtttaacgtccgttgggttacctacgacgacgaacggaaaccgtaagggtaaactttaccgtaacncgttccgagacttacttatacgttacgtactccttacgttacacgttaaccggtccggggttcctacgttcgtccggttactggtacggtcgtaaggttgtacgtcgtagggtactagttattacctactacttaccgaactnaccgtgccagttcccaaggttccataccgtgaaacgtnacggttacgtactaacgtttacagttaataactaaaattaaccgagttaccgtccgaccgtacttccggtacgttacgggacgggaaggtaaccgtaaggtcgganaaccgtaacgtaaacgtcggtagttcggtaacg

SEQ ID NO: 100022 - DNA, 676 bp, Homo sapiens
  misc_feature: GYAE6OF02H7987.47.73.G07.1.454.CMB.1.raw
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
tcagagctcacgtacacgaccggtgctcgatttagctctacgctcagggggcagaagtctctctcagtcaggacacagcatggacatgaggtccctgctcagctcctgggactcctgctgctctggctcccagataccagatgtgacatccagatgacccagtctccatcctccctgtctgcatctgtaggagacacagtacaccatctacttcgccgggcagtcaggacattagcaacgtggttacgcctggtatcaacaagaaaccgaggaaccncccgttaacctctcactcnctacgtncactcctatttcgacgtaaacggtcgggtaccctaatacgaacggttccgacggacggactagggttacggagttccggtagggtaacctaggttacttttaccgaccgtttcctaaccgtaacttagtacgacgtacaacggtccctaggaccacgttaccgtaggttaacgttattttacggaaactttttagttacttaacggttaccaaacgggtaacggttaacctttacccgtttcccgtacgttaacccgttcccggttaacggggaccgggttaacgggaaacccgggtacgggtaggtaacggtaagttaacgggaaaacgttacggtcgggtacggtacccgtacggtaccctacgttaaccg

SEQ ID NO: 100023 - DNA, 676 bp, Homo sapiens
  misc_feature: GYAE6OF02JYQ18.47.73.G07.1.454.CMB.1.raw
  modified_base (228)..(228): a, c, t, g, unknown or other
  misc_feature (228)..(228): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggcctcccagataccagatgtgacatccagatgacccagtcctccatcctccctgtctgcatctgtaggagacaggtatccaccatccacttcggaccggganaacggtcagacgactaattaaccagtaccgttaattttaaaagttggtaactaccaaccgaaggtaaaaccgaacgggggaaacctaccccccgttaaacctccgttagacttaccgttacgtacgtcctacgtactacttaccgtaaggttttcgactaacggttacggtcggggttacccctagttaccgttaggttccgtaaggtcggacgtaggttacggaagttccggtaggacgtacgttactttaccgacttccgaacacctatacgagactacggtctcgaacctacgtagtaagttcttttacgaccttaacgttacctacggttacaacgtacgtacgtaccggttaccgtaacccttcgttacgttcggaccgtaacgggcctaaacggtgaacctagtaaccgtaaacgtcgtaggtaccggtactacgacctaac

SEQ ID NO: 100024 - DNA, 814 bp, Homo sapiens
  misc_feature: GYAE6OF02HT9EC.47.73.G07.1.454.CMB.1.raw
tcagagctcacgtacacgaccggtgctcgatttagctctacgctcagggggcagaagtctctctcgagtcaggacacagcatggacatgagggtccctgctcagctccgtgggacctctgctgctcgtggttcccaggtgccgagggtgtcgaacctacttaccgagtagtaccgacccgtagttccctaccctaccttcccgttccgtcgttctgactatccgtaggtaagggacaacgagtaccgaccaactactcgtaaccgtcgggaccggtagtaacggtccggaggggttacgtacgtaaaccgtaagttcggttacgttcggttacgtacgttcggacgcgtaagaaccgacggaaacgggtaccgacccctaagccgtctagtaccgttatacggtggtaccaataccgtaacgtttaccgttacgggaacggttaacggtcgaacccgtcgttaacggtaacggtcgacgggtacacggttaacgggagggttacgaacgggacttaagttcccgttaccgtaccttaccgactttaacctacgaaccggtacgtccggtaccgttacgaccgtacggtaccgtaaacggttacggttacttaccggttattaaacccggtttaattaccgttttaaccggtaacgttacccgttaagtaaccggttactacgttaccgtaccgttaaaccccgtttaggcccggtttaacgtccgggtaaacctaacgggggtaaacctaggggtaaaacctaacggtaaacctaccgggttacgtaacggtcggtaccgtacgcttaaaccgg

SEQ ID NO: 100025 - DNA, 684 bp, Homo sapiens
  misc_feature: GYAE6OF02ICP8C.47.73.G07.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatcgacccagtcctaccattcctccctgtctgcatctgtagganacacngtcacatcacttggcggcagtcaggacattagactaattattacgactggtaatcgagacaagaaaccgaagggtaaacttaccgtaagccttaccgtgtaacttacttaagtcgtttaacctacttacctaacgtttgaccgtaaacgtttcccgggggtaccctaacgtccgttacggttacgtaaggtcgggtacgaggttcggtaactcggtacggggaactaacgttatttccgtactactctaacagtccagtacagtctacggactacgtcgtacgtaaagtctagttacgtacttaaacgtttacttaaacgtacggtaaactaaaaacgttaaactaaaccgttacgtaccgtaccccgtacgttaacgtaacccgggtttacggaaccggggtaacgggtaacccgggtaaagggttccgaaacggtttaacgaaccggtaaaacggtaaccgttacgggtacggtaacgg

SEQ ID NO: 100026 - DNA, 736 bp, Homo sapiens
  misc_feature: GYAE6OF02HN9CI.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtagagacacagtcaccagtcacttcggccggcgagtcaggacattagactaattattagcctggtatcagacaacgtaaaccgaagggtaaacgttaccgtaaacgtccttacctagtacttacgttaattacgtttacacttacctaactttgactaacgtttccggggtaccctaagttcgttacggtttacgaggttcggacgtaggttcgagttaccggtagggactaagttactttaccgtaccttaccgtaccaaccgtatacgacgtcctaacggttcgtaccgtaaccgtaaaccctaggttaaacgtttacgttttacgtaaccctttaaacgtttaaaccgtttacccgttacgttaaccgtaaacgtaacggttaacccggttttaaacccggttaacccccgtttaaccgtttaaccgtttccgggaacccgtaaccggggtaaacccttaaacggtaccggtaaaccttaacgtaaacccgtaaaaaccgtacgttacggtaccggttacgtaaccggtacctaccgttaacccg

SEQ ID NO: 100027 - DNA, 733 bp, Homo sapiens
  misc_feature: GYAE6OF02GD7RI.47.73.G07.1.454.CMB.1.raw
  modified_base (238)..(238): a, c, t, g, unknown or other
  misc_feature (238)..(238): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatcgacccagtcctaccattccctccctgtctcgactatcgtggtaggagaccacacgtccaacctatcacgttggacccgggngtacgtcgaaggtactagttaagtactaatttactttacgccttaggtatacgagtacgtaacgaaacgaagggtaacgttacgtacgtactcctagtacttactagttacgttaactacttacctacgtttacgaccgttaacggttcccgggttaccctacggttccgttccggttacgtaagggttcgaccggtaggttacgtcgttacggtacgggtaactacgttacgtttaccgtacctccgtacctaaccgtactaaccgtacggacccttcgaccggttcgacgtaccggtacgtacggaacgttacggttactagttaaccttaacgttttactaacgttacgttaaactaaacgtaacgttaaccgtacgtacccgtacccgtaccgttaccgttaccgggttccgggaacggtaaccgggttaacgtaacgggtacggtaacggtaaccgtaaccgtaaacggtaccggtacgggtacgtaccg

SEQ ID NO: 100028 - DNA, 809 bp, Homo sapiens
  misc_feature: GYAE6OF02FKXO3.47.73.G07.1.454.CMB.1.raw
tcagagctcacgtacacgaccggtgctcgatttagctctacgctcagggggcagaagtctctctcagtcaggacacagcagtggacatgagggtccctgctcagctccgtgggactcctgctgctctggctccagataccagatgtcgacatccagtatcgaacccagtcctccactccctcctgtctgctatcgtgtaggacacacgacgtccacctatcctacgttcgggaccgggtcgacgtcgaaggtactaagttacgacttaatttacgtttacgccgttaggtactcgacgactaaacggaaaacccggtaaggggtaaacctttacccgtaaggtccctttacccgtaaggttaacttaccgttaagtttaccggtttaaaccaccgttttaccccgtaacgttttacggaaccgtttaaccggttcccggggtaaccctaggttcccggtttaccgggtacgtaacgggtcggtaaccgtagggtttacggtaacgttccgggtaacgggtaaccttaaggtttaccgttttaaccgacctttacccgtaccgtaacccgtaacgtacgtacgtaccgtacgtccgttacgccgtacgtaccgtagaacggtacgttacggttactaacttaactttacgttaacgttaactaaacgtaaaacgttaactaaaccgttcggttacccgtacccgttacgttaccgttaaccgggttaccgggaaccgggtaaaccggtaaccggttaagggaacggtaacgtaacggttaaaccggaaaccggtcgtacgggtcgtaccg

SEQ ID NO: 100029 - DNA, 822 bp, Homo sapiens
  misc_feature: GYAE6OF02H655B.47.73.G07.1.454.CMB.1.raw
tcagagctcacgtacacgaccggtgctcgatttagctctacgctcagggggcagaagtctctctcagtcaggacacagcatggacatgagggtccctgctcagctccgtgggactcctgctgctcgtcggcctcccagataccagatgtgacatccagatcgacccagtcctccattccctcccgtgtcctgacctacttcgtaggtaagggactaaccacttacgtccaacctaatccgtacgttccgggaccggggcaagtcgaacggtacctaagttacgactaatttaacgtttacggccgttaaggtaactccgagtaccgaaacggtaaaaccgaagggggttaaaaccttacctaaacggtcctacccgttagaacttacttagttacgttaacctacttccgttaagtttcgtaccttaacgggttccggggttaccctagttccggttaccgtaatacgggtcggtacctaaaggggttcgacgtttcggaacggggtaacctaggtactttaaccgtcttacccgttacacccgttaactacgtacgtaccgaacggtcctacggtacctacggttacccggagttaaacggtacgtttcgttaacggtacctttaaacttaaagtttaaccgttaagttaaaaccgttaaaaattaaccgtaaaagttaccggttacccgggtcccctaccgttaccgtttaaaccgggttaccggggaaacccgggtaaggggaaacccggttaacggggttaagggtaacctaacggttaaaccggtaaaaccggtaccggttagggtacgttaaccgg

SEQ ID NO: 100030 - DNA, 714 bp, Homo sapiens
  misc_feature: GYAE6OF02I3R49.47.73.G07.1.454.CMB.1.raw
tcagagctcacgtacacgaccggtgctcgatttagctctacgctcagggggcagaagtctctctcagtcaggacacagcatggacatggagggtccctgctcagctcctggggactcctgctgctcgtggcctcccgaggtcgccgtaggtgtgacatccagatcgacccagtcctccactccctccctgtctcgctatcgtagtaaggacgacaggacgtccaaccactcctaaccgttcgggcccggggacgaggttaccggaggggtcgttacggactaaagttgttcgtttcggtccgttggtttacgacgtacgacgacccgaaccggaacgggggaaccggaccccgtaacggccgccgttgtaacttctaggtgtcgtactatacttacgttacgaacgtaacggtcgggtacctacgtacgtaacggtacgacggtacggacggtaggtacggtcggtagggtaactaggtacgttctacgtactaccgtaactacgtacgtacggtccgtaccgtcgacgtacgtcgtagtaacgttacttcgtacgtacctttaacgtttaacgttacttacgttcctacgtagttatcgtaagttccgtacccgtttacccggtccggttaccggtaaccggtacggtaacggaacggttaacggtaacgtaacgtaacgaaccggttacgtacggtacggtacctcgtaccg

SEQ ID NO: 100031 - DNA, 810 bp, Homo sapiens
  misc_feature: GYAE6OF02HSPF7.47.73.G07.1.454.CMB.1.raw
  modified_base (242)..(242): a, c, t, g, unknown or other
  misc_feature (242)..(242): n is a, c, g, or t
tcagagctcacgtacacgaccggtgctcgatttagctctacgctcagggggcagaagtctctctcagtcaggacacagcatgacatgagggtccctgctcagcctcctgggactcctgctgctctggcctcccagactaccagatgtgacatccagatcgacccagtcctccacgtccctccctgtctcgctactcgtaggaggacgacgagtacgtaccacactccgtacgtcggccgganaacggtcgagacgctaacttaacgagtacgttaagtttaaagttaggtaactaccgaaaccgtaaacggaaaaacccggaacgggtaaaaccccgtacccccttaaccgttaccgtagtacttacgttagtcgtaccgttcgactaccgttaccgttagttttacgaaccgtaacggttacgggttccggggtacccttaacgttaccggtttaacggtttaccgtaacggtacgggtaacgttagggtacggttacgtacgggttacgggaacttacggttaaccgtttacctaacccggttacctaacccgtaccttaacgtaccgtaacgtcgtacgtaccgtacgtaaccgtaaccggttagttaaacgtttctttaaccgtaaccgttaaccttttaaccgtactaccgtaaaccgttaacgtaaacgtttaacccggttaccccggttaacccgttacgtttacccgttttaccgggaacccgttaaccggggtaaacctaaccggtacggtaaccgtaactaaccgtaacgtacggtacggtacgtcgtcgaacccttacg

SEQ ID NO: 100032 - DNA, 830 bp, Homo sapiens
  misc_feature: GYAE6OF02J0PEN.47.73.G07.1.454.CMB.1.raw
tcagagctcacgtacacgaccggtgctcgatttagctctacgctcagggggcagaagtctctctcagtcaggacacagcatggacatgagggtccctgctcagctcctggactcctgctgctctggctcccagactaccagatgtgacactccagatgacccagtctccactcctccctgtctgcactctaggtaggagacagtacgtcacctagtcctacgttcggccggggacgtacgtacggtacgggtcggttagacctaaagttcggtcgtttcggtccgttcggtttacgacgacgaacggaaccaaccggaacgggggtaaaccggtaccccgtaacggccggtaccgtacggtaacttaccgttagttcgggtacgtactaaccgttaaaccgtacgttttaacggaaccggttaaacgggttaccggggaccgtaaacgtacggttaaacgggtttcgaacgggtcggggaaccgtaaggtttaccgggtaccggttacggggaacgtaacgggtacggtttacccgtaaccgttaccttaacccgtacgtaacgtaccggtaacgggtaccggtcccgtaaggtccctaaccggtccgtaacgttaaacgttcgttaaaccttcggtaaccgtttaaactttaccgtaaccggttttcaccggttaaccgttaagttacgttcgtaacgttcccgtaaccgttttaccggtacgtttaccccggtttacgggaaccggtaaacgggttaaccgtaaacgggtaagtttaaacccggtaaccgtaaaccggtaccggttacggttacgtcccgttaaccgg

SEQ ID NO: 100033 - DNA, 671 bp, Homo sapiens
  misc_feature: GYAE6OF02GY859.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagctaattatttagcctggtatcagcaagaaaccgaagggaaagttaccgtaacgtctcctgtatctatacgttactatcctactttgactaacgttccggggtccctactcgttcggttcgtacggtggcgtaggttaggtagtcgacggggttttttttttaacgagttactttacctacttacctaccgtaaccctacgtaccgtaacgtcgtaccgtccgttcggtaccacggtacccgtagtaacggtacgttcgttacgtacttaactttactttaacgttaagttaaactaaaattaaacgtaaacgtaacgtaccgtaccccgtaccgttaccgttaccggtttaccgggtaccgggtaacggggtaaccggtaagggtacgggtaacggtaacgtaaccgtaaaccggtaacgttacggtacggtaccgg

SEQ ID NO: 100034 - DNA, 735 bp, Homo sapiens
  misc_feature: GYAE6OF02F8T3S.47.73.G07.1.454.CMB.1.raw
  modified_base (220)..(220): a, c, t, g, unknown or other
  misc_feature (220)..(220): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacacagtcaccatcacttggccgggnagtcaggactattagctaattatttagccttggtatcagtcaagaaaaccgaggggtaaaacttccgtaaagccttaccgtagtaacttacttagttacgtttaacagttccctaacgttttgaccgttaaacggtttcccggggtaccctaacgttccgttccggtttacgaacgggttggaccgtaggttacgggtacttacggtaggggtaactaggtaacttttaccaccgtttacctaacccgaacctattccgaacgtaccgacggtccctaggacccgtaccgtaccgttaaggaaaggttacgttacggttacgtaaccttaaaacgttttacgtttaacgttaacgttaaaactaaaaaacgtttaacaaacgttaaccggtacccgtaccccggttacttaacccggttaaccggtttaccgggggaaccgggtaaacgggtaaccggttaagggtacggaacggtaacgttaaaccgaaacggtacggttaggtacggtaaccg

SEQ ID NO: 100035 - DNA, 818 bp, Homo sapiens
  misc_feature: GYAE6OF02JKJSM.47.73.G07.1.454.CMB.1.raw
tcagagctcacgtacacgaccggtgctcgatttagctctacgctcagggggcagaagtctctctcagtcaggacacagcatggacatgagggtccctgctcagctcctgggactcctgctgctctggctcccagataccagatgtgacatccagatgacccagtcctccatccctcctgtctcgcatctggtaggagacacgtagtcaccatcctacttcggccgggtcgagtccgaggactattagctaaatttagtttagccgttggtactctagacctaacggaaaaccgtaaggtaacgttacctaagtccgtccgtagtactacgttatcgttaacacttccctaacgtttcgtacctaacggtttcccggggtacccctaagttccgtttaccgggtttacaagggttcggtacgtacggttacggtacttcggttacggggtacctaagtttaccgttttaccgaccctttacccgtcctaaacccgtacgttaccgtacggacgtaacccggtccccttcggtaacccgtacggtacccgttaggaaacgttaccggtttagtttaccggtaaaccctttaacgttttaaacccgtttacggtttaaaccgtaaaacttaaaaaccgttaaagtaaaacccgttaccgggttaccccggtaacccccgttttaccgtacccgtttaacccggggtttacccggggaaacgggggttaacccgggtaaaccgggtaaacggggttaacgggtaacctaaccgggtttaaaacccgaaaccggtaacccggtttggggtaacttaccccggg

SEQ ID NO: 100036 - DNA, 681 bp, Homo sapiens
  misc_feature: GYAE6OF02GV9BF.47.73.G07.1.454.CMB.1.raw
  modified_base (199)..(199): a, c, t, g, unknown or other
  misc_feature (199)..(199): n is a, c, g, or t
  modified_base (334)..(334): a, c, t, g, unknown or other
  misc_feature (334)..(334): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
tcagagctcacgtacacgaccggtgctcgatttagctctacgctcagggggcagaagtctctctcagtcaggacacagcatggacatgagggtccctgctcagctcctgggactcctgctgctctggcctcccagataccagatgtgacatccagatcgacccagtcctccactccctccctgctgcattctgtagganacctacagtccaccactccacgttcggccgggcagtcgagactattacgactaaatttactttagccgttaggtactacgagacaaacggaaacccgtaaggggttaaaacttcccgaagtcctacctagacttntattacgtctactcctacttgacttacgttcggacccttatccgttacgtcgagtcggacnggtagntcggtagaatagtacttcaccttcaccactgacncgtacnccgtcctagtccgacgttacgtagtaacttggttacgttaccgtaacgtttaaactttttacgtaaacgttaacttaaaacttaaacgttaaaccgttacgttaccgggtaccccgttccgttacccgtttaccgttaaccgggggtttccggaaacggggtaacccgggttaaggaaacgggttagggaaacctaaccgttaaaccggaaaccgggtttaggtccggttaccgggaccg

SEQ ID NO: 100037 - DNA, 758 bp, Homo sapiens
  misc_feature: GYAE6OF02GLLQB.47.73.G07.1.454.CMB.1.raw
  modified_base (357)..(357): a, c, t, g, unknown or other
  misc_feature (357)..(357): n is a, c, g, or t
tcagagctcacgtacacgaccggtgctcgatttagctctacgctcagggggcagaagtctctctcagtcaggacacagcatggacatgagggtccctgctcagctccgtgggactcctgctgctctacggctccagtactaccagtactgtgacatccagtactcgacctgtctccatccctcctgtctgcactcgtaggtagacactactacgtcaacgtatcgtacgtcggccgggtacgacgtacaacgggtaactagtacgaactaattagttacggcttaggactcgaagaccgtaacgaaaacgtagggtaaacttaccgaacgtctcctaagtcttactaagtcttaacnccttacgtacgtttagacggttacggttccggtacccttagttccgtaccgggtttcaggttcggtactaggtcgtactacggtaacggtactgttacgtactacgtacgtaacctaacgctacctaagtaccggtacgtccgtacggtctaaccgtacgtacgtaaacgttacgttacggtaacgttacttaacgtttaacgttaaaccttaaacggtaaaacgttaaaacgttaaaccgtaaccgtaacgggttacccctaaccggttaccggttaccgttaaccggggtttaacccgggaacccggggttaaacgggtaaccgggttaacgggtaacgggtaacgttacccggtaaaaccgggttaaccggtacggttaccgggttacggtaacccgg

SEQ ID NO: 100038 - DNA, 695 bp, Homo sapiens
  misc_feature: GYAE6OF02IIJRV.47.73.G07.1.454.CMB.1.raw
  modified_base (179)..(179): a, c, t, g, unknown or other
  misc_feature (179)..(179): n is a, c, g, or t
  modified_base (313)..(313): a, c, t, g, unknown or other
  misc_feature (313)..(313): n is a, c, g, or t
tcagagctcacgtacacgaccggtgctcgatttagctctacgctcagggggcagaagtctctctcagtcaggacacagcatggacatgagggtccctgctcagctcctgggactcctgctgctcgtggctcccagataccagatgtgacatccagatgaccagtctcatcctcctgtcngcatcgtgtaggagacagtagtccacatccacgttcggccgggtagaggtccgagggcgttagacgaaaatgctttaggcctggtttcagtcacgacacgaagggacggacccctagccgactgatctatcggngtacatactacgttgacgaaggtcgggtaccagtactaaggttcgaacggtccggaacgtaacggttacggtaccgttacggggaacgtacggttaacggttaccgtaaccgtccgtaccgtaaaaccttcgttaaacgtaaccgggtccggtcccgttaagggccttaacggtcccgttaggaaacgttacgtttcgacgttactaaaccgtttaattccgttacgacctttacgtaagtaacgttagaacgttcgtaccgtttacccgttcggtttaacgtttcccgggaaccgttaaaccgggggtaaccgttaaaggggttaaccggaaagttaacccgaaaacgggtaccgttaacggttcggaccgtttaacccgg

SEQ ID NO: 100039 - DNA, 801 bp, Homo sapiens
  misc_feature: GYAE6OF02FVV4R.47.73.G07.1.454.CMB.1.raw
tcagagctcacgtacacgaccggtgctcgatttagctctacgctcagggggcagaagtctctctcagtcaggacacagcatggacatgagggtccctgctcagctcctggggctcctgctactcgtggcctccggaggtgccagatggtgacatccagactcgacccagtcctccactccctccctgtctgccagttctaggtaggacgaacagacgtaccaaccattccgtacgttcgggccgggactaacggtccgagacgacgtaattaacgagtacgttaattttaaagttcggtaactaccaaccgaacgaaaacccggaacgggaaacccgtacccccgttaaccgtccgtagtaacttacgtagtacgtcgtcgtactaaccgttccgttaggttttacgacgttacggttacggggttaccggggttaccctaagtttaccggttagggtttacggaggggttacggacgttagggttacggtacggttccggtaacggggtaactcgtttactttccgactttccaccgtaccgtaacttcgacgtacgtcgttaccgtacgtaaccgtaacgttagtaacgtttacgttttacacgtttaaactttaccgtaacgttacgtaaccgttaacgtaaccgggtttaacccgtttaaccccgggttaccctttaacggtttacccgggttacgggaccgtaaccggggtaaaccctaacggtaacggtacccgtaaacgttaccgaaaggttaccggttacgggtacccgtacggtaccaccgttaccctacgg

SEQ ID NO: 100040 - DNA, 756 bp, Homo sapiens
  misc_feature: GYAE6OF02ID6LV.47.73.G07.1.454.CMB.1.raw
  modified_base (119)..(119): a, c, t, g, unknown or other
  misc_feature (119)..(119): n is a, c, g, or t
  modified_base (750)..(750): a, c, t, g, unknown or other
  misc_feature (750)..(750): n is a, c, g, or t
tcagagctcacgtacacgaccggtgctcgatttagctctacgctcagggggcagaagtctctctcagtcaggacacagcatggacatgagggtccctgctcagctccgtggacctctgntgctctcggcctccagataccagatgtcgacactccagatacgaccctagtcctccattcccgtccgtcgtctacgctaacgtcgtagggtaggacgtacaccgtagtaccctacctacttccgaacgttccgggaccgggtcgtaacggtacgtacgtaacgtacgttaacttactaaacgttttacgttaccgtcgttaggttactaccacggtaacggaaacggttaaaaccggaacgggtttaaccgttacccgttaacgtccgttaccgtacgtaacttaccgttaagttcgtaaccttacgttaccgtacgtttacgtacgttaccggttccgggtacctacggttccgtacggtttcggaagtcggtacgtaggtcggtacgtccgggttaaggtaccgttagtttacttcccgtactacccgtaacctaacgtataccgcgtacacggtcccgtacgtcgtacgtcgtaagtaccgtgttaaccgtcgtacttacgttaaccgtaattacgtaaactaaacgttaactacgtaaccgtaccgacccgttactaccggttacgggtaccggaccggtagggtaacgtaaggtaggtaccgtacgtaaccgaccggttatccggntaaccg

SEQ ID NO: 100041 - DNA, 773 bp, Homo sapiens
  misc_feature: GYAE6OF02I3H1L.47.73.G07.1.454.CMB.1.raw
tcagagctcacgtacacgaccggtgctcgatttagctctacgctcgagggggcagaagtctctctcagtcaggacacagcatggacatgagggtccctgctcagctcctgggactcctgctgctcgtggctcccagataccagatcgtgacatccagatcgaccctagtctccatcctcctgtctgctatcgtgtaggacgacacgacgtcaaccgtactccgtacgttcgggacccgggtacgtaacggtaccggacgggttcgttaacggaaccgttaaagttcggttaccggtttcgggtcccgtttacggtttacgaacggttaccgaaggtaaccccgaaccgggtaacggggtaaaccccggtacccgtaaacggcccgtacccggtacggtaaccgttaccgtaagttgggtacctaacgtaacgttactacgtttacgaacggttaacggtcgggttaaccctagttaacgtaacgttcgacgacggtacgtaaggttacggtacgtacgggtaactggttaaccgttccgactaccgtacgtaactcgtaacggacggtaccgtcgacgtacgaaccgttacgtaagtaccgttatcccggtaactacctttaaacgttacccgttacgtaccgttaccttaacggttattacttaggtaaccttcgttaccgttacccgtacgttacgttaacgggccgtaaacgggtaccgttaagggaactaacggtacgaaaccggttcggtacggtacgtcgtaacccg

SEQ ID NO: 100042 - DNA, 564 bp, Homo sapiens
  misc_feature: GYAE6OF01DUB12.18.13.B02.1.454.CMB.1.raw
  modified_base (311)..(311): a, c, t, g, unknown or other
  misc_feature (311)..(311): n is a, c, g, or t
  modified_base (379)..(379): a, c, t, g, unknown or other
  misc_feature (379)..(379): n is a, c, g, or t
tcagtacgagtatgcacgaccggtgctcgatttagtctagcgactttgtgtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggngatgctggcaccggctggtactactttgattccgtgggccagggaaccctggtccaccgtctccgtcncgccctccaccgaacgggcccacgtccggtccttccccgtcggcccgccctcgcctccgacggacgccaccgtccgagacgcacgcgccggcccgtgggctcgccgtggtaccgaacgggtacctaccgttccccaatacccgttcgtacgtcggaacggtccggggactgggacgagggcgacg

SEQ ID NO: 100043 - DNA, 615 bp, Homo sapiens
  misc_feature: GYAE6OF02IKEV2.18.13.B02.1.454.CMB.1.raw
  modified_base (605)..(605): a, c, t, g, unknown or other
  misc_feature (605)..(605): n is a, c, g, or t
tcagtacgagtatgcacgaccggtgctcgatttagtctagcgactttgtgtttgggtccctcagactctcctgtgcagcctctggattcaccttcagtaactactacatggcctggatccgccaggctccagggaggggctggagtacgtctcatacatcagtaacactaggaaataccatatactacgcagactctgtggacggggccgattacaccatccgccaagggacaacgcccaagacgctacacattatctagcagatgactgcctgagcgcgaggactcggacctttactacgtgtcgcgagacgacgtcccggagatcgctcggaccaccggcgtacggttctacgttttgacgtttccggaggggacccgaacgggtacccctggtcccgtaccggtcctccgtcgaccaccctaccgaaccgaacgggtcccaccgtttccggtccctccccgtggccctaccctgacctccgaggccgccaacccgtcgacgaccgcaccgacggccgcccggtgggacctcgccgtgtaccgacgtcctttaccgtcctaccgtacgttaccgtggacgacgggtccggacggtcgggaacncgggctaacg

SEQ ID NO: 100044 - DNA, 352 bp, Homo sapiens
  misc_feature: GYAE6OF01A44C5.5.20.B09.1.454.CMB.1.raw
  modified_base (345)..(352): a, c, t, g, unknown or other
  misc_feature (345)..(352): n is a, c, g, or t
tcagatcagacacgcacgaccggtgctcgatttagtgtagtgtgaagggccgattcaccatctccagagacaattccaaaagatgttatatctgcaaatgaacagcctgagacctgaggacacggctgtatattattgtgtgacggggactcaactctggggacccactttgacaagtggggccagggaaccccggtcatcgtctcctcagcctccaccaagggcccatcggtcttccccctggcaccctcctccaagagcacctctgggggcacagcggccctgggctgcctggtcaaggctacttcccgtgtctgatctgagcgggctggcaaggcgcatagnnnnnnnn

SEQ ID NO: 100045 - DNA, 353 bp, Homo sapiens
  misc_feature: GYAE6OF01AMPHM.5.20.B09.1.454.CMB.1.raw
  modified_base (347)..(353): a, c, t, g, unknown or other
  misc_feature (347)..(353): n is a, c, g, or t
tcagatcagacacgcacgaccggtgctcgatttagtgtagtgtgaagggccgattcaccatctccagagacaattccaaaagatgttatatctgcaaatgaacagcctgagacctgaggacacggctgtatattattgtgtgacggggactcaactctgggggacccactttgacaagtggggccagggaaccccggtcatcgtctcctcagcctccaccaagggcccatcggtcttccccctgaccaccctcctccaagagcacctctgggggcacagcggccctgggctgcctggtcaaggctacttcccgtgtctgatctgagcgggctggcaaggcgcatagnnnnnnn

SEQ ID NO: 100046 - DNA, 531 bp, Homo sapiens
  misc_feature: GYAE6OF01BJVSI.5.20.B09.1.454.CMB.1.raw
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagntcgggacaagtggtggtggctgcaatcgactacgtggggcctgggaaccctggtcaccgtctcctcacgcctccaccaacgggcccatccggtcttcccccgtggcccaccctccaccaacgacgccaccctcgtggggccacgacgccggccctggggctcgcctggtcaaggacctacttcccgtgtcg

SEQ ID NO: 100047 - DNA, 553 bp, Homo sapiens
  misc_feature: GYAE6OF01A5OK4.5.20.B09.1.454.CMB.1.raw
  modified_base (342)..(342): a, c, t, g, unknown or other
  misc_feature (342)..(342): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactcccctgtatctacaaatgaacagtctgagagttgaggacacggccttctattactgtgacaaaagntcgggacaagtggtaggtggctgcaatcgactacgtggggcctcgggaacccgtggtcaccgtctcctcacgcctccaccacggcccatccggtcttccccgtcggccacccctccctacccaacgacgccaccgtccgtcgggggccaccgacggccggcccgtcgggcctcggcccgtcggtcaacggacctaccttcccggtgttccg

SEQ ID NO: 100048 - DNA, 359 bp, Homo sapiens
  misc_feature: GYAE6OF01DJ7JU.5.20.B09.1.454.CMB.1.raw
  modified_base (350)..(359): a, c, t, g, unknown or other
  misc_feature (350)..(359): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctggggacccactttgacaagtggggccagggaacccggtcatcgtctcctcagcctccaccaagggcccatccggtcttcccccgtgaccaccctcctccaagacgccacctcgtgggggcacagcggccctgggctgcctggtcaaggctacttccgtgtctgatctgagcgggctggcaaggcgcatagnnnnnnnnnn

SEQ ID NO: 100049 - DNA, 556 bp, Homo sapiens
  misc_feature: GYAE6OF01CK04F.5.20.B09.1.454.CMB.1.raw
  modified_base (259)..(259): a, c, t, g, unknown or other
  misc_feature (259)..(259): n is a, c, g, or t
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattactggaatagtggtgacataggctatgcggactctgtgaagggccgcttcaccatctccaganacaacgccaagaactccctgtatctacaaatgaacagtctgagagttgaaggacacggccttctattactgtgacaaaagntacgggacgaagtgggtggtggctgacatcgactacgtgggcctgggaaccctggtcaccgtctcctcacgccctccaccgaacgggcccacgtccggtccttcccccgtcggcccacccctccctccaacgacgccacctccgtcggggccacgacggccggcccgtcgggcctcgcccgtcggtaccgaacggtcctaaccttcccgtcgttcg

SEQ ID NO: 100050 - DNA, 547 bp, Homo sapiens
  misc_feature: GYAE6OF01BIOT8.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgcaagaactccctgtatctacaaatgaacagtctgagagttgaggacacggccttctattactgtgacaaaagagtcgggacgaagtggtggtggctgcaatcgactacgtggggcctgggaaccctggtcaccgtctcctcacgcctccaccgaacgggcccactccggtcttcccccgtcggccacccgtccctccaacgacgccaccgtcgtcgggggtccacgacggccggcccgtgggctcgccgtcggtcgaacggtacctacgttcccgtgtccg

SEQ ID NO: 100051 - DNA, 351 bp, Homo sapiens
  misc_feature: GYAE6OF01DHBK2.5.20.B09.1.454.CMB.1.raw
  modified_base (347)..(351): a, c, t, g, unknown or other
  misc_feature (347)..(351): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctgggggacccactttgacaagtggggccagggaaccccggtcatcgtctcctcagcctccaccaagggcccatcggtcttccccctggcaccctcctccaagagcacctctgggggcacagcggccctgggctgcctggtcaaggactactcccgtgtctgatctgagcgggctggcaaggcgcatagnnnnn

SEQ ID NO: 100052 - DNA, 566 bp, Homo sapiens
  misc_feature: GYAE6OF01BJG6P.5.20.B09.1.454.CMB.1.raw
  modified_base (258)..(258): a, c, t, g, unknown or other
  misc_feature (258)..(258): n is a, c, g, or t
  modified_base (338)..(338): a, c, t, g, unknown or other
  misc_feature (338)..(338): n is a, c, g, or t
  modified_base (463)..(463): a, c, t, g, unknown or other
  misc_feature (463)..(463): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccagggaaggcctggagtgggtctcaggtattacttggaatagtggtgacataggctatgcggactctgtgaagggccgcttcaccatctccaganacaacgccaagaacctccctgtatctaacaaatgaacagtctgagagttgaggacacgcttctattactgtgacaaaagngtacgggaacgtaaggtgggtggtggctgcaagtcgactacgtgggcctagggaaccctggtcaccgtctcctcacgcctcccaccgaacgggccctacgtccggtccttcccccgtcggtcccncccctccctccaacgacgccaccgtcgtcggggccaccgacggccggccccgtgggtcctcgcccgtcggtacgaacggtacctacccgttcccggtgttccg

SEQ ID NO: 100053 - DNA, 352 bp, Homo sapiens
  misc_feature: GYAE6OF01C002G.5.20.B09.1.454.CMB.1.raw
  modified_base (345)..(352): a, c, t, g, unknown or other
  misc_feature (345)..(352): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacgggggactcaactctgggggacccactttgacaagtggggccagggaaccccggtcatcgtctcctcagcctccaccaagggccatcggtctccccctgcaccctcctccaagagcacctctgggggcacagcggccctgggctgcctggtcaaggctacttcccgtgtctgatctgagcgggctggcaaggcgcatagnnnnnnnn

SEQ ID NO: 100054 - DNA, 588 bp, Homo sapiens
  misc_feature: GYAE6OF01EN9K3.5.20.B09.1.454.CMB.1.raw
  modified_base (337)..(337): a, c, t, g, unknown or other
  misc_feature (337)..(337): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaggcctggagtgggtctcaggtattacttggaatagtggtgacataggctatgcggactctgtgaagggccgcttcaccatctccagagacaacgcaagaactccctgtatctacaaatgaacagtctgagagttgaggacacggccttctattactgtgacaaaagntcgggacgaaggtggtggtggctgcaatcgactacgtggggcctgggaaccctggtccaccgtctcctcacgcctccaccaacgggcccactccggtccttcccccgtggcccaccctcccttcccaacgcgacccaccttcgtacggggggtccaaccgacgggcccggccccggttacggggcccgttggccccgttacgggttcccaaacggggtacccttacccggtttccccgggtggttacccgg

SEQ ID NO: 100055 - DNA, 544 bp, Homo sapiens
  misc_feature: GYAE6OF01A9GCA.5.20.B09.1.454.CMB.1.raw
  modified_base (340)..(340): a, c, t, g, unknown or other
  misc_feature (340)..(340): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagntcgggaacaaggtggtggtggctgcaatcgactacgtgggcctgggaaccctggtcaccgtctcctcacgccctccaccaacgggcccactccggtccttcccctggccaccctcctccaacgacncncctcgtcggggccacgacgccggccctggggcctcggcccgtgggtaccaacggaccttaccgttccccgtgtccg

SEQ ID NO: 100056 - DNA, 576 bp, Homo sapiens
  misc_feature: GYAE6OF01DHACR.5.20.B09.1.454.CMB.1.raw
  modified_base (344)..(344): a, c, t, g, unknown or other
  misc_feature (344)..(344): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccaggggaaggcctggagtgggtctcaggtattacttggaatagtggtgacataggctatgcggactctgtgaagggccgcttcaccatctccagagacaacgccaagaactccctgtatctaacaaatgaacagtctgagtagttgaggacacggtccttctattactgtgacaaaagntcgggaacgaaggtggtggtggctgctaatcgactacgtcgggcctgggaaccctggtccaccgtctcctcacgccctccaccgaacgggcccacgtccggtcccttcccccgtggaccctacccctccctaccgaacgacgcctaccgtccggtcggggccacgacggccggtcccgtgggccctcgtcccgtacgggtacaacggtacccttaccgttcccgtgttaccg

SEQ ID NO: 100057 - DNA, 545 bp, Homo sapiens
  misc_feature: GYAE6OF01DNNSZ.5.20.B09.1.454.CMB.1.raw
  modified_base (344)..(344): a, c, t, g, unknown or other
  misc_feature (344)..(344): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaaagaactccctgtatctaacaaatgaacagtctgagagttgaggacaacggccttctattactgtgacaaaaagntcgggacgaagtggtggtggctgcaatcgactactggggcctgggaaccctggtcaccgtctcctcagcctccaccaacgggcccatccggtcttccccctggccacccctcctccaacgacgcacctccgtgggggccacgaggccggcccctggggcctggccctggtccaaaggtaccttaacttcccggtgttcccg

SEQ ID NO: 100058 - DNA, 354 bp, Homo sapiens
  misc_feature: GYAE6OF01AEGPF.5.20.B09.1.454.CMB.1.raw
  modified_base (348)..(354): a, c, t, g, unknown or other
  misc_feature (348)..(354): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacgggggactcaactctgggggacccactttgacaagtggggccagggaaccccggtcatcgtctcctcagcctccaccaagggcccatcggtcttccccctgacaccctcctccaagagcacctctgggggcacagcggccctgggctgcctggtcaaggctacttcccgtgtctgatctgagcgggctggcaaggcgcatagnnnnnnn

SEQ ID NO: 100059 - DNA, 350 bp, Homo sapiens
  misc_feature: GYAE6OF01DE73U.5.20.B09.1.454.CMB.1.raw
  modified_base (347)..(350): a, c, t, g, unknown or other
  misc_feature (347)..(350): n is a, c, g, or t
tcagatcagacacgcacgaccggtgctcgatttagtgtagtgtgaagggccgattcaccatctccagagacaattccaaaagatgttatatctgcaaatgaacagcctgagacctgaggacacggctgtatattattgtgtgacggggactcaactctggggacccactttgacaagtggggccagggaaccccggtcatcgtctcctcagcctccaccaagggcccatcggtcttccccctggccaccctcctccaagagccacctctggggcacagcggccctgggctgcctggtcaaggctacttcccgtgtcctgatctgagcgggctggcaaggcgcatagnnnn

SEQ ID NO: 100060 - DNA, 649 bp, Homo sapiens
  misc_feature: GYAE6OF01ACJF6.5.20.B09.1.454.CMB.1.raw
  modified_base (329)..(329): a, c, t, g, unknown or other
  misc_feature (329)..(329): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccggcaagctccgagggaaggcctggagtgggtctcgaggtattacttggaatagtggtgacataggctatgcggactcgtggtgaagggccgcttcaccatctccagagacaacgccaagaacctcctgtatctaacaaatgaacagtctgagagttgaggacacggtccttntattactgtagacaaaagagtacgggaacgaaggtgggtggtggctggactaacgtcgaacgttacggtcgggggtaccctacggggaaccccttcgggtcctacccggttcctcccgttccgacgtcccctacccgaacccgaaccgggcccctaacgttcccggttcccttccccccgtcggaccctacccccgtccctacccgaagaccgcctacccgtcggtcgggggcccaacggacgggcccgggtcccgtcggggccttccggtacccgttcgggtaccgaacgggtaccgttacccgtttcccggtgttccg

SEQ ID NO: 100061 - DNA, 524 bp, Homo sapiens
  misc_feature: GYAE6OF01CBBPK.5.20.B09.1.454.CMB.1.raw
  modified_base (336)..(336): a, c, t, g, unknown or other
  misc_feature (336)..(336): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccagggaagggcctggagtgggtctcaggtattacttggaatagtggtgacataggctatgcggactctgtgaagggccgcttcaccatctccagagacaacgccaagactccctgtatctacaatgaacagtctgagagttgaggacacggccttcattactgtgacaaaagntcgggacgaagtggtggtggctgcaagtcgactacgtgggcctgggaaccctggtcaccgtctcctcacgcctccaccagggcccagtccgtcctcccctggccaccctcctccaagcgccacctcgtggggccacgacgccggcccgtgggcctgccctcggtcaaggtacctcgttcccgtgtccg

SEQ ID NO: 100062 - DNA, 745 bp, Homo sapiens
  misc_feature: GYAE6OF01EADKS.5.20.B09.1.454.CMB.1.raw
tcagatcagacacgcacgaccggtgctcgatttagtgtagtgtgaagtgcagctggtggagtctggggaggcttggtacagcctggcaggtccctgagactctcctgtgcagcctctggattcacctttgatgattatgccatgcactgggtccgcaagctccgaggggaagggcctggagtggtctcgaggtattacttggaatagtggtgacataggctatgcgactcgtgtgaagggccgcttcaccatctccagagacaacgccaagacctccctagtatactaacaaatgaacagtctgagagttagacggacacggtccttactattactgtgacaaaagagtacgggaacgtaaggtgggtggtaggcgtgactaacgtcggaaccttacggtcgggggtacccttacgggggtaaaccccttgggtacccaaccggttccctaccccgttcgaaccggtcccctacccgaacccgtaaaccggggcccccctaacggttcccgggttacccctttcccccccgtacgggaccccctaacccccgttaccccttaccccgaaacgggaacccgtcccgaaccccgtttccggggacggggggacccaaacccggtaccggggccccgggtacccccggttgggggtacccccttccggggcccccgtttaacgggggtaccctaaaaccgggggttaccccctttaaccccggttttcccccgggttggttaccccgg

SEQ ID NO: 100063 - DNA, 554 bp, Homo sapiens
  misc_feature: GYAE6OF01DQ587.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccagggaaggcctggagtgggtctcaggtattacttggaatagtggtgacataggctatgcggactctgtgaagggccgcttcaccatctccagagacaacgccaagaactccctgtatctaacaaatgaacagtctgagagttgaaggacacggccttctattactgtgacaaaagatacgggacgaaagtggtggtggctgcaatcgactacgtgggcctgggaaccctggtccaccgtctcctcagcctccaccaagggcccagtccgtcttcccccgtggccacccctcctaccaagacgccacctcgtcgggggccacgacggccggaccctgggcctcggcccgttgggtccaaacgggtaccttaccgttccccggtgttacccg

SEQ ID NO: 100064 - DNA, 569 bp, Homo sapiens
  misc_feature: GYAE6OF01D8HRL.5.20.B09.1.454.CMB.1.raw
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccgcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagntcgggacgaagtggtggtggctgcaatcgactacgtgggccgtgggaaccctggtcaccgtctcctcacgcctccaccaacgggcccacgtccggttccttccccccgtcggcccaccccttccctcccaacgacgccaccctcgtcgggggcaccgacggccggcccgtcggggcctcggcccgttcgggtaccaaacgggtaccttaccgtttcccggtgttacccg

SEQ ID NO: 100065 - DNA, 559 bp, Homo sapiens
  misc_feature: GYAE6OF01CZCGM.5.20.B09.1.454.CMB.1.raw
  modified_base (233)..(233): a, c, t, g, unknown or other
  misc_feature (233)..(233): n is a, c, g, or t
  modified_base (343)..(343): a, c, t, g, unknown or other
  misc_feature (343)..(343): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccaggggaagggcctggagtgggtctcaggtattactggaatagtggtgacataggctatgcggactcngtgaagggccgcttcaccatctccagagacaacgccaagaactccctgtatctaacaaatgaacagtctgagagttgaggacacggccttctattactgtagacaaaagntacgggacgaagtggtggtgctgacaatcgactacgtggggcctgggaaccctggtccaaccgtcctcctcacgccctccaccgaacgggcccatccggtccttcccccgtggcccaccctcctaccaacgcgccacctcggtcggggccacgacggccgggtccctggggcctcggccgtcgggtacaaacggtccttaccgttcccgttgtccg

SEQ ID NO: 100066 - DNA, 583 bp, Homo sapiens
  misc_feature: GYAE6OF01AGGMV.5.20.B09.1.454.CMB.1.raw
  modified_base (213)..(213): a, c, t, g, unknown or other
  misc_feature (213)..(213): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaaggcctggaggtgggtctcgaggtattacttggaatagtggtnacataggctagtgcggactctgtgaacgggccgcttcgaccatctccagagacaacgccaagactcctgtactcacaatgaacngtcngagagttgagacacggcttntattactgtagacaaagngtcgggaacgaggtggtgngtctgacaagtcgacgtacgtcgggcgtacgggtaccgtcggtacgtaccgtctccgtccacgtccctaccgaccgacggccctagtcccgtccttccccgtcgcccgtaccctccgtaccaacgtacacgtacccgtgtccgggacacgacggtcccgcccggttacgggcctcggcccgttacgggtaccgtaacggtacccttaccgttcccgtggttcccg

SEQ ID NO: 100067 - DNA, 582 bp, Homo sapiens
  misc_feature: GYAE6OF01D9S5G.5.20.B09.1.454.CMB.1.raw
  modified_base (254)..(254): a, c, t, g, unknown or other
  misc_feature (254)..(254): n is a, c, g, or t
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccgagggagggcctggagtgggtctcaggtattacttggaatagtggtgacataggctatgcggactcgtgtagaagggccgtctcacatcncagagacaacgcaagactcccttgtatctaacaaatgaacagtctgagagtgaggacacggtcttctattactgtagaacaaaagngtacgggaacgtaggtggtggtaggctggacgtaagtcgtacgtacggtcgggccgtacggtaccgtcggtcgtaccgtcctcctcacgtcctaccaccgacggaccctacgtccgttccgttccccgtcgccctacccgtcctaccacgacgccgtaccgtcgcgggtacgacgacggccggtcccgtcggtccgtcggccgtacggtacgaacggtaccgttaccgttccgtcgttaccg

SEQ ID NO: 100068 - DNA, 637 bp, Homo sapiens
  misc_feature: GYAE6OF01CLJHW.5.20.B09.1.454.CMB.1.raw
  modified_base (256)..(256): a, c, t, g, unknown or other
  misc_feature (256)..(256): n is a, c, g, or t
tcagatcagacacgcacgaccggtgctcgatttagtgtagtgtgaagtgcagctggtggagtctggggggaggcttggtacagcctggcaggtccatgagactctcctgtgcagcctctggattcacctttgatgattatgccatgcacgtgggtccgcaagctccgagggaaggcctggagtgggtctcgaggtattacgttggaataggtggtgacataggctatgcggactctggtgaaggccgtcttcaccntctccagacgacaacgccaagactccctagtactactacaaatgaacagtctgagtagttgaggacaccggtcttactattactgtagaacaaaaggtagtacggggaacgtaaggttcgggttagggtgggccttaggactaacgtccggtaaccgttacggtacgggggacccgtacggggtaaccccgttcgggtaccgtaacccgttcctcccgtaccgacgtccccgtacccaacccgtaccgggccctacgtcccggttcccttcccccgtcggacccctacccttcctacccgacgacgccaccgtcggtacggggcacgacggccgcccggtcggccgtcgccgtcggtacgacggtaccttccgtcccgtcg

SEQ ID NO: 100069 - DNA, 595 bp, Homo sapiens
  misc_feature: GYAE6OF01ER7V9.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccaggggaagggcctggagtgggtctcgaggtattacttggaatagtggtgacataggctatgcggactctgtgaagggccgcttcaccatctccagagacaacgccaagaactccctgtatctacaaatgaacagtctgagtagttgaggacacggccttctattactgtgacaaaagagtcgggagaaggtggtggtgctgcaagtcgactacgtcgggccgtcgggaaccctggtaccaccgtctcccgtcacgccctaccaccgaacgggccccacgtccggtccttccccccgtcggccctacccctcccgtacccaacggaccgaccgacccgtcggtacgggggccaccgacgggcccggtccccgtggggccttcggcccgttcggtacgaaacgtaaccgttacccgttcccgtgttacccg

SEQ ID NO: 100070 - DNA, 642 bp, Homo sapiens
  misc_feature: GYAE6OF01DDAV1.5.20.B09.1.454.CMB.1.raw
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccaggggaggcctgggagtgggtctcaggtattactggaatagtggtgacagtaggctatgcggactctggtgaacgggccncttcaacctatcctccaagagaacaacgccaaagacctccctagtatctaacgaaatggaacagtctagagagttgaaggccacggtccttataattctgtacaacgaaaagntacgggagtaaggtggtgggtaggctggactaagtccggacttacggtcggggtaccgtcggggaaacccttggtacctaacccgttcgtcccttacgacgtcccttacccgaacccgtaacgggcccctaacgttccggttcccttacccccgtcggtacccctaccccgtttcccaaccgaaacgtcgaccctacccgtacgtcggggcctaacgcggtcccgggcccgtggggccctggaccctggtaccgaaacggtaccttaaccgtccccgtagttccg

SEQ ID NO: 100071 - DNA, 354 bp, Homo sapiens
  misc_feature: GYAE6OF01CG6K1.5.20.B09.1.454.CMB.1.raw
  modified_base (259)..(259): a, c, t, g, unknown or other
  misc_feature (259)..(259): n is a, c, g, or t
  modified_base (344)..(354): a, c, t, g, unknown or other
  misc_feature (344)..(354): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctggggacccactttgacaagtggggccagggaaccccggtcatcgtctcctcagcctccaccaagggcccatcggtcttcccctggcaccctcctccaagngcacctctgggggcacagcggccctgggctgcctggtcaaggctacttcccgtgtctgatctgagcggctggcaaggcgcatagnnnnnnnnnnn

SEQ ID NO: 100072 - DNA, 546 bp, Homo sapiens
  misc_feature: GYAE6OF01AP1ZX.5.20.B09.1.454.CMB.1.raw
  modified_base (343)..(343): a, c, t, g, unknown or other
  misc_feature (343)..(343): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (487)..(487): a, c, t, g, unknown or other
  misc_feature (487)..(487): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccgagggaagggcctggagtgggtctcaggtattacttggaatagtggtgacataggctatgcggactctgtgaagggccgcttcaccatctccagagacaacgccaagaactccctgtatctaacaaatgaacagtctgagagttgaggacacggtccttctattactgtgacaaaagntacgggacgaaggtgggtaggtggctgactaagtcgactacgtgggcctcgggaaccctggtcaccgtctccncncgcctccaccgacggcccacgtccgtccttccccgtggcccaccctcctaccaacgacgccaccgtcgngggccacgacgccggcccgtgggctcgccgtggtacaacggtacctaccttccgtgtcg

SEQ ID NO: 100073 - DNA, 575 bp, Homo sapiens
  misc_feature: GYAE6OF01A66M8.5.20.B09.1.454.CMB.1.raw
  modified_base (260)..(260): a, c, t, g, unknown or other
  misc_feature (260)..(260): n is a, c, g, or t
  modified_base (341)..(341): a, c, t, g, unknown or other
  misc_feature (341)..(341): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccaganacaacgccaaagaacctccctgtatctacaaatgaacagtctgagagttgaggacacggccttctattactgtgcaaaagntcgggacgaagtggtggtggctggcaatcgactacgtcggggccgtcgggaacccttggtccaccggtcctcctccagccctccacccgaacgggcccacgtccggtcccttccccctggcccacccctccctaccaacgacgccacccgtcgtcgggggccacgacggcccggcccgtcggggcctcggcccgtagggtccaacgggtacccttaccgttccccggtgttccg

SEQ ID NO: 100074 - DNA, 584 bp, Homo sapiens
  misc_feature: GYAE6OF01CDS7C.5.20.B09.1.454.CMB.1.raw
  modified_base (245)..(245): a, c, t, g, unknown or other
  misc_feature (245)..(245): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccaggggaagggcctggagtgggtctcaggtattacttggaatagtggtgacataggctatgcggactctgtgaagggccncttcaccatctccagagacaacgccaagaacctcctagtactctaacaaatgaacagtctgagagttgacggacaccggtcttctaattactgtagacaaaagagtacgggaacgaaggtggtggtggctgacaagtcgacgtacgtcgggccgtacgggaccctggtaccaccgtctcctcacgcctcccaccgaacggcccacgtccggtccttccccgtcggccctacccctccctacccaagacgaccgacctcggtacggggcctacgacggcccggaccgtcgggcctcggtccgtcggtacgaacggtaccttaccgttcccggtgttaccg

SEQ ID NO: 100075 - DNA, 586 bp, Homo sapiens
  misc_feature: GYAE6OF01AW9H8.5.20.B09.1.454.CMB.1.raw
  modified_base (350)..(350): a, c, t, g, unknown or other
  misc_feature (350)..(350): n is a, c, g, or t
  modified_base (481)..(481): a, c, t, g, unknown or other
  misc_feature (481)..(481): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccagggaaggcctggagtgggtctcaggtattacttggaatagtggtgacataggctatgcggactctgtgaagggccgcttcaccatctccagagacaacgccaagaactccctgtatactaacaaatcgaaacagtactgagtagttgaggacagtcggcctttactaattactgtagacaaaagngtacgggaagtaaggttggtagggtggctagctaagtcgactacgtgggcctgggaaccctggactaccgtctccgtcgagccctacaccgacggcccagtccggtcctccccgtcggacctacccctccnccgtaagaccgcctacccgtcgtcggggccacgacggacccggtccccgtgggtaccctcggcccgtagggtaccaaacgggtaccttacccgttcccgttacgg

SEQ ID NO: 100076 - DNA, 794 bp, Homo sapiens
  misc_feature: GYAE6OF01BPMOT.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtgggtccggcaagctccgagggaaggccgtggagtgggtctcgaggtattacttggaataggtggtgacagtaggctatggcggtactcgtggtaggaacggggccgtcttaccacctaacttccctaccgaaggaacgaaccgaaaccgaccaaaacggtaacccttccccgtagttaactacctaaactaaaatacgaaacgtagttcgtaggtaaggtaggttaggaacgggtaaccgtaccgggttacccttttacgttaacgtttaaccgttggtaacgtaaaccgtaaaaaaggtacggttaaccgggggaaaccggttaaaggggttcgggggttaggggtcgggtaccgttaggaacctaaacggttaccggttaaccgttaccggggttcgggggtaccccggttaccggggtaaaccccgttcgggtacccgtacccgttccgttcccctacgaccgtccctaaccccgaaccgaaccggggtcccctacggttccccgttcccgttcccccgtcggacccctaccccgttccctaccgaacgaccgacccgtaccgtcgggtcggggaccacggaccggccggtcccgtcggcctcggtccgtcggtacgacggtaccttcccgttccgtgtcg

SEQ ID NO: 100077 - DNA, 406 bp, Homo sapiens
  misc_feature: GYAE6OF01CSJZY.5.20.B09.1.454.CMB.1.raw
  modified_base (200)..(200): a, c, t, g, unknown or other
  misc_feature (200)..(200): n is a, c, g, or t
  modified_base (388)..(406): a, c, t, g, unknown or other
  misc_feature (388)..(406): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactcgtggggacccactttgacaagtggggccagggaaccccggtnatcgtctcctcacgcctccaccaagggcccatccggtcttccccctgaccacccctcctccaagacgccacctcgtcgggggccacgaggccggccgtgggctcgacctgggtacaaggtacctacgtttcccgtgtcctggactccgtggacgccggggtctacgggacgaagggccgacaagtagnnnnnnnnnnnnnnnnnnn

SEQ ID NO: 100078 - DNA, 646 bp, Homo sapiens
  misc_feature: GYAE6OF01BYJGM.5.20.B09.1.454.CMB.1.raw
  modified_base (344)..(344): a, c, t, g, unknown or other
  misc_feature (344)..(344): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaacgggccgcttcaccatctccagacgacaacgccaagaactccctgtatctaacaaatgaacagtctgagagttgaggacacggccttctattactgtagacaaaagngtacgggaacgaaggtggtggtggctgacaagtcgactacgtcggggcctcgggaaccctggtacaccgtctccctcagccctccaaccgaacgggccctagtcccggttcctttccccccgtggtcccctaccccgttccccgttacccggacgtaccgtccgtaaccccgtccgggtacggggggtccaaaccggacggcccggggtcccccggttacgggggtccccgttcgggtccccgttcggggtacccgtaaacggggtaacctttaaccccggtttccccggttcggtttaccg

SEQ ID NO: 100079 - DNA, 572 bp, Homo sapiens
  misc_feature: GYAE6OF01BG679.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagatacgggacgaaggtggtggtggctgcaagtcgactacgtggggcctcgggaaccctggtccaccgtctcctcacgccctccaccgaacgggcccacgtccgtccttcccccgtggccctacccctccctacccaacgacgccaccgtccgtcggggccaccgacggccggcccgtcgggcctcggcccgttcgggtaccgaacgggaccttaccgttccccggtgttcccg

SEQ ID NO: 100080 - DNA, 421 bp, Homo sapiens
  misc_feature: GYAE6OF01EXHYJ.5.20.B09.1.454.CMB.1.raw
  modified_base (409)..(421): a, c, t, g, unknown or other
  misc_feature (409)..(421): n is a, c, g, or t
tcagatcagacacgcacgaccggtgctcgatttagtgtagtgtgaagggccgattcaccatctccagagacaattaccaaaaagatgttatatctgcaaatgaacagcctgagacctgaggacacggctgtatattattgtgtggacgggactcaactcgtcgggggaccctactttgacaaggtggggccgacgggaaccccggtcatcgtcctcctcacgccctccaaccgaacgggcccagtccggtcccttcccccgtggcccacccctcctaccaagacgccacctcggtgggggccacgacggccggcccgtgggcctcggccgttgggtacaacggtaccttaccgttccccggtgttcctgacttcgtggacggcgggctcgggacaaggccgacagtagnnnnnnnnnnnnn

SEQ ID NO: 100081 - DNA, 835 bp, Homo sapiens
  misc_feature: GYAE6OF01CNY7J.5.20.B09.1.454.CMB.1.raw
  modified_base (160)..(160): a, c, t, g, unknown or other
  misc_feature (160)..(160): n is a, c, g, or t
tcagatcagacacgcacgaccggtgctcgatttagtgtagtgtgaagtgcagctggtggagtcgtgggggaggcttggtacagcctggcaggtccctgagactctcctgtgcagcctctggattcacctttgatgattatgccatgcacgtgggtccganaagctccgaggggaacggcctggagtgggtctcgaggtattacgtaggaatgtggtagacagtaggctagtggcgtactcgtggtacggaacgggtccgtcttaccaacctatccgtaccgaagaacgaaccaaaccgaccaaacgtaaaccttcccgtagttaactacctaaacaaatcgaaacagtactaggagtagttaggaagaccgacggtccttattacgttacgtaggtacgaaacgaaaagtacggtaacgggtaacggtaaggttcggggttaggtacggtactacggtacaacgttacggtaaccgtacgggtacggggaccgttaaccgggtaaaccccgttggtaccccgtaccggtttacccgtcccgttaaccgacccggttaaccccgaccccgtaaacccggaacccgggtaccccttaacgttcccccgggtttcccctttacccccggtaccgggtcccctaacccccgttaccccgtaaccgaaacggtacccgtacccgttaacccggtccggggtaccggggaaccctaaccggtacccggggtacccgggtcccccgggttacgggtcccgttacccgggtaccccggttacgggttaacccggaaaccgggttaaccccgtttaacccgggttccccgggttagtacccggg

SEQ ID NO: 100082 - DNA, 557 bp, Homo sapiens
  misc_feature: GYAE6OF01CZ81U.5.20.B09.1.454.CMB.1.raw
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcaccttttgatgattatgccatgcactgggtccgcaagctccagggaaggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagntcgggacgaagtggtggtggctggcaatcgactacgtcggggcctgggaaccctggtcaccgtctcctcacgcctccaccaacgggcccacgtccggtccttcccccgtggccctacccctcctcccaacgacgcaaccctcgtcggggccacgaggtcggcccgtgggccgtcgcccgttcggtccgaaacggtaccttaccgttcccgtgttccg

SEQ ID NO: 100083 - DNA, 699 bp, Homo sapiens
  misc_feature: GYAE6OF01CRD8P.5.20.B09.1.454.CMB.1.raw
  modified_base (355)..(355): a, c, t, g, unknown or other
  misc_feature (355)..(355): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccggcaagctccgaggggaagggcctgggagtgggtctcgaggtattacgttggaatagtggtgacataggctatggcggtactcgtggtggaacggggccgcttaccaccatctaccagaacgaacaacgaccaaagaacctcccctagtaactactaacaaatagaacagtctgagtagttggaggacacggtccttntattacgtgtagacaaaagtagtacgggaacgtaaggtgggtggtggtacgtagaaactacgtacgtaccggtaggggtaccggtaccgggtaacccgtacgggtaccgtaccgtaccgttccctaccgacgtcccgtaacccgttaacccgaacgggacccccggtaccgttaccgggttccccgtttacccccggttcccggtacccggtaccccctacccccgttacccaaaccggacgtaccgtacccgtaccgtcggggtaccggaccacggtacccggcccggtcgggtcgtccgtccggtacgtacgtaacgtacgtacccttaccgtcggtctacg

SEQ ID NO: 100084 - DNA, 703 bp, Homo sapiens
  misc_feature: GYAE6OF01C5P6V.5.20.B09.1.454.CMB.1.raw
  modified_base (159)..(159): a, c, t, g, unknown or other
  misc_feature (159)..(159): n is a, c, g, or t
  modified_base (388)..(388): a, c, t, g, unknown or other
  misc_feature (388)..(388): n is a, c, g, or t
  modified_base (438)..(438): a, c, t, g, unknown or other
  misc_feature (438)..(438): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtcgggtccgnaagctccgaggggaggcctgggagtgggtctcgagggttatttacgttagggaattaggtggtacgactagtaggtctaagtcggacggtaccttgtggtaggaaccgggcctcttcacctatcctccaagagaacaacgcaaacgacctcctagtactctaaacgaaatagaacagtctagagtagttagagaccgacgtccttatacttatgtacgaacaaaaggtntacggggaacgtaaggttggtacggttgcgtagactaagtcgactacggnggaccggtacggaacccgtggtaccaccggttctcccgtcgacgtcccgtacccgaaccgaccggtcccctacgttcccggttccccgttcccccgtacgggtcccctaacccccgttcccgttaacccgaacgtaccgacccgtaacccgtcgggttaccggggacccgaccgtaaccgggccccgggtcccggtcgggcccttaccggtcccgttcggtaaccggtaacgttacccggttacccgttcccggtcggtttaccg

SEQ ID NO: 100085 - DNA, 567 bp, Homo sapiens
  misc_feature: GYAE6OF01BXN9J.5.20.B09.1.454.CMB.1.raw
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
  modified_base (411)..(411): a, c, t, g, unknown or other
  misc_feature (411)..(411): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccggcaagctccagggaagggcctgggagtgggtctcaggtattacttggaatagtggtgacataggctatgcggactctgtgaagggccgcttcaccatctccagagacaacgccaagaactccctagtatactaanaaatgaacagtctgagagttgaggacacgcttctatctgtgacaaaagntcgggactaaggtggtggtgctgacaagtcgactacgtggggcctgggaaccctggtacaccgtctccncgacgtccctaccgaccgacggcctacgtccgtccttccccgaggccctaccctccctacgaacgcgacctaccgtcggtcggggaccacgcggcccggtcccgtcggggtctcggcccgttggtaccgaacggtacctaccgttcccggtgttcg

SEQ ID NO: 100086 - DNA, 731 bp, Homo sapiens
  misc_feature: GYAE6OF01D9RB2.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccgcaagctcgagggaggctggagtggtctgaggttattacgtggaataggtggtagactagtaggctagtcggcggtacttcgtggtacggaacgggccgtcttaccgaacctactcctaccgaaggaacgaaccaaaccgaccaaacgtaaccttccccgtagttactacctaaacaaattacgaaacgtacgtcgtaaggaacggtaggttaggaacggaccgtaccggttccttacttattacgtgtacgaacgaaaaggtcggtacgggaacggtaagggttgggtggtacggtcgttacgacgttaagttaccggtaacgttaccgggtcggggtaccgttacggggtaacccgttcgggtaccgtaccgttccgtacccgtcgtaccgtccctacccgaccggaaccggtcccgtacgttcccggttcccttccccggtccgtaccctaccccgttccctaaccgaacgtaccgaccgtacccgtcggtacgggcctacggccggtcccggtccgcgggtccgcggtccgtacggtacgtaacgtccgtttacccgttccggtgtaccg

SEQ ID NO: 100087 - DNA, 358 bp, Homo sapiens
  misc_feature: GYAE6OF01DY6VO.5.20.B09.1.454.CMB.1.raw
  modified_base (350)..(358): a, c, t, g, unknown or other
  misc_feature (350)..(358): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctgggggacccactttgacaagtggggccagggaaccccggtcatcgtctcctcagcctccaccaagggcccatcggtcttccccctgaccaccctcctccaagacgcacctcgtggggcacgacgcggccctgggctgcttggtcaggtactacttcccgtgtctgatctgagcggctggcaggcgcagtgnnnnnnnnn

SEQ ID NO: 100088 - DNA, 570 bp, Homo sapiens
  misc_feature: GYAE6OF01D7E2B.5.20.B09.1.454.CMB.1.raw
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccgaggggaagggcctggagtgggtctcgaggtattacttggaatagtggtgacataggctatgcggactctgtgaagggccgcttcaccatctccaganacaacgccaagactccctgtatcacaaatgaaacngtctgagtagttgagacacggtccttntattactgtagacaaaagagtcgggaagaaggtgggtgggtggctgcaagtcgactcgtcggggccgtgggaacccgtggtccaccgttctaccctcacgtccctccaaccgaccgggccctagtcccggtcccttcccccgtgacccctcccctcctaccaagacgccaacccgtcggtcggggccacgacggccggcccgtcgggctcgccgttcggcaacggtaccttcgtcccgtgtaccg

SEQ ID NO: 100089 - DNA, 586 bp, Homo sapiens
  misc_feature: GYAE6OF01A7R28.5.20.B09.1.454.CMB.1.raw
  modified_base (355)..(355): a, c, t, g, unknown or other
  misc_feature (355)..(355): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccggcaagctccgaggggaagggcctggagtgggtctcaggtattacttggaatagtggtgacataggctatgcggactcgtgtgaacgggccgcttcaccatctccagacgacaacgccaagaacctccctgtactctaacaaatgaactagtctgagagttgaggacacggtccttactattactgtagacgaaaagngtacgggacgtaaggtgggtggtggctgacaagtcgacgtacgtgggccgtcggtacccgtggtaccgaccgtctcctcacgcctccgaccgacggcccacgtccggtccttcccccgtcggtcccaccctccctaccgaacgaccgtccaccgtccggtcggggccacgacgccggcccgtcgggcctcggccgtcggtaccgaacggtaccctaccgttcccgtgtccg

SEQ ID NO: 100090 - DNA, 605 bp, Homo sapiens
  misc_feature: GYAE6OF01BGTID.5.20.B09.1.454.CMB.1.raw
  modified_base (244)..(244): a, c, t, g, unknown or other
  misc_feature (244)..(244): n is a, c, g, or t
  modified_base (343)..(343): a, c, t, g, unknown or other
  misc_feature (343)..(343): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccaggggaagggcctggagtgggctcaggtattacttggaatagtggtgacataggctatgcggactcgtgtgaagggccncttcaccatctccagagacaacgccaagaactccctgtatctacaaatgaacagtctgagagttgaggacacggtccttctattactgtagacaaaagngtcgggaacgaaggtggtggtggctgacaagtcgactacgtcgggccgtagggaccctggtccaccgtctcctcacgtcctcccgaaccgaacgggcccacgttccggttcccttcccccgtcggccctacccctcccgtacccaacgacgccctaacccgtccggtcgggggaccaccgtacggcccgggtccccggtcgggtcccgtcggcccgttacgggtaccgaacgggtaccttacccgttcccgttcggttcccg

SEQ ID NO: 100091 - DNA, 603 bp, Homo sapiens
  misc_feature: GYAE6OF01B8R61.5.20.B09.1.454.CMB.1.raw
tcagatcagacacgcacgaccggtgctcgatttagtgtagtgtgaagtgcagctggtggagtctggggaggcttggtacagcctggcaggtccctgagactctcctgtgcagcctctggattcacctttgatgattatgccatgcactgggtccggcaagctccgagggaagggcctggagtgggtctcaggtattacttggaatagtggtgacataggctatgcggactctgtgaagggccgcttcaccatctccagagacaacgccaagactcctgtatctacaatgaacagtctgagagttgaggacacggtccttatattaactgtgacaaaagagtcgggacgaagtgggtggtggctgacgaatcgacgtacgtggggcctcgggaccctggtccaccgtcctcctcgacgcctccgaccgaacggccccagtcccggtcccttcccccgtggccctaaccccgttcccgtacccaacgtaccgcctaacccggtcgtacgggggaccaccggaaccggccccgggtcccgtcggggccgttccggcccttcgggtaaccgaacggttacccgttacccgttccccggttgttcccg

SEQ ID NO: 100092 - DNA, 616 bp, Homo sapiens
  misc_feature: GYAE6OF01A4RYM.5.20.B09.1.454.CMB.1.raw
  modified_base (159)..(159): a, c, t, g, unknown or other
  misc_feature (159)..(159): n is a, c, g, or t
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (593)..(593): a, c, t, g, unknown or other
  misc_feature (593)..(593): n is a, c, g, or t
tcagatcagacacgcacgaccggtgctcgatttagtgtagtgtgaagtgcagctggtggagtcgtggggggaggcttggtacagcctggcaggtccctgagactctcctgtgcagcctctggattcactttgatgattatgccatgcacgtgggtccgnaagctacgagggacggctggagtggtactcgaggttattacgtaggaattggtgtagactagtaggctagtcggcggacttgtaggacggaacgggtcctcttacaccattccacaaggacaaccgaacgtaccaaacgtacctcctagtactactaaacaatacggaacagttcgtagaagtaggttagaacgggaaccnccgttctttacgtaacttacgtgaacgaanaaaaggtcggtaacgggtaaggtaaggtggggttggcggtcgtacgtaagtacggtacgtacgttgggtaaccgggtccgtaacggtacccgtgtaacctccggtcctcaccgtacgcccgtaccacggaccgccctaacgtccgtcccttaccgacgcccttaccgctacgacgtcncncgtcgcgcgcgcgcgcgcgcgcncgcgtacacgactctcgtcgtcg

SEQ ID NO: 100093 - DNA, 818 bp, Homo sapiens
  misc_feature: GYAE6OF01C9LQ7.5.20.B09.1.454.CMB.1.raw
  modified_base (432)..(432): a, c, t, g, unknown or other
  misc_feature (432)..(432): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtggggtccggcaagcctccgaggggagggcctgggagtgggtctcgaggttattacgttggaataggtggtagacagtaggctaagtggcggtactcgtggtaggaacggggccgtacttccaaccctatcctaccgaaggaacgaaccaaaccggaccaaaacgtaaccctccccgttagtaactacctaaacaaaagtacgaaactagtctaggaagtagttaggaacgaccgaaccggttcctttattaactttacgtagttacgaaacgtaaaacggnggttaccggggaacgtaaggttggggtaggtggtactgaactaagtccgtacgttaccggtcggggtacccgtacgggtaacccgtggtaccgtacccgtctccctcgacgtccctacccgaaccgaaccggcccctacggttcccgttccccgttacccccgtcgggtaccccctacccccgttacccgaaccgtaacggaccgtaccccgtaacccggtccgggtaccgggggacccaaccggggtaaccgggcccccggggttaccccggttccgggggtcccgttacccggggttaccccggttaccgggggttaaccccggttaaaaccgggtttaccccgttttaccccgggtttttccccgggttgggtttaaccccgg

SEQ ID NO: 100094 - DNA, 384 bp, Homo sapiens
  misc_feature: GYAE6OF01ADN80.5.20.B09.1.454.CMB.1.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (363)..(384): a, c, t, g, unknown or other
  misc_feature (363)..(384): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctgggggacccactttgacaagtggggccagggaaccccggtcatcgtctcctcagcctccaccaagggcccatccggtccttccccctgaccacccctccctccaagacgccacctcgtcggggggccacacgcggccctcgggctcgcctggtcaaggctaccttcccgtgtctgatctgagcgggntggcgaaggcgnagagnnnnnnnnnnnnnnnnnnnnnn

SEQ ID NO: 100095 - DNA, 614 bp, Homo sapiens
  misc_feature: GYAE6OF01AV0NG.5.20.B09.1.454.CMB.1.raw
  modified_base (263)..(263): a, c, t, g, unknown or other
  misc_feature (263)..(263): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccgaggggaagggcctggagtgggtctcgaggtattacttggaatagtggtgacataggctatgcggactctgtgaagggccgcttcaccatctccaganacaacgccaagactccctgtactctaacaaatgaacagtctgagagttgaggacacggtcttctattactgtagacgaaaagagtcgggaacgaagtgggtggtggctgacaagtcgactacgtggggcctagggaaccctggtccaccggtctcctcacgtccctcccgaccgaaccggcccagtcccgggtaccctttcccccgtgggtacccctacccctccctacccgaacgtaccgccctaaccgtccggtcggggaccaaccggacggcccggtacccggtcgggccgttccggcccgttcgggtaccgaaacgggtacccttaccgttcccgggtgttacccgg

SEQ ID NO: 100096 - DNA, 885 bp, Homo sapiens
  misc_feature: GYAE6OF01EEGAE.5.20.B09.1.454.CMB.1.raw
  modified_base (214)..(214): a, c, t, g, unknown or other
  misc_feature (214)..(214): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccggcaagctccgagggaaggcctggagtgggtctcgaggtattactggaatagtggtnacataggctatggcggactcgtgtaggaacgggtccgtcttacgacctaacgttcctacccgaaggaacgaaccgaaaccggacccaaaacggtaacccttccccgttaggttaacttacctaaactaaaacgttacggaaacctagttaccgtaggaaggtaaggtttacggaaacgggaccgtaaccgggtcccttttacgtaaactttaccgtaggtaacgaaaccgtaaaaacggtacgttaccgggggaaaccgtaagggttggggttagggtacgggtacgtacggacctaaacgttaccggtaaccgttaccgggtccgggggtacccggttaccggggtaacccccggttcgggttacccgtaacccggttcctaccccgtacgtaccggtacccctacccgaacccggaacccgggtccctaaccggttcccgggttacccctttcccccccggtacggtaccccctacccccgttaccccgttaacccgaacggacccgtaccccgtaacccgttcgggtacccggggaacccaaccggaccggggtccccgggttaccccggttaccgggggtcccgttacccggtacccgggttaccgggtaaccggtaaacccggttaacccgtttaccccggttttccccgggtacggtttacccgg

SEQ ID NO: 100097 - DNA, 743 bp, Homo sapiens
  misc_feature: GYAE6OF01DP71M.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtgggtccggcaagctccgaggggaaggccgtggagtgggtctcgaggtattacttggaataggtggtgacagtaggctatggcgactctggtagacgggccgtcttcaaccatcctccaagacgaaccaacgaccaaagaacctccctagtactactaaacaaatagaacagtctagagtagttagaaggacctaccggtcctttactattacgtgtagaacaaaagtacgtacgggaacgtaaggttgggtggtggtctagactaacgtcgtaacgttaccgtcggggtaccgtacgggtaacccgttcggtaccgtaacccgttccttcccgtaccgacgtccccgtacccgaacccgtaaccggggtacccctaaccggttcccggttccccgttaccccccggtaccgggtacccccttaacccccgttccccgtaacccgaaaccggtaccgacccgtaacccgttaccgggtccgggggacccaccggaccgggtccccgggtacccggtccggggtccgttccggtcccggttaccgggtaccggtaaacgggtaccctttaacccggttccccggttggttacccg

SEQ ID NO: 100098 - DNA, 602 bp, Homo sapiens
  misc_feature: GYAE6OF01AF17L.5.20.B09.1.454.CMB.1.raw
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
tcagatcagacacgcacgaccggtgctcgatttagtgtagtgtgaagtgcagctggtggagtctgggggaggcttggtacagcctggcaggtcccctgagactctcctgtgcagcctctggattcaccttttgatgattatgccatgcactgggtccggcaagctccagggaagggcctgggagtgggtctcaggtattacttggaatagtggtgacatatgctatgcggactctgtgaagggccgcttcaccatctccagagacaacgccaaagaacctccctagtaatcctaacaaatcgaacagtactagagagttgaggacacggtccttctattacngtgaacaaaagngtacgggaacgaaggtggtaggtggctaggcaagtcgactacgtcgggccgtgggaccctggtccaccgtctcctcacgtcctaccaccgaacggcccacgtccgtccttcccccgtggccctaccccgtcctccgaacgcgcctaccgtccggtccggggacctaccggacggcccggtacccggtcggggccctccgggcccgttcgggtaccaaaccgggtacccttaaccgttcccggttacgg

SEQ ID NO: 100099 - DNA, 666 bp, Homo sapiens
  misc_feature: GYAE6OF01CURW1.5.20.B09.1.454.CMB.1.raw
  modified_base (158)..(158): a, c, t, g, unknown or other
  misc_feature (158)..(158): n is a, c, g, or t
  modified_base (235)..(235): a, c, t, g, unknown or other
  misc_feature (235)..(235): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggnaagctccgaagggaaggcctgggagtgggtctcaggtattactggaatagtggtgacataggctatgcggactctgngaggccgcttcacatctcagagacaacgccaaagactccctgtatctaacgaaatgaacagtctgagagttgaggacacggtcttctattctgtnacgaaaagngtacgggaacgaagtggtagggtggacgtgacgtaacgtcgaaccgttacggtcggggtcccgtacgggtaaccccgtggttaccaaccgttcctcctccgacgccccttacccgaaccgaaccgggcccctaacgtcccggttccctttccccccgtcggaccccgtaacccccttcccgtaacccgtaacgaccgccgtacccgtaccggttccgggggacctaaccggaccgggccccgggtccccggttcgggggcccttccgggcccgttacgggtaaccgaaaccggttacccttaacccggttcccggttccgttaccgg

SEQ ID NO: 100100 - DNA, 651 bp, Homo sapiens
  misc_feature: GYAE6OF01DGGO7.5.20.B09.1.454.CMB.1.raw
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtgggtccggcaagctccgaggggagggcctggagtgggtctcgaggtattactggaatagtggtgacagtaggctagtgcggactcgtggtgaacgggccgcttcaccatctaccagaacgacaacgaccaaagaacctccctagtactctaacaaatgaacagtctagagtagttgagacacggtccttntaattcgtgtagaacaaaagngtacgggaagaaggtgggnggtggcgtgactaagtcgacgtacggtcgggtaccgtacgggtaacccgtggtccgtaccgttcctccctacgaccgtccctacccgaaccgaccgggtcccctaacgttcccggttaccctcccccgtcggacccctaccccgtccctaccgaacgaccgtaccgtacccgtcgggtcggggacccacgacccgggtcccggacccggtcgggtccgtccggtaccggtccggtacgaacggttacccttacccgttccggtcgttaccg

SEQ ID NO: 100101 - DNA, 1013 bp, Homo sapiens
  misc_feature: GYAE6OF01C3UWJ.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtcggggtccggcaagcctccgaaggggacgggccgtggaggtgggtctcgaggttattacgttaggaataggtggtagactagtaggctagtggcggtactcgtggtaggaacggggccgtcttccaacctactcctaccgaagaacgaaccgaaaccggacccaaaacggtaaccccttccccgttagtaaccttacctaaactaaaagtacgaaactaggttacgtaggaaggtaggtttacggaacgggtaccgtaaccgggttcccttttacgttaacgtttaccgttaggtaacggaaacgtaaaaacggtacggttaaccgggggaaacgggttaaacggggttgggggttacgggggtacgggtaccgttacggtaaccgtaaacggttacccgggtaaccggttaccggggttccggggggtaccccggttaaccgggggttaaacccccgttcggggttaccccgtaaccccggtttccccgttaccccgttacccgaacccggtaccccccgttaacccccggaaccccgggtaaaccccgggggtaccccccttaacccgggtttcccccgggtttaccccccgtttcccccccggtaccgggtaccccccgttacccccccgttaccccgtaacccccggaaacgggtaaccccggtaccccggtaaccccggtttcccgggggtaccggggggtaccccaacccgggtacccggggtcccccggggttacccccgggttacgggggtccccgttcccggggtaccccggtttacccggggttaaacccggttaaacccggggtttaaccccgttttaccccgggttttcccccgggttcggtttacccgg

SEQ ID NO: 100102 - DNA, 771 bp, Homo sapiens
  misc_feature: GYAE6OF01ANIG9.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccggcaagctccgaggggacggcctggagtgggtctcgaggttattacgttggaataggtggtgactagtaggctagtcggccggtactcgtggtggaacggggccgtcttcaccatcctccgagacgacaacgccaagaacctccctagtactctaacaatcgaacgagtctagagagttggaggaccacggtcttactagttaccgtgtacgaacgaaaagtcgtacggggaacgtaaggtgggttacgggtggtacgtaggactaacgtaccggtaaccgttacggtaccgggggaccgttaccggggtaaccccgttacgggttacccgtacccggttcccttaccccgtccgtaccgtaccccttaccccgaacccggtaacccgggacccctaccggttacccggttaccccctttcccccggtaccggtacccctacccccgttaccccgtacccgaaccgacccgtaccgtaccccgtcggttacgggggaccctaaccggaccgggtcccgggtaccccggttcggggtcccgtaccggtcccgggttacgggtaacccggtaacgggtaaccctttccccgggttacccggttcgtttaacccggg

SEQ ID NO: 100103 - DNA, 872 bp, Homo sapiens
  misc_feature: GYAE6OF01A1AOB.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccgcaagcctccgagggaggcctggagtgggtctcgaggttattacgttggaatagtggtagacgtagtaggctatcggcggtacttcgtaggtggaacggggcccgtcttaccgaaccctacgttccgtacccgaaggaacgaaccgaaaccggtaccaaaacggtaacccttcccccgttagttaacttaccgtaaactaaaagtcggaaaacctacggttaccgttagggaacggttaggtttacggaagggtaacccgtaaccggggttacccttttacgttaacgtttaaccgttggtaacgaaacgtaaaaacggtacggtaaccgggggtaacgtaaacggggtttgggggttagggtacgggtccgttacgacgtaaacgttccggtaaccgttacgggttcgggggtacccggttacggggtaacccgttccgggttaccgtacccggttccgttcccgtaccgtacgtccccgtacccgtaaccgtaacccgggtacccgtacgttccccggttaccctttcccccggtcggtacccctccccgttaccctaccgaacggtaccgacccgtacccggttccgggaccggggtccaacccgggtaccgggtcccgggtccccgggttacgggtccccgttcgggtaccccggttcgggtaacccgtaaacgggttacccgttaccccgtttcccggttcggttacccg

SEQ ID NO: 100104 - DNA, 769 bp, Homo sapiens
  misc_feature: GYAE6OF01C0G2F.5.20.B09.1.454.CMB.1.raw
  modified_base (164)..(164): a, c, t, g, unknown or other
  misc_feature (164)..(164): n is a, c, g, or t
  modified_base (226)..(226): a, c, t, g, unknown or other
  misc_feature (226)..(226): n is a, c, g, or t
tcagatcagacacgcacgaccggtgctcgatttagtgtagtgtgaagtgcagctggtggagtcgtggggggaggcttggtacagcctggcaggtccctgagactctcctgtgcagcctctggattcctacctttgatgattatgccatgcacgtcgggtccganaagctacgaggggaaggccgtggagtcgggtctacgtaggttattacgtaggaatagtggtnactagtagctagtgacgtactcgtaggtaggaacgggcctcttaccaacctacgtcctacgaagaacgaaccaaccgaccaaacggtaacccttcccgtagttaactacctaaacgtaaagtacgaaacgtagtacgtaggtaaggtaaggttacggaacggtacctaccgggttaccctttacgttaactttaaccggtagttaacgaaaccgtaaaaggtcgtaacggggaaacgtagggttcgggtgggtacgtcgtagaacgtaacgtccggtaacgttacggggtccgggaccgttacggggaacccttgggtcccttaccggtcctacctcgacccggttcccaaaccgaaccgacccgggtaccctacgtcccgttacccttccccgtacggtaccctaccctcccgtacaacgccgtacccgaccggtcgggaccgggacctaccggaaccgggtcccgggtcccgtcgggtcctacggtccccggttaggtaaacccgtaaaccggtcctttaacccggtcccggttgtaaccg

SEQ ID NO: 100105 - DNA, 382 bp, Homo sapiens
  misc_feature: GYAE6OF01B1MIS.5.20.B09.1.454.CMB.1.raw
  modified_base (371)..(382): a, c, t, g, unknown or other
  misc_feature (371)..(382): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactcgtgggggacccactttgacaagtggggccagggaaccccggtcatcgtcctcctcagcctccaccaagggcccagtccggtccttccccctgacccacccctccctaccaagacgccaccgtcgtcgggggccacgacgccggccctggggctcgcctggtaccaaggctaccttccgtgtctgatcgtgagcgggctggacaggcgcatagnnnnnnnnnnnn

SEQ ID NO: 100106 - DNA, 513 bp, Homo sapiens
  misc_feature: GYAE6OF01COIUQ.5.20.B09.1.454.CMB.1.raw
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(513): a, c, t, g, unknown or other
  misc_feature (478)..(513): n is a, c, g, or t
tcagatcagacacgcacgaccggtgctcgatttagtgtagtgtgaagggccgattcaccatctccagagacaattaccaaaaagatgttatatctgacaaatgaaacagcctgagacctgaggacacggctgtatattattgtgtggacgggactcaacgtcggtcggggaccctactttgacgaggtcggggccgaacgggaccccggtcagtccgtctcctcgacgccctaccaccgaacgggcccagttccggttcccttcccccgtacgaccctacccctccctaccaaaggacgaccctaccgtcgggtacgggggccacggacggcccgggtcccgtcggggtcctcggtccgttacgggtaccgaaacgggttaccctttaccgtttccccggttagtccgttacgtacgttccggtaggacgggtccgggtacgtacggggaaccgaacggggcctacgtagtagngngnnnnnnnnnnnnnnnnnnnnnnnnnnnnnnnnnnnn

SEQ ID NO: 100107 - DNA, 900 bp, Homo sapiens
  misc_feature: GYAE6OF01DA7G8.5.20.B09.1.454.CMB.1.raw
tcagatcagacacgcacgaccggtgctcgatttagtgtagtgtgaagtgcagctggtggagtcgtggggggagcttggtacagcctggcacggtccctgagactcgtcctgtgcagcctctggattccacctttgatgtattatcgcctagtcgctacgttcggggtccggactaacgcctaccggaaggggaacgggtccgtagggtaggtcgggttctacgtaaggttactttacgttaggaagttaggtggttagaactaaggtacggcttaagtcggtacggtaccgttgtaggtaacggtaccgggtcctaccgtttaccgaaccctaacgttccgtaccgaaaggtaaaccgaaccgtaaaaccggacccctaaaaaccggtaacccctttccccgttaaggttaaacctaccttaaaaacgaagttaccgaaacgttacgtacgtagaacgggttaggttaggaaccggtaacgtccggtttacccttaggttaactttaccggtagtaagtaaaaccgaaaaggttcggtaacggggtaacgttaaggggttcgggtaggtcgtaacgttagaaccgtaacgggttaccgtaacggttcccgggttaccgggtacccgggttacggtaaccccggttcggtaacccgttaacccggttaccctcccgttacgaaccgtcccccgtaacccgtaaccccgggaccgtcccgtaccggtttcccgttacccgttaccccgtcccggtacccctacccgtacccgtaacggtacgtacccgtaccgtaccggttaccgggtcccggaccaccgtcggggtacccgcccggttacggcccgttaccggtccgtacggtaccgtaaacggttccctttaacccggttcgttgtaccg

SEQ ID NO: 100108 - DNA, 1049 bp, Homo sapiens
  misc_feature: GYAE6OF01BAPO4.5.20.B09.1.454.CMB.1.raw
tcagatcagacacgcacgaccggtgctcgatttagtgtagtgtgaagtgcagctggtggagtctgggggaggcttggtacagcctggcaggtcccctgagactctcctgtgcagcctctggattcacctttgatgattatgccatgcacgtgggtccggcaagctccgagggaaggcctggagtgggtctgaggttacttacgttggaactagtggtgactagtaggtctagtcggccggtacttcgtggtacgaacgggtcccgtacctttccgaccaattccctacccgaaggaacgtaaccaaaccggacccgaaacgtaacccttccccgtagttaactacctaaaccaaaacgtcgaaaccgtaggttcgtacggaaggtacggttagggaacggaccgtaccgggttaccctttacgttaagtttaccgttgggtaacgaaacgtaaaaacggtcggtaaccggggtaacggtaaacggttcggggtacgggttacggaccggtaccggtaaacgtacccgttacgggtaaacccgttacggggttacccgggggtaccccggttaacccgggggtaaacccccggtttacggggttaaccccgtaaccccgggtttcccttacccccggttcgtaaccccggtaccccctttacccccggaaaacccgggtaacccggggttacccccgtaaccggtttcccccggggttttaccccctttacccccccccgggttacggttaaccccccccgtttaacccccccgggtttcccccgtttaaacccccggaaaaccgggtacccggttaacccccggtaacccccggttttacccgggggtttaacccgggggggaccccgtaaaaacccggggtcccccgggggttacccccgggggtaccccccggggtttacccggggtaaccccgggttcccgggttaacccccggttttacccgggggttaaccccggtaaaacccggttttaccccccgggtttaaccccgtttttcccccccggggttacggttttaccccgggg

SEQ ID NO: 100109 - DNA, 745 bp, Homo sapiens
  misc_feature: GYAE6OF01C0BJC.5.20.B09.1.454.CMB.1.raw
  modified_base (161)..(161): a, c, t, g, unknown or other
  misc_feature (161)..(161): n is a, c, g, or t
  modified_base (409)..(409): a, c, t, g, unknown or other
  misc_feature (409)..(409): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattccacctttgatgattatgccatgcacgtgggtccganaagctcgaggggacggctggagtggtctgaggtattacgttggaatggtggtgacagtaggctatcggcggtacttcgtaggtaggacgggccgtctttccgaccactcctaccgaagacgaaccgaacgacccaaagaaccttcccctagttactacctaaacaaatagaaaccagtcgtaggagtagttaggaacggtaccgaccgggttcctttactaatttacgtggtaacgaacgtaaaaggngtaccgggaaagaggttggggaggtcggtacaggtactaagtaccggtaacgttacgggtcggggtccggttaacgggaacccgtgggtacctaccggttacctccctaccgccgtacccgttccaacccggaaccgggtcccctaacggttcccggtttccccttacccccgtggtaccccgtaacccccgttccctaaccgtaaccgacgtccctaacccggtcgggtccggggaccgaccggtaccgggcccggtcccggtcggggtcctccgggtaacccgttacgggtaacgaaaccgggttaccttcccggtttccggtcgttacccggg

SEQ ID NO: 100110 - DNA, 690 bp, Homo sapiens
  misc_feature: GYAE6OF01ELWJT.5.20.B09.1.454.CMB.1.raw
  modified_base (506)..(506): a, c, t, g, unknown or other
  misc_feature (506)..(506): n is a, c, g, or t
tcagatcagacacgcacgaccggtgctcgatttagtgtagtgtgaagtgcagctggtggagtcgtggggggaggcttggtacagcctggcaggtccctgagactctcctgtgcagcctctggattcacctttgatgattatgccatgcacgtggggtccggcaagctaccgaggggaagggcctgggaggtgggtctcgaggttattacgttggaataggtggtagaacagttaggcttagtggccggtactcgtggtaggaacggggcctacttccaccatcctaccgagacaaccaaccgtaccaaagaacctccctagtaactactaacaaaagtcgaaactagtcgtagagtagttggaaggtaccacggttccttactaattacgtgtagaaacaaaaggtacgtacggggaagtaaggtggggtaggtggtactggaactaacgtcgtaacgtacggtcgggccgtacgggtaacccgttggtaccgtaccgtctacccncgacgtccctaccgaaccgaccggtccctacgttcccggttcccttcccccgtacggacccctaccccgtacctaccgaacgacgccgtacccgtcgggtaccgggaccaccgacgggtcccggtcccggtcgggcctacggtccgtacggtaaccgaacggtaccttacccgttccgtcgtcg

SEQ ID NO: 100111 - DNA, 849 bp, Homo sapiens
  misc_feature: GYAE6OF01D9P4H.5.20.B09.1.454.CMB.1.raw
  modified_base (797)..(797): a, c, t, g, unknown or other
  misc_feature (797)..(797): n is a, c, g, or t
tcagatcagacacgcacgaccggtgctcgatttagtgtagtgtgaagtgcagctggtggagtcgtggggggaggcttggtacagcctggcaggtccctgagactctcctgtgcacgcctctggatttctacctttgatgtattatgccagtgccacgtcgggtaccggacaagcctaccgaaggggaacggccgtggaggtgggtctacgtaaggttaagtttacgtaggtaataggtggtacgaacgtagtacggtactagtcgcgtacttcgtggtaggacgggtcccgtcttaccgaacctacttcctaccgaacgaacgaaccgaaccgtaaccaaacgtaacccttccccgttagttaacctaccgtaaaccgtaaaagtacgaaaccgttacgtacgtaggacggtaaggttaggaaacggcccgtaaccggttccctttacttaacgtttacgtaggtaacgaaaccgaaaaggtacggtaacggggaacgtaaggggttcggggtaggggtcggtacgtacgtaacgtaaacgttaccgggtaaccgtacgggttcccggggtaccggtaaccgggtaaacccggttccggtacccgtaccccggttccctcccggtaaccgtacccgtaccccgtaacccgaacccgggtaacccgggcccttaaccccggttcccggttccccgttaccccggtacccgtaccccgtaccccgttacccaaccgaacggaccgtccctaccggtcgggtcgggtaccaccgggccggccccgtccgggtcggtcccnccggtcggtacggttaccgaaccggttaccctttacccgggtcgttggtacg

SEQ ID NO: 100112 - DNA, 922 bp, Homo sapiens
  misc_feature: GYAE6OF01BANWV.5.20.B09.1.454.CMB.1.raw
tcagatcagacacgcacgaccggtgctcgatttagtgtagtgtgaagtgcagctggtggagtcgtgggggaggcttggtacagcctggcaggtccctgagactctcctgtgcacgcctcgtggtattcctacctttgattgtatttagtcgacctagtgacctacggtcggggtccgacaacggtcctaccggaaggggtaacggccgttagggtacggttcgggtcctacgtaagggttaactttacggttagggtaaagttagggtgggtacgaacgtaagttacgggtccttaagtcgggtacggtacttcgtgggtaaggaaccgggtccgtaccttaccgacctacttacccgtaccgaaggaaccgaaccgaaccggaacctaaacgttaacccttccgtagttaactacctaaactaagtacgaactagtctaggtaagtagtacggaacgaccgtacggttcttacgttaactacgtagtaacgaaacgaaacggtacggtacggggaacgttaaggttggggtagggtcgtacgtacgtacgtaaacgttcggtaacggttaccggtaccggggtacccgtaaccggggtaacccgttcgggtaccccgtaccgttacccgtacccgttaccgacccgttacccaacccccggtaccgggtaacccggtcccttacccggttccccggttacccccgtttcccccggaaccggttacccccgttaacccccgttcccgtaaaccggaaccgtaccgtacccggtacccggttacgggtaccccggggaacctaacccggggtcccgggttccccgggtcccggtaccgggtcccgttaccgggtaccccgggttaaacggaaccgggttaaccccggttaaccgtttcccccgtttccggttacggttacccg

SEQ ID NO: 100113 - DNA, 674 bp, Homo sapiens
  misc_feature: GYAE6OF01D4UO5.5.20.B09.1.454.CMB.1.raw
  modified_base (211)..(211): a, c, t, g, unknown or other
  misc_feature (211)..(211): n is a, c, g, or t
  modified_base (477)..(478): a, c, t, g, unknown or other
  misc_feature (477)..(478): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
  modified_base (536)..(536): a, c, t, g, unknown or other
  misc_feature (536)..(536): n is a, c, g, or t
  modified_base (551)..(551): a, c, t, g, unknown or other
  misc_feature (551)..(551): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtggtgacgggactcaacgtcgtcggggaccctactttgaacgaaggtcggggccgaacgggtaaccccggtnacgttccgtccttccgtcaacggtccctacccgaaccgaaacgggccctaacgttccggttaccctttcccccgtggaccctacccctccgtaaccgaacggacgcctaaccgttcggtcgggggacctaacggacggcccggtacccgttcggggacctcggtaccgttacggtaacgaaacggttaccgttacgtttccccggtagtttcgacgtacgttcgtaggaccggcgggtactgggaccgacggcgactacgtaagcnngactgntcgacgngactcgatgacgtncgnagtcgntgacgtanacgtgtcgactcgngcgtagcgagacganacgtcgtacgtacgtagtacgtacgtacgtacgacgtacgtacgtacgtacgtacgtacgtagtacgtacgtacgtacgtacgtacgtacgtacgtacgtacgtacgtacgtacgtacgtacg

SEQ ID NO: 100114 - DNA, 901 bp, Homo sapiens
  misc_feature: GYAE6OF01EOFQO.5.20.B09.1.454.CMB.1.raw
  modified_base (140)..(140): a, c, t, g, unknown or other
  misc_feature (140)..(140): n is a, c, g, or t
  modified_base (848)..(848): a, c, t, g, unknown or other
  misc_feature (848)..(848): n is a, c, g, or t
tcagatcagacacgcacgaccggtgctcgatttagtgtagtgtgaagtgcagctggtggagtcgtggggggagcttggtacagcctggcaggtccctgagactctcctgtgcagcctctggattcacctttgatgattangccatcgctacgttcgggtccgacaagccgtaccgaaggggaacgggtccgtgggaggttcgggtactacgtaaggttactttaccgttaggaattaggtgggtagactagtacggtacttagtcggtaccggtacttcgtaggtacggaacggggccttaccgttaccgaaccttacttccgtaccgaaggaaccgaaaccgtaaaccgtacccgaaaaccggtacccctttaccccgttacggtttaaccttaaccgttaaaactaaaacgttacggtaaaacgttcggttaaccggtaggtaacggttacggttacggaaccgggttaacccggtaccccgggtttaccttttaacggtttaacgtttaaccggtttacggtaacggtaaaacgtaaaaacggttaccggggtaaccggggtaaacgggtaaggggttcgggggttacggggttacgtaacggttacggaaaccgttaacgggttaacccgggttaccggttacccggggtaccggggttaaccccgggtaacgggttaaccccgtttcgggtacccgtaccggttacccgtacccgtaccgtacgtcccctaccggaccggtacccgtccgtacgttacccgtcccgtacccgtaccgaccctacccgtacgtaccacgaccgtaccacgtcgggaccggccgacggtcccggccggtaccggnggtcccgtcgtaccgtacggtaccgtacgttacccgtccgttccggtcgtacg

SEQ ID NO: 100115 - DNA, 463 bp, Homo sapiens
  misc_feature: GYAE6OF01CTU28.5.20.B09.1.454.CMB.1.raw
  modified_base (201)..(201): a, c, t, g, unknown or other
  misc_feature (201)..(201): n is a, c, g, or t
  modified_base (416)..(419): a, c, t, g, unknown or other
  misc_feature (416)..(419): n is a, c, g, or t
  modified_base (421)..(463): a, c, t, g, unknown or other
  misc_feature (421)..(463): n is a, c, g, or t
tcagatcagacacgcacgaccggtgctcgatttagtgtagtgtgaagggccgattcaccatctccagagacaattccaaaaaagatgttatatctgcaaatgaacagcctgagacctgaggacacggctgtatattattgtgtgacggggactcaactcgtgggggacccatttgacaaggtgggccagggaaccccggtnatcgtctcctcacgcctccaccaagggcccatccggtccttcccccgtggccaccctcctaccaacgacgccaacccgtcggtcggggggaccacacggcccggacccgtggggcctcggcccgttggtaccgaacggtaccttacccgtttcccggtgttcctgacttcgtaggacggcgggtcgtcgggacgaacgggtccggactagtacgnnnngnnnnnnnnnnnnnnnnnnnnnnnnnnnnnnnnnnnnnnnnnnn

SEQ ID NO: 100116 - DNA, 881 bp, Homo sapiens
  misc_feature: GYAE6OF01BRPE9.5.20.B09.1.454.CMB.1.raw
  modified_base (184)..(184): a, c, t, g, unknown or other
  misc_feature (184)..(184): n is a, c, g, or t
  modified_base (350)..(350): a, c, t, g, unknown or other
  misc_feature (350)..(350): n is a, c, g, or t
tcagatcagacacgcacgaccggtgctcgatttagtgtagtgtgaagtgcagctggtggagtcgtgggggggaggtcttggtacagcctggcaggtccctgagactctccgtgtcgcacgcctcgtggtattcctaccttttgattgtattagtcgaccatgacctacggtcggggtcccgganaacgccgtaccggaagggggaacgggtccgtgggtaggtgggtctacgtagggttaattacgtggaacttagggtggtcgaactagtacggtctagtcgcggtactcgtgtaggacggcctctacgacactcacagacgaacaccgacaacgtactcctgtactanaacaagcgagatgtagtagtagtacggaacgacgtacgttccttattactacgtcgtacgaacgtaaagtcgtacgggtaaggtaggtacgggttggtaccggagtacggtaacctaacggtacccggtaaccggttaacggggtcccggggttaaccggttaacccccggggttacccgggttaccccggtttacccgtaaccccggggtttccctaccccggtacccgtaccccggtaacccccggtaccccgtaaaaccccggggtacccggtttacccccgttacccgggtttcccccgttaacccccggtcccccgggtttacccccaaccccggttaccccctaacccggttaacccgaacggtaccccgttacccgtaaccggggtttccggggacccgggtacccgtaacccggcccgggtccccgggttccggtacccggggtccgtacccggggtacccgttccgggtaaaaccggttacccgggttaccccttttccccgttacccggttcccttacggg

SEQ ID NO: 100117 - DNA, 736 bp, Homo sapiens
  misc_feature: GYAE6OF01BHMRC.5.20.B09.1.454.CMB.1.raw
  modified_base (160)..(160): a, c, t, g, unknown or other
  misc_feature (160)..(160): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtcgggtccggnaagctccgaggggacggctggagtgggtctcgaggttattacgttaggaattaggtgggtagactagtaggtctagtggccggtactcgtggtaggacggggccgtcgttaccacctatcctaccgaagaacgaccaaccgaccaaacgtacctccctagtacttactaacaaagtacgaactacgtactaggagtaggttaggaaggacctaccggtccttacttacttacgtagtacgaacgaaaagtggtaccgggaagtacggtggggtacggtggtcgtagacgtaacgtacggtaccgtacgggtaccgggccggttacgggacccggttcggtacctaccgtccctccgtaccgtaccgtacccgtaacccgtaacccggaaccggtcccttaccgttcccgttaccccgttcccccgtacggtccccctacccttcccgaaccgtaacgtaccgtacccgtacccggttccggtacggggacccacggccgggtccccgggtaccgttcgggcctccgggtaccgtacgggtaccgaacgggtacccgttacgttcccggtgttaccg

SEQ ID NO: 100118 - DNA, 864 bp, Homo sapiens
  misc_feature: GYAE6OF01CV0UJ.5.20.B09.1.454.CMB.1.raw
  modified_base (231)..(231): a, c, t, g, unknown or other
  misc_feature (231)..(231): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgtattatcgccatgcacgtcgggtaccggcaacgcctaccgaaggggaacgggctggaggtcgggtctacgaggttattacgttggaatagtggtanacagtaggtactagtcggacggtacttcgtaggtacgggaaccgggtccgtaccgtttacccaacctaacttacccgttaaccgaaggaaccgaaaccgaaacccgaaccgtaaaacgtaaccttacccgttagtaactaacctaaacaaacgtacgtaaactacggttactaagggtaggtaaggttacggaacggtaccgtaaccgggttccttttacgttaacgtttacggtaggttaacggaaacgtaaaacggtacgggtaacggggtaaaccggtaagggttcgggtagggtcgtacgtcgtaactaacgtaccgtacggttaaccgggtccggggtaccggttaccgggtaacccgtcggttacccgtacccgttcccttacccgaccgtaccgtacccgtacccggaaccggacccgggtaccctacccggttccccggttccccgtttcccccgtaccgtaccccctaacccgtccgtaaacccgacggtaccctaccgtacccggtcgggtaccgggaccaccggtaccgggtcccgggtccggttcggtaccggttcccggtaccggttacggtaacccggtaaccggttaccccgttaccgtttccccggttcgttaccgg

SEQ ID NO: 100119 - DNA, 713 bp, Homo sapiens
  misc_feature: GYAE6OF01ER7XS.5.20.B09.1.454.CMB.1.raw
  modified_base (159)..(159): a, c, t, g, unknown or other
  misc_feature (159)..(159): n is a, c, g, or t
  modified_base (399)..(399): a, c, t, g, unknown or other
  misc_feature (399)..(399): n is a, c, g, or t
  modified_base (578)..(578): a, c, t, g, unknown or other
  misc_feature (578)..(578): n is a, c, g, or t
tcagatcagacacgcacgaccggtgctcgatttagtgtagtgtgaagtgcagctggtggagtctgggggaggcttggtacagcctggcaggtccctgagactctcctgtcgcagcctctggattcacctttgatgattatgccatgcacgtgggtccgnaagctcgagggaggctggagtggtctctaggtattacgtggaataggtgtgacagtaggctagtcggcggtactctggtaggaacgggccgtcttaccacctataccttaccgaagaacgaaccgtaaccgaaccgtaaacgtaacctccccgttagtaactacttaaaccaaaaagttcgaaactagtacgtagaacggtagttaggaacgaccgtacggtcctttacctaattacgtntagaaacgtaaagcgtagggaacgtaaggttggtagggtcgagtcgaacgtaaacgtacggtacgtaacgggtacggggtacccgtaacggggtaacccgtcggtaccctacggtccctaccgtactccggtacccacccgaaaccggaacggccctacgtacccgtcccgtttccccncggtaccctccccgtaaccgtacccaacgtacgacccgtacggtccgggtacggcccagaccggtccggtacccgttcgggctccggtaccgtcgggtaacgtaacggtacccgttaccgtttcccgtgtaaccg

SEQ ID NO: 100120 - DNA, 782 bp, Homo sapiens
  misc_feature: GYAE6OF01D2IHT.5.20.B09.1.454.CMB.1.raw
  modified_base (315)..(315): a, c, t, g, unknown or other
  misc_feature (315)..(315): n is a, c, g, or t
tcagatcagacacgcacgaccggtgctcgatttagtgtagtgtgaagtgcagctggtggagtcgtggggggaggcttggtacagcctggcaggtccctgagactctcctgtgcagcctctggtattctacctttgatgtattatcgccatgctacgtcggggtacccggacaacgccgtaccggaaggggaacgggccgtggggtaggttcgggttctacgtaagggtttactttaacgttagggaaagttaggtgggtacgaactagtaggtacttagtcggccggtactcgtggtaggacggcctctcacctntccacagacaaccacgaccaagtacctcctagtactactaactaagacgaactcgtcgtaggaaggttagtacggaacggtaccgtaccggttcttttacttaagtttacgtacggtaacgaaacgtaaaagggtacggtaacggggtaaacggttagggtcggggttggtacggtcgttacgaacgtaacgtccggtaaccggttacgggtccgggtaccggtaccggtaaccccggttcggtaccctacccgttaccgtaccctcgacccgtccccgtaccgaacccgggtacccggtcccttaccgttcccgttccccgtccccgtccggacccctcccgtacctaaccgacgtacccgccgtaccggtacgggccgggaccacgggaccgggccccggtcggcggtcccgtccgtacggtaccggtaaccggaccgttacccgttcccggttccgtcgtacgg

SEQ ID NO: 100121 - DNA, 867 bp, Homo sapiens
  misc_feature: GYAE6OF01BS3U0.5.20.B09.1.454.CMB.1.raw
tcagatcagacacgcacgaccggtgctcgatttagtgtagtgtgaagtgcagctggtggagtctgggggagcttggtacagcctggcaggtccctgagactctcctgtgcagcctcgtggattctacctttgatgtattatgcctagtcgcctacggtcgggtaccgacaacgtccgtaccggaaggggaacgggtccgtagggtacggttcggggtcctacgtagggttaactttacggtaggtaagttaggtggtagaactagttacggtactagtcggacggtacttcgtgggtacggaaccggggcccttacttacccaacctagttccctacggaagaacgaacctaaccgaccgaaacgtaccccttcccgttagtaacctaacctaaacgaaacgttcgaacgtacgttcgtaggtaaggtaggttacggaaaccggaccgtaccgttacctttagttaacttacgtaggtaacgaaacggtaaagtcggtaccggggaaagttagggttgggtacgggtacgtcgtacggaactaggttcccggtacgttaccggggtacgggtaccggttaccgggtaacccgttcggtaccctaccggttccctacccggtacgtacccgtaccccgtaaccgtaaacccgggcccgtacccgttacggttcccccgtttaccccgttcccccggtacgtaccccccgtaccccttaacccgtaccgtaaacgcccgtacccgtacccgggtgggacccgggtaccgaacccgggccgggtccccggtacccgggtcggtcccggttcccggtaccggttacggtaacccgtaaccggtttccctttacccggtcccgttcgtacgg

SEQ ID NO: 100122 - DNA, 821 bp, Homo sapiens
  misc_feature: GYAE6OF01BW2XB.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattctaccttttgatgattatgccatgcacgtcggggtccgacaagcctaccggaaggggaacgggcctgggaggtgggtcctacgtaggttacttacgttggaagttaggtggtacgactagtacggctagtcggcggtacttcgtggtacggaacgggtcccgtcttaccacctatcctaccgaagacgaacaaccgaccaaacgtacctccctagtactactaaactaatagaactagtacgtagaggtagttaggaacggtaccgtaccggttcctttacttaacgtttacgtaggttaacgaaacgtaaaacggtacggtaccggggtaaacggttagggttagggggttggggtacggtacgttacggaaccgttaacgtcccggtaacggttacccggggtccgggggtaccggtacccggggtaacccgttcggtacccggtacccgttccctacccgtaccacccgtacccccgtacccgaacccgggtaacccggtcccctacggttccccggttccccttcccccggtacccggtcccctaaccccccgtccgtaacccgtaacgccgtaccctacccggttcgggtaccgggtacccacggtccgggcccggtcccggtcgggtcccttcggaccggttacgggtaacccgttacgggttacccgttcccgtttcccggtcgttacgg

SEQ ID NO: 100123 - DNA, 987 bp, Homo sapiens
  misc_feature: GYAE6OF01C6Q4S.5.20.B09.1.454.CMB.1.raw
  modified_base (159)..(159): a, c, t, g, unknown or other
  misc_feature (159)..(159): n is a, c, g, or t
tcagatcagacacgcacgaccggtgctcgatttagtgtagtgtgaagtgcagctggtggagtctgggggagcttggtacagcctggcaggtccctgagactctcctgtgcagcctctggattccacctttgatgacttatgccatgcacgtgggtccgnaagctcgagggacggctggagtggtctgaggtattacgtggaataggtgtcgactagtggcttagtcggaccgtactcgtaggtacggacgggtccgtccttaccgaacctacgttccgttaccgaaggaacgaaccgaaccgaccccgtaaaaggtaaccccttccccgtttaggttaaacctttaccgttaaaacgtaaaacgttacggtaaaaccgttaacggttaccggttaagggtaagggttaaccgggttttaaggggaaaccgggttaacccgtaaaccccgggtttccctttttaaccgttaaacgttttaccgttacgggtaacgtaaacccgtaaaaagggtcggttaaccggggtaaacgtaacggggttggggttacgggtcggccgttaggaaccgtaaacgttccgggtaacgttaccggtccgggggttaacccgttaccggggtaaacccctttacgggtacccgttaccccggttccgttacccccgttacgaccccggttcccccgttaaacccggaacccgggtaacccgggtacccctttaaccgggttcccccgttttacccccgttaccccccgggtcggtaaaccccccgttcccccgttaaccccgttaaaccgaaccggttacccggtaccccgttacccgggttcccggggtacggggacccctaaaccgggtacccgggtccccgggttacccgggttaccggggttccctaccccgggggttaccgttacccggggttaacccggtaaaacccggtttacccgttttacccccgtttaccggggtttcgttaacccggg

SEQ ID NO: 100124 - DNA, 818 bp, Homo sapiens
  misc_feature: GYAE6OF01E3NGV.5.20.B09.1.454.CMB.1.raw
tcagatcagacacgcacgaccggtgctcgatttagtgtagtgtgaagtgcagctggtggagtcgtggggggaggcttggtacagcctggcaggtccctgagactctcctgtgcagcctctggattcacctttgatgattatcgccatgcacgtcggggtccgcaagcctccgaaggggaacgggccgtgggaggtcgggtctcgtaggttattacgttaggaataggtggtagacagtaggctagtcgcggtactcgtggtacggaacgggtcccgtcttaccaccctacttcctacccgaaggaacgaaaccaaccgacccaaacgtaaccctacccttacgttaactactaaacaaaatacgaaactagtacgtaggaagttacggttaggaacggaccgtaccggttacctttacgttacgttacgtgtagaaacgaaaaggtacggtaacggggaacgtaagggtgggttcggggtacgtcgtacgacgtaacgtaccgtacgtaccgggtcggggtcccggtaccgggtaaccccgttcggtacccgtacccgtccgttaccctccgaccgtccccgtacccgaacccggaaccggtccccgtaccgttcccggttcccccttccccggtaccgtacccctaccccctcccgtaacccgaacggccgtacccctaccgggttccgggaccggggtacccaccgggtaccgggccccgggtaccccggtccggggtccgtccggtaccccgggttacggtaacccggtaaaccgggttacccctttaccccggtttccccgtgggtttacccgg

SEQ ID NO: 100125 - DNA, 555 bp, Homo sapiens
  misc_feature: GYAE6OF01EA7UX.5.20.B09.1.454.CMB.1.raw
  modified_base (214)..(214): a, c, t, g, unknown or other
  misc_feature (214)..(214): n is a, c, g, or t
  modified_base (279)..(279): a, c, t, g, unknown or other
  misc_feature (279)..(279): n is a, c, g, or t
  modified_base (518)..(518): a, c, t, g, unknown or other
  misc_feature (518)..(518): n is a, c, g, or t
  modified_base (520)..(555): a, c, t, g, unknown or other
  misc_feature (520)..(555): n is a, c, g, or t
tcagatcagacacgcacgaccggtgctcgatttagtgtagtgtgaagggcccgattcaccatctccagagacaattccgaaaaaagatgttatatctgacaaatgaacagccctgacgacctgaggacacggctgttatattattacgtgtgaacgggactacaaactcgtggggaccctactttgaacaaggtcgggccgagggaacccggtnatcgtcctccgtcacggtcccaccaaccgaacgggcccctaacgtccggttccctttccccccgnggacccctacccccttacctacccgaaagaaccgtccgtaaccgttccggtcggggggaccaaaccggtacggccccggtaacccccggttcggggaccgtccggtacccgtacggttaaccgaacgggttaaaccctttaccgtttcccccgggtgtttacccgttaaggtactttacgggacggtaccgggccgggcgttaccgggacgaaacggttccgtaccgaaagtggctcgnannnnnnnnnnnnnnnnnnnnnnnnnnnnnnnnnnnn

SEQ ID NO: 100126 - DNA, 755 bp, Homo sapiens
  misc_feature: GYAE6OF01CBLJR.5.20.B09.1.454.CMB.1.raw
  modified_base (163)..(163): a, c, t, g, unknown or other
  misc_feature (163)..(163): n is a, c, g, or t
  modified_base (177)..(177): a, c, t, g, unknown or other
  misc_feature (177)..(177): n is a, c, g, or t
  modified_base (534)..(534): a, c, t, g, unknown or other
  misc_feature (534)..(534): n is a, c, g, or t
  modified_base (647)..(647): a, c, t, g, unknown or other
  misc_feature (647)..(647): n is a, c, g, or t
  modified_base (696)..(697): a, c, t, g, unknown or other
  misc_feature (696)..(697): n is a, c, g, or t
  modified_base (701)..(702): a, c, t, g, unknown or other
  misc_feature (701)..(702): n is a, c, g, or t
  modified_base (704)..(704): a, c, t, g, unknown or other
  misc_feature (704)..(704): n is a, c, g, or t
  modified_base (707)..(707): a, c, t, g, unknown or other
  misc_feature (707)..(707): n is a, c, g, or t
  modified_base (710)..(710): a, c, t, g, unknown or other
  misc_feature (710)..(710): n is a, c, g, or t
  modified_base (715)..(715): a, c, t, g, unknown or other
  misc_feature (715)..(715): n is a, c, g, or t
  modified_base (720)..(721): a, c, t, g, unknown or other
  misc_feature (720)..(721): n is a, c, g, or t
  modified_base (723)..(724): a, c, t, g, unknown or other
  misc_feature (723)..(724): n is a, c, g, or t
  modified_base (726)..(726): a, c, t, g, unknown or other
  misc_feature (726)..(726): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
  modified_base (733)..(733): a, c, t, g, unknown or other
  misc_feature (733)..(733): n is a, c, g, or t
  modified_base (737)..(740): a, c, t, g, unknown or other
  misc_feature (737)..(740): n is a, c, g, or t
  modified_base (742)..(743): a, c, t, g, unknown or other
  misc_feature (742)..(743): n is a, c, g, or t
  modified_base (745)..(746): a, c, t, g, unknown or other
  misc_feature (745)..(746): n is a, c, g, or t
  modified_base (749)..(749): a, c, t, g, unknown or other
  misc_feature (749)..(749): n is a, c, g, or t
  modified_base (751)..(751): a, c, t, g, unknown or other
  misc_feature (751)..(751): n is a, c, g, or t
  modified_base (753)..(753): a, c, t, g, unknown or other
  misc_feature (753)..(753): n is a, c, g, or t
tcagatcagacacgcacgaccggtgctcgatttagtgtagtgtgaagggaggcctggagtgggtctcaggtattacttggaatagtggtgacataggctatggcggactcgtgtaggaagggccgcttcaccatctcagagacaacgccaagactccctgtanctaacaaatgaacngtctagaggagttggaaggaccgaccggtcctttactaagtttacgtgtagaaacgaaaaacggtacggtaccggggaacggtaagggttggggttgggtaggtcgtaacgacgaaacgttaccggaaccgttacggggtaccggggtacccgttaaccgggggaaccgttccgggttaccgtacccggttcccttaccccggtacaacggacccccgtaaccgaaccggtaaccccggggtcccgtaaccggtttcccgtacccccgttttcccccgcggtaccccctaacccccgtttcccgaacccgaaaacggtacccggccgttaacccggttaccggggacggggtacccnccgggtaaccggccccggtcccgggtcggggtccgttaaccgccgggttacgaaaccgtaaccgggttaaccctttcccgttcccggttcgtacgtacgggtctttaaccggnggtacccgggccgggtacgtaccgggacggtaacgccgtaagaaggtcnngcgnngncgnagngcgcncgacnngnngngcncnanagcnnnngnngnnganangnag

SEQ ID NO: 100127 - DNA, 350 bp, Homo sapiens
  misc_feature: GYAE6OF02F0K2K.5.20.B09.1.454.CMB.1.raw
  modified_base (347)..(350): a, c, t, g, unknown or other
  misc_feature (347)..(350): n is a, c, g, or t
tcagatcagacacgcacgaccggtgctcgatttagtgtagtgtgaagggccgattcaccatctccagagacaattccaaaagatgttatatctgcaaatgaacagcctgagacctgaggacacggctgtatattattgtgtgacggggactcaactctgggggacccactttgacaagtggggccagggaaccccggtcatcgtctcctcagcctccaccaagggcccatcggtcttccccctgacaccctcctccaagagcacctctgggggcacagcggccctgggctgcctggtcaaggactacttcccgtgtctgatctgagcgggctggcaaggcgcatagnnnn

SEQ ID NO: 100128 - DNA, 351 bp, Homo sapiens
  misc_feature: GYAE6OF02IEX74.5.20.B09.1.454.CMB.1.raw
  modified_base (346)..(351): a, c, t, g, unknown or other
  misc_feature (346)..(351): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctgggggacccactttgacaagtggggccagggaacccggtcatcgtctcctcagcctccaccaagggcccatcggtcttccccctgacaccctcctccaagagcacctctgggggcacagcggccctgggctgcctggtcaaggctacttcccgtgtctgatctgagcgggctggcaaggcgcatagnnnnnn

SEQ ID NO: 100129 - DNA, 542 bp, Homo sapiens
  misc_feature: GYAE6OF02GSTD4.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacaagtggtggtggctgcaatcgactacgtgggcctgggaaccctggtcaccgtctcctcagcctccaccaacgggcccatccggtcttcccctggccaccctcctcccaagacgccacctcgtcgggggcacgacggccggcctcggggcctcggcccgttcgggtccaagggtacctaccgtttcccggtgttccg

SEQ ID NO: 100130 - DNA, 652 bp, Homo sapiens
  misc_feature: GYAE6OF02JFALT.5.20.B09.1.454.CMB.1.raw
  modified_base (181)..(181): a, c, t, g, unknown or other
  misc_feature (181)..(181): n is a, c, g, or t
  modified_base (209)..(209): a, c, t, g, unknown or other
  misc_feature (209)..(209): n is a, c, g, or t
  modified_base (312)..(312): a, c, t, g, unknown or other
  misc_feature (312)..(312): n is a, c, g, or t
tcagatcagacacgcacgaccggtgctcgatttagtgtagtgtgaaggtgcagctggtggagtcgtggggaggcttggtacaggcctggcagggtcccctgagactctcctggtgccagcctctggagttcacctttggatcgattatgccatgcactggtcgcagctccaggacggctgngtggtctcaggtatactggaatgtggtnacataggctatgcggactctgtgaacgggcccgtctttcgaacctgttcctccaagaacgacgaaacgcccaaagaacctccctgtatctaacaaatcgaacngtcctggtaacgaggttggagggtacctacgggaccttttcaagtttcgtgtagacgaaaagtgttcggggaactaaggtcggttaggtcggccttagactaatcggacgtacgtcggggtcctcgggaaccctggtcgaccgttcttcccgtcacgtcctccaccgtaacgggacccacgttccggttcccttacccccgttggtcccgtacccgtaccgtacccgaacggtacgacctaccgtccgtacggggacctacgacggtccggtcccgtcggggtaccttcgtcccgttcggtccgtaaccggtacccttaccgtttccccggtgttacccg

SEQ ID NO: 100131 - DNA, 349 bp, Homo sapiens
  misc_feature: GYAE6OF02IAPHP.5.20.B09.1.454.CMB.1.raw
  modified_base (344)..(349): a, c, t, g, unknown or other
  misc_feature (344)..(349): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctgggggacccactttgacaagtggggccagggaaccccggtcatcgtctcctcagcctccaccaaggccatcggtcttcccctgcaccctcctccaagacgcacctctgggggcacagcggcctgggctgcctggtcaaggactacttcccgtgtctgatctgagcgggctggcaaggcgcatagnnnnnn

SEQ ID NO: 100132 - DNA, 543 bp, Homo sapiens
  misc_feature: GYAE6OF02HOUSO.5.20.B09.1.454.CMB.1.raw
  modified_base (342)..(342): a, c, t, g, unknown or other
  misc_feature (342)..(342): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaaagaactccctgtatctaacaaatgaacagtctgagagttgaggacacggccttctattactgtgacaaaagntcgggacgaaggtggtggtgctgcaatcgactacgtgggcctgggaaccctggtcaccgtctcctcagcctccacaacgggcccatccggtccttccccgtggccaccctcctcccaagcgccaccgtcgtggggccacgacggccggccctggggcctcggcccgtggtaccgaaggtaccctacttccccggtgttccg

SEQ ID NO: 100133 - DNA, 538 bp, Homo sapiens
  misc_feature: GYAE6OF02HUE3M.5.20.B09.1.454.CMB.1.raw
  modified_base (341)..(341): a, c, t, g, unknown or other
  misc_feature (341)..(341): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgctttcaccatctccagagacaacgccaagaactccctgtatctacaaatgaacagtctgagagttgaggacacggccttctattactgtgacaaaagntcgggacgaagtggtgtggctgcaatcgactacgtgggcctgggaaccctggtcaccgtctcctcagcctccaccaacgggcccactccggtccttccccctcggccaccctcctccaacgacgccaccgtcgtcggggccacgaggccggccctgggctcgccgtggtcgaacggtacctacgttcccgtgttccg

SEQ ID NO: 100134 - DNA, 538 bp, Homo sapiens
  misc_feature: GYAE6OF02H5J1O.5.20.B09.1.454.CMB.1.raw
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaaatgaacagtctgagagttgaggacacggccttctattactgtgcaaaagntcgggacgaagtggtgtggctgcaatcgactactggggcctgggaaccctggtcaccgtctcctcagcctccaccaacgggcccatccggtcttccccctggccacccctcctccaagcgccacctcgtggggccacgacggccggccctgggcctcgcccgtgggtaccaagggtacctacgttccccggtgttccg

SEQ ID NO: 100135 - DNA, 557 bp, Homo sapiens
  misc_feature: GYAE6OF02J28H5.5.20.B09.1.454.CMB.1.raw
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
  modified_base (500)..(500): a, c, t, g, unknown or other
  misc_feature (500)..(500): n is a, c, g, or t
  modified_base (553)..(553): a, c, t, g, unknown or other
  misc_feature (553)..(553): n is a, c, g, or t
tcagatcagacacgcacgaccggtgctcgatttagtgtagtgtgaagtgcagctggtggagtctggggaggcgttggtacagcctggcaggtccctgagactctcctgtgcagcctctggattcacctttgatgattatgccatgcactgggtccggcaagctccagggaagggcctggagtgggtctcgaggtattacttggaatagtggtgacataggctatgcggactctggtgaagggccgcttcaccatctccagacgacaacgccaagaacctccctagtatctaacaaatgaacngtctagagtagtgaggacacggcttntatactgtanacaaaagngtcgggaacgaagtgggtagtgctgacaagtcgactacgngggtccgtacgggaacccgtggtaccgaccggttcctccgtccgacgccctacccgaccgacggcccacgtccggtccctcccgtcgaccctaccctccctaccgacgacgccncgtcgcgggcacgcgccgccgcggctcgcgtcgtcgacgtactccttccggtntccg

SEQ ID NO: 100136 - DNA, 573 bp, Homo sapiens
  misc_feature: GYAE6OF02J1GUK.5.20.B09.1.454.CMB.1.raw
  modified_base (337)..(337): a, c, t, g, unknown or other
  misc_feature (337)..(337): n is a, c, g, or t
tcagatcagacacgcacgaccggtgctcgatttagtgtagtgtgaagtgcagctggtggagtctggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctatactgtgcaaaagntcgggacaagtggtgtggctgcaatcgactactgggcctgggaaccctggtcaccgtctcctcgagcctccaccgtaacgggcccaacgttccggtaccttcccccgtcggcccaccccgttccctaccgaaacgtacgaccaacccttcgtcgggggaccacgacggcccgggcccgtagggcccgttgacccgttggtaccgaacgggtacctacccgttcccggtagttcccg

SEQ ID NO: 100137 - DNA, 531 bp, Homo sapiens
  misc_feature: GYAE6OF02FJX7K.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagatcgggacgaagtggtggtggctgcaatcgactactggggcctgggaaccctggtcaccgtctcctcagcctccaccaacgggcccatccggtcttccccctcggccaccctcctccaacgacgcacctcgtcggggcacgagccggccctgggcctcgcctcggtcgaaggacctaccgttcccgtgttcg

SEQ ID NO: 100138 - DNA, 557 bp, Homo sapiens
  misc_feature: GYAE6OF02FL19K.5.20.B09.1.454.CMB.1.raw
  modified_base (322)..(322): a, c, t, g, unknown or other
  misc_feature (322)..(322): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagactccctgtatctacaaatgaacagtctgagagttgaggacacggtccttntattactgtgacaaaagatcgggacgaagtggtggtggctgcaatcgactacgtgggccgtgggaaccctggtccaccgtctcctcacgcctccaccaacggcccacgtccggtccttccccgtcggcccaccctccctaccgaacgacgtaccaccgtccgtcggggcaccgcggcccggcccgtcgggcctcgcccgtggtaccgaacggtacctacccgttcccgtgttccg

SEQ ID NO: 100139 - DNA, 568 bp, Homo sapiens
  misc_feature: GYAE6OF02FHW4K.5.20.B09.1.454.CMB.1.raw
  modified_base (344)..(344): a, c, t, g, unknown or other
  misc_feature (344)..(344): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaacctccctgtatctacaaaatgaacagtctgagagttgaggacacggtccttctattactgtgacaaaagtntcgggaacgaaagtcggtggtggctgcaagtcgactacgtcggggcctgggaaccctggtcaccgtctcctcacgtcctccaccgaacggcccagtccggtccttccccgtggcccacccgtcctaccaacgcgacaccgttcgtcgggggtcacgacggccggcccgtacgggcctcggtccgtcggtacgtaacggaccttaccgttccccggtgttaccgg

SEQ ID NO: 100140 - DNA, 563 bp, Homo sapiens
  misc_feature: GYAE6OF02GJD8P.5.20.B09.1.454.CMB.1.raw
  modified_base (469)..(469): a, c, t, g, unknown or other
  misc_feature (469)..(469): n is a, c, g, or t
  modified_base (493)..(493): a, c, t, g, unknown or other
  misc_feature (493)..(493): n is a, c, g, or t
  modified_base (559)..(559): a, c, t, g, unknown or other
  misc_feature (559)..(559): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaaggccgcttcaccatctccagagacaacgccaaagaacctccctgtatctaacaaatgaacagtctagagagttgaggacacggtccttctattactgtgacaaaagagtcgggaacgaagtgggtaggtgcgtgcaatcgacgtacgtcggggccgtacgggaccctggtccacccgttctccctcgacgccctccaaccgaacgggcccacgtccggtcccttcccccgngccctaccctccctaccaacgacncaccctcgtcggggcacgacggccggcccgtgggcctcgccgtggtcaaggtcctaccgttcccgntccg

SEQ ID NO: 100141 - DNA, 636 bp, Homo sapiens
  misc_feature: GYAE6OF02JSE8R.5.20.B09.1.454.CMB.1.raw
  modified_base (241)..(241): a, c, t, g, unknown or other
  misc_feature (241)..(241): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccagggaaggcctggagtgggtctcaggtattacttggaatagtggtgacataggctatgcggactctgtgaagggccnttcaccatctccagagacaacgccaagaacctcctgtactctacaaatgaaacagtctagagtagttgaaggaccacggtccttataattacgtgtacgacaaaaagtcgtacggggaacgtaaaggttgggtagggtggctaggcaaagttccgactacgtcgggtaccgtacgggtaacccgtcggtaccgtaccggtacctccgtaccgacgccctacccgaaccgaaccgggccctacgtcccggttcccttcccccgtcggaccctacccctcccgtacccgaacgccgcctaacccgttccgtacggggaccaccgaccggcccgggtacccgtcgggtccgtcggtccgtcggtaccgaacggtaccgttaccgttcccggtgtaccg

SEQ ID NO: 100142 - DNA, 546 bp, Homo sapiens
  misc_feature: GYAE6OF02IR0HC.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaaagaactccctgtatctacaaatgaacagtctgagagttgaggacacggccttctattactgtgacaaaagatacgggaacgaagtggtggtgctgcaatcgactacgtggggctgggaaccctggtcaccgtctcctcacgcctccaccaggcccatcgtcttcccccgtggccaccctcctaccaacgacgccacctcgtgggggcacgacggccgggcccctggggcctcggcccgtcggtacgaacggacctaccgtttccccggtgttccg

SEQ ID NO: 100143 - DNA, 545 bp, Homo sapiens
  misc_feature: GYAE6OF02GTJ0L.5.20.B09.1.454.CMB.1.raw
  modified_base (376)..(376): a, c, t, g, unknown or other
  misc_feature (376)..(376): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattacttggaatagtggtgacataggctatgcggactctgtagaaggccgcttcaccatctccagagacaacgccaagactccctgtatctacaaatgaacagtctgagagttgaggacacggcctttctattactgtgacaaaagatcggacgaagtgggtaggtggctgcaatcgactacgnggggcctagggaaccctggtcaccggtctccctcacgtcctccaccaacgggcccagtccggtccttccccgtggccaccctcctccaagcgccacctcgtggggccacgacggccggcccgtgggcctcggcctcggtacgaacggaccttaccgttcccggtgtccg

SEQ ID NO: 100144 - DNA, 563 bp, Homo sapiens
  misc_feature: GYAE6OF02I6JGQ.5.20.B09.1.454.CMB.1.raw
  modified_base (283)..(283): a, c, t, g, unknown or other
  misc_feature (283)..(283): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggctcaggtattacttggaatagtggtgacataggctatgcggactctgtgaagggccgcttcacccatctccagagacaacgccaaagaactccctgtanctacaaatgaacagtctgagagttgaggacacggccttctattactgtgacaaaagatcgggacgaagtaggtggtggctggcaatcgactacgtggggcctgggaaccctggtacaccgtctcctcacgcctccaccgaacgggcccagtccggtccttcccccgtagacccacccgtccctaccgaacgacgccgaccctcgtcggggccacgacggccggcccgtgggccttcgcccgtcggtaccgaacgggtacctacccgttcccggtgttccg

SEQ ID NO: 100145 - DNA, 547 bp, Homo sapiens
  misc_feature: GYAE6OF02FV3UV.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaaacagtctgagagttgaggacacggccttctattactgtgcaaaagatcgggacgaagtggtgtggctgcaatcgactactgggctgggaaccctggtccaccgtctcctcagcctccaccaacgggcccatccggtccttcccccgtggccacccttcctccaaacgacgccacctcgtggggccaccgacggccggccccgtggggccctcgcccgtggtccgtaacggaccttaccgttcccggtgttccg

SEQ ID NO: 100146 - DNA, 548 bp, Homo sapiens
  misc_feature: GYAE6OF02JT9FU.5.20.B09.1.454.CMB.1.raw
  modified_base (514)..(514): a, c, t, g, unknown or other
  misc_feature (514)..(514): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaacctccctgtatctacaaatgaacagtctgagtagtgaggacacggtcttactattactgtagacaaagagtacgggaacgtaagtgggtgtggctgacaatcgactacggtcgggccgtacgggaacccgtggtaccaccgttccgtcctcaccggcctacccgaccgaacggcccagtccgtcctccccgtgccaccctcctccaacgcgccaccgtcgcgggcacgacggccggtccgngggcctcgcgtcgcaacggcttacgtccgtagtc

SEQ ID NO: 100147 - DNA, 564 bp, Homo sapiens
  misc_feature: GYAE6OF02HBWOX.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagacctccctgtatctacaaatgaacagtctgagagttgaggacacggccttctattactgtgacaaaagatcgggacgaaggtggtaggtggctgcaagtcgactacgtggggcctcgggaaccctggtccaccgttcctccctcacgccctccaccgaacgggccctactccggtccttccccgtcggccacccctccctccaacgacgccacccgtcgtacggggcacgacggccggcccgtcgggcctcggtccgtcggtaccgaacggtacctaccgttcccgtgttccg

SEQ ID NO: 100148 - DNA, 733 bp, Homo sapiens
  misc_feature: GYAE6OF02JVBH8.5.20.B09.1.454.CMB.1.raw
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccagggaagggcctgggagtgggtctcgaggttattacgttggaataggtggtgacagtaggctatgcggactctgtgagggccnttcaccatctcaganacacgcaagactccctgtactctacaaatgaacagtctgagagtagaggacacggtccttactattacgtgtacgacgaaaagacgtcggggaacgtaaggtgggtagggtggctaggactaagtcggtaacgtacggtcgggggccgtacggggaaccccgttgggtacctaacccggttcctccctacgaccggtaccccgttcccgaaaccggtaacccggggtacccctaacggttcccgggttccccgtttaccccccgtccgggtaccccttaaccccccgttccccgtacccggtaaaaccggtccggtaccccgtaaaccccggttccgggttacggggggacccctaacccggtaccggggcccccggggtaccccggttcggggtacccgttccggttcccggtacggggttaacccaaaccgggttaccccgttacccgggtttccccgtacggttccgg

SEQ ID NO: 100149 - DNA, 358 bp, Homo sapiens
  misc_feature: GYAE6OF02IOUCR.5.20.B09.1.454.CMB.1.raw
  modified_base (262)..(262): a, c, t, g, unknown or other
  misc_feature (262)..(262): n is a, c, g, or t
  modified_base (349)..(358): a, c, t, g, unknown or other
  misc_feature (349)..(358): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacgggggactcaactctgggggacccactttgacaagtggggccagggaaccccggtcatcgtctcctcagcctccaccaagggcccatcggtcttccccctggcaccctcctccaagngcacctctgggggcacagcggccctgggctgcatggtcaaggactacttcccgtgtctgatctgagcgggctggcaaggcgcatagnnnnnnnnnn

SEQ ID NO: 100150 - DNA, 571 bp, Homo sapiens
  misc_feature: GYAE6OF02GGFU2.5.20.B09.1.454.CMB.1.raw
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgcaagaactccctgtatctacaaatgaacagtctgagagttgaggacacggccttctattactgtgacaaaagntacgggaacgaagtggtggtggctgcaatcgactacgtgggccgtacgggacccgtggtccaccgtctcctcagcctccaccgaacgggcccatccggtcccttccccgtcggtcccacccgttccctacccaagaccgcacccgtccgtcgggggccaaccgtacggccggcccgtggggcctcggtcccgtcggtacgtaacgggaccttaccgttcccgtcgttccgg

SEQ ID NO: 100151 - DNA, 563 bp, Homo sapiens
  misc_feature: GYAE6OF02HT4VF.5.20.B09.1.454.CMB.1.raw
  modified_base (335)..(335): a, c, t, g, unknown or other
  misc_feature (335)..(335): n is a, c, g, or t
  modified_base (410)..(410): a, c, t, g, unknown or other
  misc_feature (410)..(410): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctagtatctacaaaatgaacagtctgagagttgaggacacggccttctattactgtnacaaaagatcgggacgaagtggtggtggctgcaatcgactacgtgggccgtgggaaccctggtcaccgtctcccncacgcctccaccaacggcccatccggtcttcccccgtggcccaccctccgtaccaacgacgcaccctcgtcggggccacgacggccggacccgtgggcctcggcccgttcgggtaccgaacgggtacccttaccgtttccccggtgttacccg

SEQ ID NO: 100152 - DNA, 561 bp, Homo sapiens
  misc_feature: GYAE6OF02FZ0CW.5.20.B09.1.454.CMB.1.raw
  modified_base (340)..(340): a, c, t, g, unknown or other
  misc_feature (340)..(340): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgacaaaagntacgggacgaagtggtggtggctgcaagtcgactacgtgggcctgggaacccgtggtcaccgtctcctcacgcctccaccaacgggcccactccggttccttcccccgtcggccctaccccgtccctacccaacgacgccaccctcgtcgggggccaccgacggccggcccgtcgggccgtcgcccgtcggtccgaacggacctaccgttcccgtgttccg

SEQ ID NO: 100153 - DNA, 552 bp, Homo sapiens
  misc_feature: GYAE6OF02IPJ66.5.20.B09.1.454.CMB.1.raw
  modified_base (342)..(342): a, c, t, g, unknown or other
  misc_feature (342)..(342): n is a, c, g, or t
  modified_base (487)..(487): a, c, t, g, unknown or other
  misc_feature (487)..(487): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaaggcctggagtgggtctcaggtattacttggaatagtggtgacataggctatgcggactctgtgagggccgcttcaccatctccagagacaacgccaagaactccctgtatctaacaaatgaacagtctgagagttgaggacacggtccttctattactgtagacaaaagngtacgggacgtaaggtggtggtggctgactaagtcgactacgtgggccgtagggaccctggtccaccgtctcctcacgtcctccaccgacggcccatccggtccttccccgtgccctaccctcctccgaacgacgccaccgtcgnggggcacacgggccggtcccgtgggcctcggccgttcgacgtacggtacctccgttcccgtgtcg

SEQ ID NO: 100154 - DNA, 622 bp, Homo sapiens
  misc_feature: GYAE6OF02FZP71.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctgggagtgggtctcaggtattacttggaatagtggtgacataggctatgcggactctgtgaagggccgcttcaccatctccagagacaacgccaagaactccctgtatctaacaaatgaacagtctgagagttgaggacacggccttactattactgtagacaaaagagtcgggaacgaaggtggtggtggctgacaatcgactacgtcggggccgtgggaacccgtggtccaccgtctccctcaccgcctcccaccgacgggcccagtccggttcccttcccccgtcggaccctaccccgttccctacccgaacgaccgcccgtacccgtccgggtccggggtaccaccgaccgggtcccggtcccggtaccggggccgttacgggtcccgttacgggaccgttaaaccgggtaccctttacccggtttccccggtcgttacccg

SEQ ID NO: 100155 - DNA, 668 bp, Homo sapiens
  misc_feature: GYAE6OF02HSP2L.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaacgaacctccctgtatctacaaatgaacagtctgagtagttgaggacacggccttactattactgtgacaaaagagtacgggacgtaaggtggtggtggctgactaagtcgactacggtcggggccgtaggggtaaccctgggtaccacccggttcctccctacgaccgccctacccgaaccggtaaccgggcccctacggttcccggttccccttcccccggtacggtccccctaaccccttcccgaaccgaaacgtcccgacccgtaacccgttccggggaccgggggaccaaccgggaccgggtccccgggtccccggtacggggtcccgttccggcccgttcgggtaaccggaaaccgggttacccctttacccggttttcccggtgttacccgg

SEQ ID NO: 100156 - DNA, 420 bp, Homo sapiens
  misc_feature: GYAE6OF02IYNOZ.5.20.B09.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (379)..(420): a, c, t, g, unknown or other
  misc_feature (379)..(420): n is a, c, g, or t
tcagatcagacacgcacgaccggtgctcgatttagtgtagtgtgaagggccgattcaccaatctcccagagacaattccaaaaagatgttatatctgcaaatgaacagcctgagacctgaggacacgggctgtatattattgtgtgacgggggactcaactctgggggacccacgtttgacaagtggggccagggaaccccggtnatcgtctcctnagcctccaccaagggcccatcggtcttccccctgacaccctcctcaagcgcacctctggggcacagcgcctggctgcctggtcaacggactacgttccgtgtcgtgtaatctggagccggggtctcgggacctaaggggaccnccagtaagggcngagcatgnnnnnnnnnnnnnnnnnnnnnnnnnnnnnnnnnnnnnnnnnn

SEQ ID NO: 100157 - DNA, 567 bp, Homo sapiens
  misc_feature: GYAE6OF02I2QCY.5.20.B09.1.454.CMB.1.raw
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattacttggaatagtggtgacataggctatgcggactctgtgaacgggccgcttcaccatctccagagacaacgcaagactccctgtactctacaaatgaacagtctagagagttgaggacacggtccttctattactgtnacaaagatcgggaacgaaggtggtggngctgacaatcgactacgtggggctcgggaccctggtcaccgtctcctcgacgtcctaccaccgacgggccctacgtccggtccttccccgcgccctacccctcccgtaccaacgtacgccctaccgtccgcggggtaccacgacggccgggccgtcggggcctcggccgttcggccgtaacggtaccttacccgttcccgtcgtccg

SEQ ID NO: 100158 - DNA, 593 bp, Homo sapiens
  misc_feature: GYAE6OF02I3CAX.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtggggtccggcaagcctccgagggaagggcctggaggtgggtctcgaggttattacgttggaataggtggtgacataggctatgcggactctgtgaagggccgcttcaccatctccagagacaacgcaagaacctccctgtatctaacaatagaacagtctgagagttgaggacacggccttctattactgtgacaaagatcgggaacgaaggtgggtggtggctaggctaagtcgacgtacgtcggggccgtcgggtacccgtcggtacgtaccgtcctcctcgtacgcctcccgaaccgacggccccacgtccggttcccttccccgtcggtcccaccctccctacccgaacgacgcctaccgtcgtcggggccacgacggccggccgtcgggtccgtcggtccgtcggtacgtaacggaccttaccgttcccgtgtaccg

SEQ ID NO: 100159 - DNA, 600 bp, Homo sapiens
  misc_feature: GYAE6OF02G5OWR.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaaggcctggagtgggtctcgaggtattactggaatagtggtgacataggctatgcggactctgtgaagggccgcttcacatctcagagacaacgccaagaactcctgtatactacaaatcgaacagtctagagagttagaaggacacggtccttctaatactgtagactaaaagagtacgggacgtaaggtggtaggtcgctggactaagtcgactaacggtcggggaccgtacgggaaccctggtacgaccgttctcctacgagccctaccaccgaacgggccctacgtccggtcccttccccgtacggcccaccccgttccgtaccgaacgacgacctaccgtcgtcggggtacaccggtacggccggcccgtcgggtaccgtcgcccgttacggtaccaacgggtcccttaccgttcccggtgtccg

SEQ ID NO: 100160 - DNA, 582 bp, Homo sapiens
  misc_feature: GYAE6OF02IWNSN.5.20.B09.1.454.CMB.1.raw
  modified_base (329)..(329): a, c, t, g, unknown or other
  misc_feature (329)..(329): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaaggcctgggagtgggtctcgaggtattacttggaatagtggtgacataggctatgcggactcgtgtgaagggccgcttcaccatctccagagacaacgccaagaacctccctgtactctaacaaatgaacagtctgagtagttgaggacacggtccttntattactgtagacaaaagtgtacgggaacgaaggtgggtagggtcggtcgtgacaagtcgacgtacgtcgggccgtacgggaccgtcggtctaccgtctcctcacgcctccgaccgacggccctactccggttcccttccccgtcgccctacccttccaccgaacgtaccgcctaccgtcgtcggggccacgcggccggtcccgtggccgtcggccgtcggtaccgaacgtaccgtaccgttcccgtgtaccg

SEQ ID NO: 100161 - DNA, 353 bp, Homo sapiens
  misc_feature: GYAE6OF02F23I4.5.20.B09.1.454.CMB.1.raw
  modified_base (349)..(353): a, c, t, g, unknown or other
  misc_feature (349)..(353): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctgggggacccactttgacaagtggggccagggaaccccggtcatcgtctcctcagcctccaccaagggcccatcggtcttccccctgacaccctcctccaagagcacctctgggggcacagcggcccctgggctgcctggtcaaggactacttcccgtgtctgatctgagcgggctggcaaggcgcatagnnnnn

SEQ ID NO: 100162 - DNA, 603 bp, Homo sapiens
  misc_feature: GYAE6OF02H0MV7.5.20.B09.1.454.CMB.1.raw
  modified_base (347)..(347): a, c, t, g, unknown or other
  misc_feature (347)..(347): n is a, c, g, or t
  modified_base (426)..(426): a, c, t, g, unknown or other
  misc_feature (426)..(426): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccaggggaagggcctggagtgggtctcaggtattacttggaatagtggtgacataggctatggcggactctgtgaagggccgcttccaccatctccagagacaacgccaagaactccctgtatcctaacaaatgaacagtctgagagttgaggacacggccttcgtattactgtgacaaaagngtacgggaacgaaggtggtgtggctgcaagtcgactacgtggggcctgggaacccttggtaccgtaccgtctccctacncgtccctaccaccgaacggcccagtccgtccttccccgtcggcctacccttcctaccgaacgtcgacctacccgtcgtcggggccacgaccggccggtccccggtgggtcccgtacggtccccggttacgggttccgaaccgggtaccctttacccggtttccccggttgttacccg

SEQ ID NO: 100163 - DNA, 577 bp, Homo sapiens
  misc_feature: GYAE6OF02IRV7M.5.20.B09.1.454.CMB.1.raw
  modified_base (343)..(343): a, c, t, g, unknown or other
  misc_feature (343)..(343): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctagtgcggactctgtgaaggccgcttcaccatctccagacgaacaacgccaaagaactccctgtactctacaaatgaacagtctgagagttagagacacggcttctatactgtagacaaagngtacgggacaaggtggtaggtgctgacaatcgactacgtgggacgtcgggaacctcggtacgaccgtctacctcacgtcctaccaccacggccacgtaccggttccttacccgtcgtccctaccctccctaccgaacgtacgcctaaccgtcgtcggggccacgacggccggtcccggcggtccgtaccgtccgtacggtacgtaacggaccgttaccgttccccgtggttccg

SEQ ID NO: 100164 - DNA, 640 bp, Homo sapiens
  misc_feature: GYAE6OF02I6VW1.5.20.B09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccgagggaagggcctggagtgggtctcgaggtattacgttggaataggtggtgacagtaggctatgcggactcgtgtagaggccgcttcaccatctccagagacaacgccaagaactccctgtatctacaatagaacagtctganagttagaggacacggtccttactattactgtgacaaaagagtacgggacgtaaggtgtgggtggcgtggctaagtcgactacggtcggggccgtacgggacccgttggtaccgtaccgtctccctacacgtcctcccacccgaacggcccacgtccggttacccgttccccgtccggtaccctccccgtccctacccgaacgacgtacccgtacccgtccggtacgggggtaccaccggaaccggccgggtcccccgtaggggtcccgttcggtacccgttacgggtacgtaaaccgggtacctttacccggttccccggttgttacccgg

SEQ ID NO: 100165 - DNA, 901 bp, Homo sapiens
  misc_feature: GYAE6OF02JV3V5.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtgggtccggcaagctaccgagggaaggcctggagtgggtctcgaggttattacgttaggaattaggtggtgactagtaggactatggcggactcgtggtagaacggccgtcttcgacctatcgtacctagacgaacaacgaccaaagaacctcccctagtaactaccgtaacaaatcgaaactagtacgtaggaagaggttacggaggaacctccggtacttacttaacgttacgtagtgaactaaaaggtacgtacgggaaacggtaagggttcggggtaggggtacggtacgttacggaccgtaaacgtaccggtaaccgttaccgggtttacgggggcccgtttaaccggggaacccccggtttacgggtacccgttaacccccgggttaccgttacccccgttacgtacccggtacccccggttaccccgaaaccccgggtaaacccggggttacccccttaaaccgggtttccccgggtttaccccgtttacccccccgggttaacggtacccccccgttaacccctttacccccggtaacccggtaaaccgtacccgggtacccccgtacccggttacccgggtaaccggggggtacccctacccgggtaacccgggtccccgggttaccccggtcgggggttaccccgttacccgggttaccccggtacccgggggttaaccccgtaaaaccggggtttaccccgtttacccccggtttaaccccgggttccgttttaacccggg

SEQ ID NO: 100166 - DNA, 899 bp, Homo sapiens
  misc_feature: GYAE6OF02HZS36.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagccctctggtattctacctttgatgtattatcgcctatcgactacgtcggggtcccggacaacgtccaccggaaggggggaacgggtccgtagggtaggtcgggttcctacgtaaggttaatttacggttaggtaagttaggtgggtagaactagtaaggtcttaagtcggacggtacttcgtaggtgggtaacggggccgttcttacctacctaacttcctacccgaaggaacgaaccgaaaccggaccgaaaacggtaacccttacccgtaagttactaccttaaacaaaacgttacgaaactacgttctacggaaggtagttaggacgggtaaccgaccggttccgtttacttaattaccgtagtagaacgtaaaaggtcggttaacgggaacgtaagggttacgggtaggggtacggtacgttagaccgtaagtaccgtaacgttacgggtaccgggggtacccgtaccgggggtaaccccgttcggttacccggtaacccggttcccgtaccgtacccggtaccgtaccccgtacccgtaaaccggacccgggaaccctacggtcccggtttaccccgttcccccggtagtacccccgtaccctaccccgtaacgtaaccgcccgtacctacccggttaccgggccgggggtaccacccgtacgggggcccccggttaccggggtcgggtccccgttacggtccccgggttaccgggtaccgggtaaaacccgggtttaccccttacccgggttttaccccgggttacccgtttaaccggg

SEQ ID NO: 100167 - DNA, 567 bp, Homo sapiens
  misc_feature: GYAE6OF02FS9WL.5.20.B09.1.454.CMB.1.raw
  modified_base (346)..(346): a, c, t, g, unknown or other
  misc_feature (346)..(346): n is a, c, g, or t
  modified_base (500)..(500): a, c, t, g, unknown or other
  misc_feature (500)..(500): n is a, c, g, or t
  modified_base (563)..(563): a, c, t, g, unknown or other
  misc_feature (563)..(563): n is a, c, g, or t
tcagatcagacacgcacgaccggtgctcgatttagtgtagtgtgaagtgcagctggtggagtctggggaggcttggtacagcctggcaggtccctgagactctcctgtgcagcctctggattcacctttgatgattatgccatgcactgggtccgcaagctccagggagggcctggagtgggtctcgaggttattacgttggaatagtggtgacagtaggctatgcggactctggtgaacgggccgcttcaccatctccagagacaacgccaagacctccctgtatctacaatcgaacagtctgagagttagaggacacggtccttgtattactgtgacaaaagtntacgggacgaagtgggtggtggcgtgcgaatcgactacgtcggggcctacgggaaccctggtaccaccggttcctccgtcacgtccctccgaccgaacgggcccacgttccggtcccttccccgcgcctccctcctccgaacgcgctacctcgnggggccacgacggccggtccgtcgggtcgtcgccgtaggtaccgaaggtcctacttcccggtntccg

SEQ ID NO: 100168 - DNA, 582 bp, Homo sapiens
  misc_feature: GYAE6OF02FGYA8.5.20.B09.1.454.CMB.1.raw
  modified_base (279)..(279): a, c, t, g, unknown or other
  misc_feature (279)..(279): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcaccttttgatgattatgccatgcactgggtccggcaagctccagggaagggcctggagtgggtctcaggtattacttggaatagtggtgacataggctatgcggactctgtgaagggccgcttcaccatctccagagacaacgccaagactcccngtatctacaatgaacagtctgagagttgaggacacggccttctattactgtgacaaaagatcgggacgaagtggtggtgctgcatcgactagcgggcctgggaccctggtccgaccgtctcctcacgccctaccgaccgaaccgggcccagttccggttccctttcccccgtgggaccctaccccttcccgtacccaacgaccgtccaacccgttcggtacgggggccaaccgacggcccgggtcccgtcgggcctcggccgttacggtacgaacggtaccttacccgttcccggtgttaccg

SEQ ID NO: 100169 - DNA, 625 bp, Homo sapiens
  misc_feature: GYAE6OF02IRBO9.5.20.B09.1.454.CMB.1.raw
  modified_base (249)..(249): a, c, t, g, unknown or other
  misc_feature (249)..(249): n is a, c, g, or t
tcagatcagacacgcacgaccggtgctcgatttagtgtagtgtgaagtgcagctggtggagtcgtggggggaggcttggtacagcctggcaggtccctgagactctcctgtgcagcctctggattcacctttgatgattatgccatgcacgtgggtccggcaagctccaggggaaggcctggagtgggtctcgaggtattacgtggaataggtggtgacataggctatgcggactctgtgaagggccgnttcaccatctccagagacaacgccaagacctccctgtatctaacaaatgaacagtctagagagttgaggacacggtccttactattactgtagacaaaagagtcgggaacgtaaggtgggtggtggtcctggacaagtcgaaccgttacggtcggggaccgtacgggaacccgtcgggtccgaccgtcctccccgtacgacgtccctaccgaacccgaaacgggcccgacgtccggtccttcccccgtcggcccaccctcccgtaccgaacgtacgaccctaccgttccgtacgggggaccaccgacggtcccggcccggtcgggccgtccggccgttacggacgaacggtacccgttaccgttcccggtgtccgg

SEQ ID NO: 100170 - DNA, 552 bp, Homo sapiens
  misc_feature: GYAE6OF02GQ2Y0.5.20.B09.1.454.CMB.1.raw
  modified_base (339)..(339): a, c, t, g, unknown or other
  misc_feature (339)..(339): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactctgtgaagggccgcttcaccatctccagagacaacgccaagacctcctgtatctacaaatgaacagtctgagagttgaggacacggccttctattactgtgacaaaagntacgggagagtggtgtgctgcaagtcgactacgtcggggcctgggaaccctggtccaccgtctcctcacgccctccaccgaacgggcccacgtccggtccttcccccgtggtcccaccccttcctaccgtaacgacgccaccgtcgtcggggcacgacgccggcccgtcgggctcgccgtcggtacgaacggtacctacgttcccgtgtaccg

SEQ ID NO: 100171 - DNA, 627 bp, Homo sapiens
  misc_feature: GYAE6OF02G64H8.5.20.B09.1.454.CMB.1.raw
  modified_base (158)..(158): a, c, t, g, unknown or other
  misc_feature (158)..(158): n is a, c, g, or t
  modified_base (344)..(344): a, c, t, g, unknown or other
  misc_feature (344)..(344): n is a, c, g, or t
  modified_base (490)..(490): a, c, t, g, unknown or other
  misc_feature (490)..(490): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccggnaagctccagggaagggcctggagtgggtctcgaggtattacttggaatagtggtgacataggctatgcggactcgtgtgaacgggccgtcttcaccatcctccagagacaacgccaagaacctccctgtactctaacaaatgaacagtctgagtagttgaggacacggtccttactattactgtanacgaaaagtagtacgggaacgtaaggtggtggtgcgtgactaagtacgactacgtggggacccgtacgggaacccgtgggtacctaccggtcctcctcacgtcctacccacgaacgggcccctagttcccggttcccttcccccgngggtcccctaccccgttccgtaccgaaccgacggccctacccgtcggtccggggaccacggcgccccgggtccggtcgggcccttcgggtccctgggtaccgaaccggttacccgttaccgtttcccggtagttccg

SEQ ID NO: 100172 - DNA, 588 bp, Homo sapiens
  misc_feature: GYAE6OF02G6Y0H.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaagggcctgggagtgggtctcaggtattacttggaatagtggtgacataggctatgcggactcgtgtgaagggccgcttcaccatctccagagacaacgccaaagaacctccctgtatcacaaatgaacagtctgagtagttgaggacacggccttctattactgtgacaaaagagtcgggaacgaagtgggtggtgcgtgacaatcgactacgtgggccgtcgggaacctggtcaccgtctcctcgacgtcctcccgaaccgaacgggcccctagtcccggtccttcccccgtggtacccctaccctacccacccaagaccgaccacccgttccgtcgggggccacgaccggccggtcccgtcgggcctggtcccgtcggttaccgaacggttaccgttacccgtttccctgtaccg

SEQ ID NO: 100173 - DNA, 743 bp, Homo sapiens
  misc_feature: GYAE6OF02I3FJM.5.20.B09.1.454.CMB.1.raw
  modified_base (164)..(164): a, c, t, g, unknown or other
  misc_feature (164)..(164): n is a, c, g, or t
tcagatcagacacgcacgaccggtgctcgatttagtgtagtgtgaagtgcagctggtggagtcgtgggggaggcttggtacagccctggcaggtccctgagactctcctgtgcagcctctggattcacctttgatgattatgccatgcacgtcgggtaccgganaacgctaccgaggggaaggcctggagtgggtctcgagttattacgttaggaataggtggacactagtaggcttaagtcgaccggactcgtggtaggaacggggtcctcgttaccaacctaactcctaccgaagaacggaaccaaaccggacctaaagtaaccctaccccttaggtaacttactaaactaaaagtcgaaacgagttcgagtaggtagttacgaacggtaccaaccggtcctttacgttattacgtacgttagaaacgaaaagtacggtacgggaacgtaaagggtcgggtaggtacggtacgtagactaacgtaccgtacgtacggtcgggaccgtacgggaaccgtggtcctaccgtctccctacgtacgaccctaccgaacccgaacggacccctacgttaccgttcccgttacccccgtggtacccctaccctaccgttacccgaaagaccaccgtacccgtaccgggtcgggaccctaacgaaccgggtcccgggacccgttcggggccttaccggaccgttacgggtaacaccgggttaccctaccggtttcccgtcggttaccg

SEQ ID NO: 100174 - DNA, 853 bp, Homo sapiens
  misc_feature: GYAE6OF02JYLLC.5.20.B09.1.454.CMB.1.raw
  modified_base (473)..(473): a, c, t, g, unknown or other
  misc_feature (473)..(473): n is a, c, g, or t
tcagatcagacacgcacgaccggtgctcgatttagtgtagtgtgaagtgcagctggtggagtctgggggaggcgttggtacagcctggcaggtccctgagactctcctgtgcagcctctggattcacctttgatgattatgccatgcacgtgggtccggcaagctccgagggaaggcctgggagtggtctcgaggtattacgtggaatagtggtgacagtaggctatggaccgggacttcgtgggtacggaacgggggtccctctttaccaacccgagttccctacccgaaaggaacgtaacccgaaaaccggcccgtaaaaggtaaccctcccctaggttaatacccttaaacaaaaagttcgaaaaccgtagtttacctagggaaagtacgggttagaaacgggtaacgtacccgggtacccttttaacttaaacgtttaaccgttggggaacgtaaaccttaaaaaaggnggtttaaacgggggaacgtaaaggttggggttacggtcgggacttacggacgttaaaacgtcgtaaccgtacggtaccgggggtaccgttaaccgggggtaacccttagggtcccgtaaacccgttcgttacccctacggaacgtaccccgttacccgaaacccggtaaaccggggtccctaaacgtttcccgggttaccctttccccccggcggtaccccttaaccccgttacccggtaacccgtaacgtaccgcccgttaaaccgtccggttacggggacccgaccaccggggtcccggttaaccccgtggggccctaccggtaccggttcccggtaaggaacccgttaccgttacccgttttcccggagtttaccgg

SEQ ID NO: 100175 - DNA, 615 bp, Homo sapiens
  misc_feature: GYAE6OF02GOP5J.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcactgggtccgcaagctccagggaagggcctggagtgggtctcaggtattacttggaatagtggtgacataggctatgcggactctgtggaaggccgcttcaccatctcagagacaacgcaagaactccctgtatctaacaaatagaacagtctgagagttgaaggacacggccttgtattactgtgacaaaagagtcggacgaagtgggtggtggctgacaagtcgactacgtggggtccgtcgggtaacccgtggtctacccgtcgtccctcacgcccgtacccaaccgaacggggccccacgttccggttcccctttacccccgtcggaccctaccccttcccgtacccaaagccgacccaccgttcggtccggggcaccgtacgggcccggtccccgttcggggcctccggccggttacggtaccggtaaacggtcccgtttaacccgttccccggtgttacccgg

SEQ ID NO: 100176 - DNA, 577 bp, Homo sapiens
  misc_feature: GYAE6OF02FMB04.5.20.B09.1.454.CMB.1.raw
  modified_base (344)..(344): a, c, t, g, unknown or other
  misc_feature (344)..(344): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcaccttttgatgattatgccatgcactgggtccggcaagctccagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggtccttctacttactgtgacaaaagngtacgggacgaaggtggtggtggctgacaagtcgactacgtcgggccgtgggaacccgtggtcaccgtcctcctcacgtcctccacccgaacgggcccagtccggtccttccccgtcggcccacccctcctaccaacgacgacctaccgtcggtcggggccacgacggcccggtcccgtcgggccgtcgccgttcggtacgtaaccggtaccttaccggttcccgtgttccgg

SEQ ID NO: 100177 - DNA, 582 bp, Homo sapiens
  misc_feature: GYAE6OF02G9SFH.5.20.B09.1.454.CMB.1.raw
  modified_base (297)..(297): a, c, t, g, unknown or other
  misc_feature (297)..(297): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctccagggaggcctgggagtgggtctcgaggttattacgttggaaattaggtggtagactaagtagggctagtggcggtactcgtgtggaagggccgcttcaccatctccagagacaacgccaagactcctgtanctacaaatgaacagtctgagtagttgaggacacggccttactattactgtgacaaaagtgtcgggaacaaggtgtggtggctgactaatcgacgtacgtgggaccgtacgggtaacccgtcggtaccgacccgtctcctacgacgccctaccaccgaacggcccacgtccggtacccttccccgcgccctaccctcctaccgaacgacgccacctcggtcggggacacgacggccggcccgtggcctacgccgtggtccgaaggccttaccgttccgtgttaccg

SEQ ID NO: 100178 - DNA, 621 bp, Homo sapiens
  misc_feature: GYAE6OF02I8ZLM.5.20.B09.1.454.CMB.1.raw
  modified_base (332)..(332): a, c, t, g, unknown or other
  misc_feature (332)..(332): n is a, c, g, or t
  modified_base (378)..(378): a, c, t, g, unknown or other
  misc_feature (378)..(378): n is a, c, g, or t
  modified_base (429)..(429): a, c, t, g, unknown or other
  misc_feature (429)..(429): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcactgggtccggcaagctcagggaaggcctggagtgggtctcgaggtattacgttggaatagtggtgacataggctagtgcggactctgtgaagggccgcttcacctatcctccagagacaacgccaaagaacctccctgtatctaacaaatgaaccagtctgagagttgaggacacggtcccttntacttactgtgaacaaaagagtcgggacgtaaaggtgggtggtggntgacaagtcgactacgtgggccgtcgggaacccgtcgtcgaccgtcctccncacgtcctcccacccgaacgggcccctagtcccggttacccttccccgtaccgtccctacccctccctacccgaaacgaccgacccgtacccgtcgtcgggggaccaccgacgggtcccgggcccgtacggggtcctcggtccgttcgggtaccgtaaccgggtacccttacgtttccccggtacgttccgg

SEQ ID NO: 100179 - DNA, 355 bp, Homo sapiens
  misc_feature: GYAE6OF02FY2NG.5.20.B09.1.454.CMB.1.raw
  modified_base (349)..(355): a, c, t, g, unknown or other
  misc_feature (349)..(355): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacgggggactcaactctgggggacccactttgacaagtggggccagggaaccccggtcatcgtctcctcagcctccaccaagggcccatcggtcttccccctgaccaccctcctccaagagcacctctgggggcacagcggccctgggctgcttggtcaaggctacttcccgtgtctgatctgagcgggctggcaaggcgcatagnnnnnnn

SEQ ID NO: 100180 - DNA, 368 bp, Homo sapiens
  misc_feature: GYAE6OF02F1XO1.5.20.B09.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
  modified_base (351)..(368): a, c, t, g, unknown or other
  misc_feature (351)..(368): n is a, c, g, or t
tcagatcagacacgcacgaccggtgctcgatttagtgtagtgtgaagggccgattcaccatctccagagacaattccaaaaagatgttatatctgcaaatgaacagcctgagacctgaggacacggctgtatattattgtgtgacggggactcaactctgggggacccactttgacaagtggggccagggaaccccggtnatcgtctcctcagcctccaccaagggccatcggtccttccccctggcaccctcctcaagagccacctcgtgggggcacagccggccctgggctgcctggtcaaggactacttcccgngtctgatctgagcggctggacaaggcgacatagnnnnnnnnnnnnnnnnnn

SEQ ID NO: 100181 - DNA, 627 bp, Homo sapiens
  misc_feature: GYAE6OF02FMY1S.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcaccttttgatgattatgccatgcacgtgggtccggcaagctccagggaagggcctggagtgggtctcaggtattacgttggaatagtggtgacagtaggctagtgcggactctggtgaagggccgcttcaccatctccagacgacaacgaccaagaacctccctgtactctaacaaatagaaacagtctagagagttgaaggacacggtcttactattactgtgacaaaagagtacgggacgaaggtgggtggtggctgacaagtccgtactacggtcgggccgttacgggaacccgttggtacctaccgtcctccgtcacgtccctaccgaaccgaccgggaccctacgttccggtaccctttcccccgtggtacccctacccgttaccctaccgtaaacgaccgaccgtacccgttccgtcgggggaccgacgacggccggcccgtcggggcctcggccggttcggtacgaacggtaccttacccggttccgtcggttacg

SEQ ID NO: 100182 - DNA, 539 bp, Homo sapiens
  misc_feature: GYAE6OF02JJO4F.5.20.B09.1.454.CMB.1.raw
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (497)..(498): a, c, t, g, unknown or other
  misc_feature (497)..(498): n is a, c, g, or t
  modified_base (501)..(501): a, c, t, g, unknown or other
  misc_feature (501)..(501): n is a, c, g, or t
  modified_base (504)..(539): a, c, t, g, unknown or other
  misc_feature (504)..(539): n is a, c, g, or t
tcagatcagacacgcacgaccggtgctcgatttagtgtagtgtgaagggccggagttcaccatctccagagacaattccaaaaagatagttatatctgcaaatgaacagcctgagacctgagacacggctgtatattatgtgtgacggggactcaaactcgtagggggacccacgtttgactaaaggtgggggccacggggaaccccggtcgagtccgtacgtccctacgacgcctacccgaccgaacgggccccaacgttccgggtcctttccccccgcgacccgccccctacctacccgaaaggccgcctaccccgtccggtcggggaccaccgacggcccggcccgtcgggtccgtccggtccgtcggtaccgaacggtacccgtacccggttacccggttcggtaccgtacgtcttccgtacggacggtcgggtccgtacggaccggtacgggccgtacgacgtacgngcgtacgcngnngcnctgctngtcnncgngcnnnnnnnnnnnnnnnnnnnnnnnnnnnnnnnnnnnn

SEQ ID NO: 100183 - DNA, 398 bp, Homo sapiens
  misc_feature: GYAE6OF02IHHZJ.5.20.B09.1.454.CMB.1.raw
  modified_base (347)..(347): a, c, t, g, unknown or other
  misc_feature (347)..(347): n is a, c, g, or t
  modified_base (361)..(363): a, c, t, g, unknown or other
  misc_feature (361)..(363): n is a, c, g, or t
  modified_base (365)..(398): a, c, t, g, unknown or other
  misc_feature (365)..(398): n is a, c, g, or t
tcagatcagacacgcacgaccggtgctcgatttagtgtagtgtgaagggccgattcaccatctccagagacaattccaaaaaagatgttatatctgcaaatgaacagcctgagacctgaggacacggctgtatattattgtgtgacggggactcaactctgggggacccactttgacaagtggggccacgggaccccggtcatcgtctcctcagcctccaccaagggcccatccggtcttccccctggccaccctcctccaagacgcctacctcgtgggggccacacgcggccctgggctgcctggtacaagtactactcccgtgtctgatcgtgagcggctcgganaaggcgacagtagnnncnnnnnnnnnnnnnnnnnnnnnnnnnnnnnnnnnn

SEQ ID NO: 100184 - DNA, 679 bp, Homo sapiens
  misc_feature: GYAE6OF02HOP3I.5.20.B09.1.454.CMB.1.raw
  modified_base (161)..(161): a, c, t, g, unknown or other
  misc_feature (161)..(161): n is a, c, g, or t
  modified_base (592)..(592): a, c, t, g, unknown or other
  misc_feature (592)..(592): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtcgggtccganaagctcgagggaaggcctggaggtggtctcgaggtattacgttaggaaataggtggtagacagtaggactagtggacggtacttcgtggtaggaacggggccctccttaccgaacctacgttcctaccgaaggtaacgaaaccgaaaccggaccaaacggtaacccttaccccgtagttactaccctaaacaaaagtacgaaactcggttcgtaggaaggtaggttagacggacctaccggttctttacttaacgttacgtagtacgtaaacaaaaggtcgtacgggtaaacggtaggttggggtgggtagtccgtagaactaacgtacgacgttacggtcggggtacccgtaccgggtaccgtacggtaccgtacccgttcctcctacgacgtcctaccgaaccgtacgcctacgtccgttccctcccgngccctaccctccacgacgcncnccgttgcgggcacggccgcggtccgcggtcgtcgtccgtggacgacgtccgttcccgtcgtctcg

SEQ ID NO: 100185 - DNA, 575 bp, Homo sapiens
  misc_feature: GYAE6OF02FM9U4.5.20.B09.1.454.CMB.1.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
  modified_base (571)..(571): a, c, t, g, unknown or other
  misc_feature (571)..(571): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattcaccttttgatgattatgccatgcactgggtccggcaagctccagggaaggcctggagtgggtctcaggtattacttggaatagtggtgacagtaggctatgcggactctgtgagggccncttcaccatctccaganacaacgccaagaacctccctagtactctaacaaatgaacagtctagagagttgaggaccacggtccttntattacgtgtgaacaaaagngtacgggaacgtaaggtgggtggtggctgactaagtcgactacggtgggacctcgggaacccgtggtaccaccgtctcccgcacgtccctaccaccgaaccgggccctacgtccggttcccttccccgnggccctaccctccaccaacgacnccaccgtcggcgggcacgacgccggccgtcgggcctcgtccgtcggcgaacggtcctacgttcccggtntccg

SEQ ID NO: 100186 - DNA, 722 bp, Homo sapiens
  misc_feature: GYAE6OF02HTHV7.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattcacctttgatgattatgccatgcacgtgggtccggcaagctccgaggggaagggcctggagtgggtctcgaggttattacgttaggaataggtggtgacagtaggctagtgcggtactctggtgaacgggcgtccttcaccatcctaccagacgaccaacgaccaaacgaaccttccctagtactactaaacaaatacgaaactagtactaggacggtagttacggaaggaccgtaccggtcctttacgtaattacgtgttacgaacaaaagtacggtagggaacggtaaggtggggtggtggctacgacgaacgtcggtactacggtcggggccgttacgggaacccgtcggtaccgtaccgtcctccgtacgaccgacccctaccgaacccggaaccgggaccctacgttcccggttacccgttcccccggtacgtccccgtaccccttacccgaccgaacgtaccgacccaccggttacccgggcgggaccgaaccggacgggtccccgggtcccgttacgggggtccctccggggtcccgttcggggtaaccgtaaccgggttaaccctttcccggtttacccgtcggttaccg

SEQ ID NO: 100187 - DNA, 673 bp, Homo sapiens
  misc_feature: GYAE6OF02GRZ60.5.20.B09.1.454.CMB.1.raw
  modified_base (386)..(386): a, c, t, g, unknown or other
  misc_feature (386)..(386): n is a, c, g, or t
tcagatcagacacgcacgaccggtgctcgatttagtgtagtgtgaagtgcagctggtggagtctggggggaggcttggtacagcctggcagggtccctgagactctcctgtgcagcctctggattcacctttgatgattatgccatgcactgggtcccggcaagcctccgaaggggaacgggcctggaggttgggtctcgaggttattacgttaggaataggtggtagacagtaggctatgcggacttcgtgtggaagggccgtcttccgaccatcctaccgagaacgaaccaacgaccaaacgaacctcccgtagtaactacctaacaaaatcgaaacctagtctagaaggtagttaggacggacaccggtccttactattaccngtagaacgaaaagtacgtacgggaaacggaaggttgggtagggtcggctgacgtaagtccgtacgtaccggtcggggccgtaccggggtaccgtcggtacctaccgtcctcccgtcgaccgtcccacccgaaccgaccggcctacgttccgttccccgttcccgcgtcccctaccctacccaccgaagaccgacctaccgtcgggtacgggacccacgaccggccggtcccggtggtccacggtccggtacggaccgtaacggtaccctttccggttccgtcgttcg

SEQ ID NO: 100188 - DNA, 746 bp, Homo sapiens
  misc_feature: GYAE6OF02H4JXC.5.20.B09.1.454.CMB.1.raw
tcagatcagacacgcacgaccggtgctcgatttagtgtagtgtgaagtgcagctggtggagtctggggggaggcttggtacagcctggcaggtccctgagactctcctgtgcagcctctggattctacctttgatgattatgccatgcacgtgggtccgcaagctccgagggaaggcctggagtgggtctcgaggtattacgtaggtaataggtggtgacagtaggctagtggcggtacttcgtaggttacggaacgggtcccgtcctttaccaaccgaacttcccttaccgaacggaacggaacctaaaccgaccccgaaacggtaaacccttccccgttagttaacttaacctaaaccaaaatacgaactagttactagggaacgtaggttaggaacggaccgtaccggtcctttacctaagtttaccgtgttagaacgaaaaggtacggtacggggaacgtaagggttcgggtaggtcggcgtacgactaagttccgtaacgtacggtcggggtaccggtacgggtaacccgtcggtaccgtacccggttcctcctacgtaccgtacccgtaccgaccgaccggtcctacgtaccggttccttccccgtacggtcccctaccctccgtaccgaacgccgtactaaccgtcggtcgggaccgacggtaccggccggtacccggtcggccgttcgccggttcggtacggtaaccggttaccgtttaccgttcccggtgttaccgg

SEQ ID NO: 100189 - DNA, 839 bp, Homo sapiens
  misc_feature: GYAE6OF02HW6OY.5.20.B09.1.454.CMB.1.raw
  modified_base (215)..(215): a, c, t, g, unknown or other
  misc_feature (215)..(215): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtgggtccgcaagctccgagggaaggcctggacgtgggtctcgaggtattacgttaggaatagtggngacgataggactatgcggactcgtaggtgaacgggccgtcttaccgaactactctacccaagacgaaccaaacggaccctaaacgaaacctcccgtagtaacttaccgtaaaccaaaaagttgaaactacggttacctaggaagtaggttagaggtaccgaacggtctttacgtaattacgtgtacgaacgaaaaaggtcgtaacgggaacgtaaggttcgggtagggttacggcgttacgctaacgttacggaacttaccggtacggggtccgttaacggggaaccccggttagggtaccaacccgttaccgtaccgtaccgtaaccgtacccgttacccccgaaaaccggaaccggggacccctaacggttacccgttacccgttttaccccccggtaggtaacccccgtaacccccgttaccccgtaacccgtaaaacgtacccggtaaccctaaccccggtttcgggacccggggttacccgaaccggttaaaccggggcccccgggttaccccgtacccgggggtacccgttaccggtacccccgggtttacgggttaacccggtaaaacccggtttacccgttaaaccccggtttcccccggttagtttaaccccggg

SEQ ID NO: 100190 - DNA, 877 bp, Homo sapiens
  misc_feature: GYAE6OF02GNSJI.5.20.B09.1.454.CMB.1.raw
  modified_base (870)..(870): a, c, t, g, unknown or other
  misc_feature (870)..(870): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgaccagtgacacgtcgggtccggacaagcctaccgaaggggaacgggtcccgtagggtaggttcggggtaccttacgtaagggtttaactttaaccgtttagggtaaagttaagggttgggtacgtaacgtaagttaaggtccgttaagttcggtacccggtaactttccggttaagggtaacgggtaaaccggggtccccttacctttaacccgaaacccgttacgttacccgtaacccgtaaagggtaaccgaaaacccgaaacccggtaacccgaaaaacggttaaccccttaccccgttaggttaaaccttacccgtaaaacgtaaaacgtaacgtaaaaccgtacggttaccgtaaggtaacggtaaggtttaacggaaacggtacccgtacggttaccctttaacgttaactttacgtacgtaacgaaacgaaaaggtacgtacgggaaacgttaggtgggtggtacgacgtagacgaagttccgtaacgtacggtcgggaccgtaacggtaacccgtgtacctaccgtacctacccgtcgaccgtcctaaccgacccgaacgccctacgtcccgtcccgttacccgacgacccgttacccctaccgaacctaacggactcccgtaccgtaccgggtcgggaccaccggtaccggtcccggtacccgtggtaccgttccggtacgtacggtaaccggtaaccggttaccccttacggtttcccgngttaccg

SEQ ID NO: 100191 - DNA, 710 bp, Homo sapiens
  misc_feature: GYAE6OF02GMVE6.5.20.B09.1.454.CMB.1.raw
tcagatcagacacgcacgaccggtgctcgatttagtgtagtgtgaagtgcagctggtggagtcgtggggggaggcttggtacagcctggcaggtccctgagactctcctgtgcagcctctggattcacctttgatgattatgccatgcacgtgggtccggcaagctccgaggggaacgggcctgggagttgggtctcgtaggttattacgttggaatagtggtgacagtaggctagtgcggactcgtggtaggaacgggccgccttcaccctatcctacccagacgacaaaccgacccaaagaacctccctagtactactaacaaatacgaaactacgtctaggagtagttaggaggtaccacggtccttcttaacttacgtgtacgacaaaagtacgtacgggaaggtaaggtggtgggtcggtctggacctaagtaccgtacgtacggtcggggtcccggtacgggtaaccccgtggtacccgaccgttccgtcccctcgaccgtccctacccgaaccggaccgggaccctaccggttcccgttccccgttccccgtccggtcccctaccccgttccctacccgaaccgacgtcccgaaccgttccgggaccggggcctaccggacggcccgggacccgttcggggaccgttcccggaccgttacgggtaccgaaccggttaccgttacccgttcccggtgttaccgg

SEQ ID NO: 100192 - DNA, 732 bp, Homo sapiens
  misc_feature: GYAE6OF02HZ5KB.5.20.B09.1.454.CMB.1.raw
  modified_base (576)..(576): a, c, t, g, unknown or other
  misc_feature (576)..(576): n is a, c, g, or t
  modified_base (658)..(658): a, c, t, g, unknown or other
  misc_feature (658)..(658): n is a, c, g, or t
tcagatcagacacgcacgaccggtgctcgatttagtgtagtgtgaagtgcagctggtggagtctggggggagggcgttgggtacagcctggcaggtccctgagactctcctgtgcagcctctggattcacctttgatgattatgcctagtgcacgtcggggtccgacgaagctcccgaaggggaacgggcctgggagtggggtcctcgaggttattacgttagggaatgggtggtagaacgtagtaggtctaagtggaccggtacgttcgttagggcgggtaacggggtcccgtccgtttaccgacctacttcctaaccgagaccgaacaaccgaaccgaaacgtacctacccgtacgtaactacctaacaaacgtactaacgtaagttccgtaagtaggtacgtaggacggaacgtacccggttacgttacttacttacgtgtaacgtacgaaaacgtcgggtaacgaacgggtaaaggtttgggacggttacgggtacgtacgacgtaacgtaccgtacggtaaccggtccggggacgttaccgggaccgtacggtcctaccgtcctcacgccnccgtaccgaccgaccggctacgtccgccgttccccgacgtcccgtccctaccgaccgacgtccgacctcgacggtccggacnccgacggccggtcccgtagggcccgtacgtccggtcggaccggtcggtaacccgttacgttccggacgttccgg

SEQ ID NO: 100193 - DNA, 680 bp, Homo sapiens
  misc_feature: GYAE6OF02F8M3V.5.20.B09.1.454.CMB.1.raw
tcagatcagacacgcacgaccggtgctcgatttagtgtagtgtgaagtgcagctggtggagtctgggggaggcttggtacagcctggcaggtccctgagactctcctgtgcagcctctggattcactttgatgattatgccatgcactgggtccggcaagctccgagggaacgggcctggagtgggtctcgaggtattacgttggaatagtggtgacataggctatgacggactcgtggtagaacgggccgtcttcgaccagtcctaccagacgacaacgccaaagaacctccctagtactactaactaaatagaacagtctaggagtagttgaaggacacggtccttacttacttacgtgtgaacaaaaggagtacgggaacgtaaggtgggtagggtggtcgtaggacaaagtccgaacgttaccggtcggggtaccgtacgggtaacccgttggtcctaccggtcctcccgtacgacgtcccgtaccaaccggaccgggccctacgtccggttacccttccccggtacggccctaccccgtccgtaacccgaagtacctcgtacccgttcggggtacggggacctaaccggcgggtacccggtcccggttcggggtccctcggtacccgttacgggtaccgaaccgggttacctacccggtttcccggtagttcccg

SEQ ID NO: 100194 - DNA, 732 bp, Homo sapiens
  misc_feature: GYAE6OF02GDZNQ.5.20.B09.1.454.CMB.1.raw
  modified_base (158)..(158): a, c, t, g, unknown or other
  misc_feature (158)..(158): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtgggtccgnaagctccgagggaacggcctgggagtgggtctcgaggtattacttggaatagtggtgacataggctagtggcggtaccttcgtggtagaacggggcccgtcgtttaccaccctattccgtacccaagaacgaccaacccgacaaacggtacctcccgtagtatactaacaaatcgaactggtctaggaagtaggttagaacggtaccgacggttccttactattacgtcgtagaaccaaaagcgtacgggaacgtaaggtggttaggtcggacttcgaacctaaggtcgacgttacggtcggggtaccgtacgggtaaccgttcgttaccgtaacccgtcgtccctaccgtacggtacccctaccgtaacccgaacgggtacccctacgttcccggttccctttccccgtaccggtccctaccccgttacccgtacccgaaagacccgacccgtaccgtacgggttccggggacaacccggtccgggacccggtcccggtcgggtacccgtaccggtccggttacggtaccggtaaacccggttaccgttacccggttcccgttcggttacccg

SEQ ID NO: 100195 - DNA, 706 bp, Homo sapiens
  misc_feature: GYAE6OF02JYMGS.5.20.B09.1.454.CMB.1.raw
  modified_base (280)..(280): a, c, t, g, unknown or other
  misc_feature (280)..(280): n is a, c, g, or t
tcagatcagacacgcacgaccggtgctcgatttagtgtagtgtgaagtgcagctggtggagtcgtgggggaggcttggtacagcctggcaggtccctgagactctctgtgcagcctctggattccactttgatgattatgccatgctacgtgggtccgcagctccgagggaggctggagtgggtctcgtaggttacttacgttaggaattacggtggtagacagttagggactagtggccggtaacttcgtggtaggaacggggccctacttcgaacctntacctcgaggaacgacgaacgaccgaaacgtacccttcctagtactacctaacaaagtcgaacacgttcgtagaagtaggtggaacggaaccgtccggtacttacgttaattacgtcgtaagaactaaaaggtcgtacgggtaacgaagggttgggtggtacggtctacgaactagtccgtacgtcggtacgggcgtaccgggtaccgtgggtacctaccggttcctccgtaccgaccgtaccctccgaaccgaccggaccctcggtcccggttccttaccccgtccgtccctacccgtccgtaacctaacgtaccgccgtacccgtcgggtaccgggaccaaccggccggtacccgggccgttaggtccgttccgtaccggttacggaccgtaccgtaccgtttacccggttccggtacgttcgg

SEQ ID NO: 100196 - DNA, 653 bp, Homo sapiens
  misc_feature: GYAE6OF02II5IY.5.20.B09.1.454.CMB.1.raw
  modified_base (116)..(116): a, c, t, g, unknown or other
  misc_feature (116)..(116): n is a, c, g, or t
  modified_base (159)..(159): a, c, t, g, unknown or other
  misc_feature (159)..(159): n is a, c, g, or t
  modified_base (581)..(581): a, c, t, g, unknown or other
  misc_feature (581)..(581): n is a, c, g, or t
  modified_base (587)..(587): a, c, t, g, unknown or other
  misc_feature (587)..(587): n is a, c, g, or t
  modified_base (597)..(597): a, c, t, g, unknown or other
  misc_feature (597)..(597): n is a, c, g, or t
tcagatcagacacgcacgaccggtgctcgatttagtgtagtgtgaagtgcagctggtggagtctgggggagcttggtacagcctggcaggtccctgagactctcctgtgcagcctntggattcacctttgatgattatgccatgcacgtcgggtccganaacgcctaccgaggggaacggtcctggaggtgggtctcgtaaggttattacgttaggaaattaggtggtagacagtaggtctagtcgcggactcgtggtacggaacggccgtcttcacctacgtctccagacaacgaaccgccaaagtacctcctagtactacgtaactaagtacgaactagtcgtagaacgtagttaggacgtaccgtaccggtaccttttacgtaacgttcgttggtacgtaaacgaaaaaggtcgtaacggggaacgtaaggttgggttacgggtcgtacgtggtaacgtaacgtacgtacgtacggtcgggcgtacggtaccgtcgtaccgtaccgtctcctcgaccgtcctaccgaccgaacgcctcgtccgttcccgtcccgtacgaccctcccgtacctacgacncgaccncgtcgcggcncgacgcggccgtgggtaccgtcgcgtcgacgtaccgtacgttaccgtcgtacgtcg

SEQ ID NO: 100197 - DNA, 857 bp, Homo sapiens
  misc_feature: GYAE6OF02IRNN5.5.20.B09.1.454.CMB.1.raw
tcagatcagacacgcacgaccggtgctcgatttagtgtagtgtgaagtgcagctggtggagtctgggggaggcttggtacagcctggtaggtccctgagactctcctgtgcagcctctggattcacctttgatgattatgccatgcacgtcgggtccggacaagcctccgaggggaacgggcctgggaggtgggtctcgaggttattacgttggaatagtggtagacagtacggactagtggacggtacttcgtggtaggaacgggtcccgtacttaccgaacctataccctaccgaaggaacgaaccgaaaccgaccctaaaacgtaacccttccccgtaagttaaccgttacctaaactaaaagtacggtaaaccgtacggttaccgtaggtaacgggtagggtttacggaaccgggtaaccgtaccgggttaccctttacgttaactttaccggttagtaacgaaacgtaaaaacgggtacggtacggggaaacggttaagggttggggtacgggtcggtcgtacggtaactaacgtttaccgaccgtacggggtcccggggtaccgtaacgggacccggttacggtcccgtaccgtcccgttacctccgacgtacccctaccgtaacccggaaccggtaccctacggttcccggtaccccgtttcccccgtacggacccccttaccccgtcccgtaaacccggtaacgacccgtacccgtaccggtccggggccggggtaaccaccggaccgggtccccgggtcccgggttccggggtctcccgggtccggttaccggtaaccggtacccggtttaaccgtttcccccggttaccgggttacgtaggtaccgg

SEQ ID NO: 100198 - DNA, 811 bp, Homo sapiens
  misc_feature: GYAE6OF02FT0IY.5.20.B09.1.454.CMB.1.raw
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctcggattcacctttgatgattatgccatgctactgggtccggacgaagctccaggggaagggcctggnggtgggctcaggtnttacgtgaagtagttggtgacagtagctagtgcggtactctggtagaacggggtcccnccgttacacccgtatccgtacccgtaagagtaacccgaacggcccaaaacggtaccctcccctaggtactactaacaaacgttagaaccgtagttaccgtagaaaggtgttacgaaagggtaaccacccgggttactttacccggtaaattaccgttagttacgaacgtaaaaacggtggtaccccgggtaacgtaagggtggttacggttacgggcctaggtaacgaacgtccggaccgttaacggtccggggtaccggtaaccggtacccgggtacgtaccggtaacccggtcccttacccgtcgtccgtacccgaccccgttaacccgacccggacccgtacgtacccggttcccgtttaccccggccgttacccgtacccccgtacccgtacccgttaacccggtacgcccgtaacccgtccggtaaccggggtaccctaaccggtacccggggtccccgtacccgggtccgggacccgggttccggaccccggttacgggaccgggttaaccgggtaccccgttacccggttcccggttcccgtaacgg

SEQ ID NO: 100199 - DNA, 711 bp, Homo sapiens
  misc_feature: GYAE6OF02GSPU8.5.20.B09.1.454.CMB.1.raw
  modified_base (274)..(274): a, c, t, g, unknown or other
  misc_feature (274)..(274): n is a, c, g, or t
  modified_base (368)..(368): a, c, t, g, unknown or other
  misc_feature (368)..(368): n is a, c, g, or t
tcagatcagacacgcacgaccggtgctcgatttagtgtagtgtgaagtgcagctggtggagtctggggggaggcttggtacagcctggcaggtccctgagactctcctgtgcagcctctggattctactttgatgattatgccatgcacgtggggtccggcaagcctccgaaggggaacgggccgtgggagttgggtctcgaggttattacgttggaatggtggtagacagtaggctagtcgcggtactcgtgtcggacggccgtcttcacctntcctccagacgacaacgaccaagacctcctgtactactaacaagtacaacagtctagagtagtaggaggaccgtacggtaccttactacttacngtacgaacgaaaagtcggtacgggaagtaaggttgggttagggtcggtacgtcggaaccttaacggtcggtaacccgttacgggtccggggtaccgtaccggggtaacccgtcggtaccgacccttccgtccctacgaccttcccgacccgtaccggaaccggtccctacggttcccgttcccttcccggtaccgtcccctacccgtcccgtaaccgaaccgtcgaccctaccgtacggggccgggaccaccggaccggtcccgggtcccgtagggtccccgttcggcccggttacgggtaccggtaaccggttcccgtttacccgttcccggtagttcccgg

SEQ ID NO: 100200 - DNA, 714 bp, Homo sapiens
  misc_feature: GYAE6OF02IYXII.5.20.B09.1.454.CMB.1.raw
  modified_base (162)..(162): a, c, t, g, unknown or other
  misc_feature (162)..(162): n is a, c, g, or t
  modified_base (183)..(183): a, c, t, g, unknown or other
  misc_feature (183)..(183): n is a, c, g, or t
  modified_base (296)..(296): a, c, t, g, unknown or other
  misc_feature (296)..(296): n is a, c, g, or t
tcagatcagacacgcacgaccggtgctcgatttagtgtagtgtgaagtgcagctggtggagtcgtggggggaggcttggtacagcctggcaggtccctgagactctcctgtgcagcctctggattcacctttgatgattatgaccatgcacgtgggtccggnagctacgagggacggctgggngtggtctcgaggtattacgttggaataggtggtagacagtaggctagtggccggacttcgtggaggaacgggtccgtcttcaacctctctaccgacgacaaccacgaccaaanaacccttccgtgtaactctaacaaagtcgaactagtcaggatacggtggaacgaccgtacggtctttactaattcttacggagtaaacgaaagtacggttcgggaaaggtaggttggtagggcgtacggtacgaacaacggttaccggtaacggttcgggtacggggttacccgtaccggggtaacccggttggtacccgtacccgttccgttaccgccgtaccggaccctacccgacgggaacccggtcctacgttcccgttcccccgtccgtacgccccgttacccctcgaccgtaagaccctccggtacccggtacggtccggggcctacccgggtcggcccgggttaccccggtcgggcttcccgggtacgttccggtaacacccgggtttacttcccggtttcggacgttccg

SEQ ID NO: 100201 - DNA, 788 bp, Homo sapiens
  misc_feature: GYAE6OF02GMRR9.5.20.B09.1.454.CMB.1.raw
  modified_base (307)..(307): a, c, t, g, unknown or other
  misc_feature (307)..(307): n is a, c, g, or t
  modified_base (776)..(776): a, c, t, g, unknown or other
  misc_feature (776)..(776): n is a, c, g, or t
tcagatcagacacgcacgaccggtgctcgatttagtgtagtgtgaagtgcagctggtggagtctgggggaggcttggtacagcctggcaggtccctgagactctcctgtgcagcctctggattcacctttgatgattatgccatgcacgtgggtccggcaagctccgagggaaggccgtggagtgggtctcgaggttattacgttggaataggtggtagacagtaggctagtggcgactctgtggaggccgcttcaccatctcgagagacaacgcaagacctccctgtactctaactaatacgaacncgtctagacggtagttggacggactaccggtcctttcttaagtttacgtggttacaacgtaaaaagtggttaccggggaacgtaaacggttggggtaggtcgggaccttggaacctaagttccgggtaacctaacgggtcgggggtaccgtaccggggtaacccgttcgggtacctaacccgggttccttacccgtaccaccggtaccccgtacccgtaacccggtaacggggaccccgtaacggtttccccggttacccgtttccccccgtacggtcccccggtaccccctttaacccggtaccccgtaaaggtacccgtaaccccgtacccgttaccgggttccgggggacccaccggtaaccggggccccggggtacccggttcgggggtacccgttccgtaccccggggtttacggtacccgtaaaacccggggtttccccgttttaacccggtttccccgggtntttaaccccggg

SEQ ID NO: 100202 - DNA, 1020 bp, Homo sapiens
  misc_feature: GYAE6OF02I6L74.5.20.B09.1.454.CMB.1.raw
tcagatcagacacgcacgaccggtgctcgatttagtgtagtgtgaagtgcagctggtggagtctgggggagcttggtacagcctggcaggtccctgagactctcctgtgcagcctctggattccacctttgatgattatcgaccatgcacgtggggtccgacaagcctccgaaggggaacgggcctagggtaggttcgggtctacgtaggttaactttacttaggaagttacggtgggttagaacgtagtacggactaacgttggaccggtactcggttaggtacgggaaacgggtcccgttacttaccgaaccgtacttaccgacccgaaggtaacgaaaccccgaaacggacccaaaacggtaaccccttccttaacggttaaccttaccgtaaaacgtaaaacgttacggtaaaacccgagttacggtaacggaacgttaagggttacggaacgggttaacccgtaccgggtcccctttttaaacgttaacgttttaaccggttagggtaaacgtaaaacgggtaaaaacgggttacgggtaaaccccggggggtaaagggttaaacggggttcggggttaaggggttaccgggccgttaaaccgggaacctaaacggtacccggtttaaaccggttaccggggttaacccggggggtaccgggtttaacccgggggttaaaccccggtttcgggtaaccccgttaccccgggtttcctaacccggtaccggacccgttaacccgggtaccccgaaaaccggggttaccccgggaaccctttaacccggtttacccgggtttcccccttccccggttaccgggtacccccctacccttacccggtaacccgaaccggtaccgtacccccggttaagggtcccggggtaaccggggaccctaaaccggggtcccgggttaaacccggggtccccgggttgtaccccggttcgggtacccgtttaaagggcccgggttaaaaccccgcggtttaaccccgggtttaccttacgggtccg

SEQ ID NO: 100203 - DNA, 898 bp, Homo sapiens
  misc_feature: GYAE6OF02HXGJS.5.20.B09.1.454.CMB.1.raw
tcagatcagacacgcacgaccggtgctcgatttagtgtagtgtgaagtgcagctggtggagtctggggggaggcttaggtacagcctggcaggtccctgagactctcctgtgcagcctctggattcacctttgatgattatcgccagtgcacgtgggtccggcaagctccgagggaggcctggaggtggtctcgaggttacttacgttaggaacgtaaggttggtagacgtaagtagggactaagttcggccggtaaccttcgtaggtacgggaacgggggtcccgtaccgtttacccgaacccttaactccgttacccgaaggaacggtaaaccgaaacccggaaacccgtaaacggtaaaccccttaccccgttacggttaaccttaaccgtaaactaaaacgtacggaaacctacgttacgtagaacggtagttacgggaacggtaaccgtaccggtacctttactactttaaccgtgtaacgtaacaaaacggtcggtaacgggaacgtaaagggttagggtacggtaggacgttagacgtaacgttaccgtacgttaccggtacggggtacccgtaccgggtaacccgttcggtaccctaccggttacccgttccgtacctaccggtaaccctaccccggaaacccgttaaccgggtacccgtaccggtacccggtttccccgttaccccccggttcgaccccgttacccccgttacccggtaacccgtaaacggtacccggaccctaacccgggttaccggacccgggggtacctaacccgggccggggtaaccccggtcccgggttaccgggaccgtttacccggtaccggttaccgggtaccggtaaaccgggttacccctttacccgggttcccggttaccgttaccgg

SEQ ID NO: 100204 - DNA, 717 bp, Homo sapiens
  misc_feature: GYAE6OF02JZ6CW.5.20.B09.1.454.CMB.1.raw
  modified_base (123)..(123): a, c, t, g, unknown or other
  misc_feature (123)..(123): n is a, c, g, or t
  modified_base (168)..(168): a, c, t, g, unknown or other
  misc_feature (168)..(168): n is a, c, g, or t
  modified_base (198)..(198): a, c, t, g, unknown or other
  misc_feature (198)..(198): n is a, c, g, or t
  modified_base (381)..(381): a, c, t, g, unknown or other
  misc_feature (381)..(381): n is a, c, g, or t
  modified_base (481)..(481): a, c, t, g, unknown or other
  misc_feature (481)..(481): n is a, c, g, or t
tcagatcagacacgcacgaccggtgctcgatttagtgtagtgtgaagtgcagctggtggagtcgtgggggaggcttggtacagccgtggcaggtccctagagactcctccgtgtcgcagcctntcggattcacctttgatgacttatcgccatgcacgtgggtccganagcctcgagggacggcctgggatgggttcncgaggttacttacgttaggaattggtggtagacaagtggcttagtcggaggtaccctgtcgggtagaaccgggtcctacttccgaaccgagttacctcccgaaggaaacggccctaaacggtcccgtaaaacggtaacccttcccgttagtaaaccgtctaaacgtaaacttgaaaaccggtnttacgtaggtaagtacggtaggaaccgtacgtcggttacttacgttatacgtgacgtaaacgtaaacggtggtacgggaagttacgggtggtcggtacgnggtacgtaactgtacccggtacgtaggtaccggtccgtaccggtaccgtacggtaccgtacggtccgtcgtaccgcgtccgtaccgaccgaccggtaccgccgtaccgttccctcccgtaccgttacccgtacccgtccgtacgaccgtcgacgtaccgtaccgcggccgtacgccggccggtaccgccggtaccgtcgccgttcgaaccggtacgtccgttacggtcctcgtacg

SEQ ID NO: 100205 - DNA, 894 bp, Homo sapiens
  misc_feature: GYAE6OF02HX80J.5.20.B09.1.454.CMB.1.raw
  modified_base (390)..(390): a, c, t, g, unknown or other
  misc_feature (390)..(390): n is a, c, g, or t
  modified_base (431)..(431): a, c, t, g, unknown or other
  misc_feature (431)..(431): n is a, c, g, or t
tcagatcagacacgcacgaccggtgctcgatttagtgtagtgtgaagtgcagctggtggagtctggggggagggcttggtacgagcctggcaggtccctgagactctcctgtgcagcctctggtattctacctttgatgtattatgccatgcctacgttcggggtccggtcgaagccgtccgaaggggaagggccgtagggtaggttggggtctcgtagggttaatttacgttagggtaaattaggttgggtgtacagttggtactagtcggacggtacctcttggtacggaacggggcctcgttacccacctactcctccaagaacgtaccaaaccgtaccaaacgtaaccttcccgtagtactaccttaacgaaatacgaacagttcngagtgtaggacggtacgccggtacttacgtattacgtgtanaacgaaagagtaccgggaaggtaacggtgggtagggcgtcgtacgtacgtaacgtacccgtacgttacgggtacgggggtacccggttaccggggaaaccccgtttcggggttaacccgtacccggttccccgtttaccccgtaccgtacccggtaaccccgttacccccggtaaaccccgggaacccgggtaaccccgttacccggtttacccccgggttttcccccgttacccccccgggtttacccgggtacccccctaacccccgtttacccccgacccggttaaaccggtaacccgtcccggtaaacccccggtttccggggttacccggggcccgtaaacccggcccgggtccccggggtccccggttaggggtcccgttcccgggttacccggttacgggtaccggtttaaacccggtacccggttttaaccgtttccccggttacggtttcccgg

SEQ ID NO: 100206 - DNA, 750 bp, Homo sapiens
  misc_feature: GYAE6OF02J1UQB.5.20.B09.1.454.CMB.1.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
tcagatcagacacgcacgaccggtgctcgatttagtgtagtgtgaagtgcagctggtggagtctggggggaggcgttggtacagcctggcaggtccctgagactctcctgtgcagcctctggattcacctttgatgattatgccatgcactgggtccggcaagcctccgagggaacgggcctgggaggtgggtcctcgaggtattacttgggaataggtggtgactataggctatggcggactcgtgtgaacgggccgcttcaccatctcngagacaacgccaagaacctcccngtactctaacaaatgaacacgtctggagtagtgaggacacgccttactactactgtacgactaaaaggcgtacgggaacgtaaggtgggtaggtgggtacctggactaagtacgacgttacgtacggggccgttacgggtaacccgtgggtccgaacccgttcctcccgtacgaacccgccccgttacccgaacccggtaaaccgggcccccgtaaacgttccccggggttaacccctttccccccgggtacgggtacccccgtacccccttaccccgttaccccgaaacgggttacccggacccttaaccccgggttaccgggtccgggggtaccccaaccgggtacccgggcccggggttaccccgtcggggacccgttccgggtacccgttaccggggttacccaaaaccgggggtccccttttaacccgggttccccggttaccggttaccg

SEQ ID NO: 100207 - DNA, 759 bp, Homo sapiens
  misc_feature: GYAE6OF02H80AR.5.20.B09.1.454.CMB.1.raw
  modified_base (142)..(142): a, c, t, g, unknown or other
  misc_feature (142)..(142): n is a, c, g, or t
  modified_base (156)..(156): a, c, t, g, unknown or other
  misc_feature (156)..(156): n is a, c, g, or t
  modified_base (187)..(187): a, c, t, g, unknown or other
  misc_feature (187)..(187): n is a, c, g, or t
  modified_base (438)..(438): a, c, t, g, unknown or other
  misc_feature (438)..(438): n is a, c, g, or t
tcagatcagacacgcacgaccggtgctcgatttagtgtagtgtgaagtgcagctggtggagtctggggaggcttggtacagcctggcaggtcctgagactctcctgtgcagcctctggatttcactttgatgattatgcatncactgggtaccggnaagctccgaggggaggcctggagtgggtctnaggtattacgtggaatagtggtgacagtggctagtgccgtatctagtggaacggccgtcgtacaccgtatcctacgagaacgaccaaccgacccaaaggtaaccctcccgttagtactaccttaaacaaacgttccgaaacgtagttacgtaggtacgtaggtttacgacgggactaccgggttactttacctgtttaacgtggttagtaaacgaaaacggtgtaccggggaaggtaacggtgggtacggnggttacgcgacgtaactcgtaacgtaccggtggtccgtacgggtacccgttacggtactacccggttcctcccgtaccgaccgacccgtttaccgacccggaaccgggtaccccgtacgtccccgggtttacccctttacccccggtccggtaccctaacccccgttaccgtacccgtaacccgggccgtaaccctacccgttccgacgggtacgtaccggaaccgtcccgggtcccgggtacccgtggggtcccgtcggtaccccgtttcggggtaaccgttacccggggtacccttttacccgggttacccgttaccgg

SEQ ID NO: 100208 - DNA, 576 bp, Homo sapiens
  misc_feature: GYAE6OF02FNNXG.5.20.B09.1.454.CMB.1.raw
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (496)..(501): a, c, t, g, unknown or other
  misc_feature (496)..(501): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
  modified_base (562)..(563): a, c, t, g, unknown or other
  misc_feature (562)..(563): n is a, c, g, or t
  modified_base (566)..(567): a, c, t, g, unknown or other
  misc_feature (566)..(567): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
tcagatcagacacgcacgaccggtgctcgatttagtgtagtgtgaagggccgattcaccatctccagagacaattccaaaaaagatgttatatctgcaaatgaacagcctgagacctgaggacacggctgtatattattgtgtgacggggactcaactcgtcgggggacccactttgacaaggtggggccaggggaaccccggtcatccgtctcctcacgccctccaccaacgggcccatccgggttccttccccctcgacctacccccttcctacccaaggaacgcctaaccgtcggtcggggggccacgaccgggccgggtccccgtagggggtccctcggtcccgtagggttaccaaacggggtaccctttaacccggttccccggtccgttacgtcggtaacttcggtggaacgggtcgggcgttacggggaccgaacgggtcggacctaagtaggctagcgtnacgatcgcgnaacgtgcatcgctagccnnnnnngngtncncngcntntgncncgncncngngtntcncnngtnacancagntntgctcgngcanncannagatgngtn

SEQ ID NO: 100209 - DNA, 505 bp, Homo sapiens
  misc_feature: GYAE6OF01C42WW.24.45.E01.1.454.CMB.1.raw
  modified_base (424)..(424): a, c, t, g, unknown or other
  misc_feature (424)..(424): n is a, c, g, or t
  modified_base (480)..(480): a, c, t, g, unknown or other
  misc_feature (480)..(480): n is a, c, g, or t
  modified_base (502)..(502): a, c, t, g, unknown or other
  misc_feature (502)..(502): n is a, c, g, or t
tcagactactatgtcacgaccggtgctcgatttagtgagtcagtaagggaaaggacacagcatggacatgagggtccccgctcagctcctggggctcctgctactctggctccgaggtgccagatgtgacatccagatgacccagtctccatcctccctgtctgcatctgtaggagacagagtcaccatcacttgttgggcaagtgagaccattagcagctctttgagttggcatcaaattcaaaaccagggaaacgcccctaaacctcctgatctatactgcgtcaatttacacagtgggtccatccaggttcagtgcaatggatctgggacagagtttcactctcaccatcagcagtctgcaacctgaagactttgactaacttactatttgtacaacagtagttacacggtttcccccgtnaaccgttcggacgggaggacctagggtggagatcaacacgaactgtggctgcacgntctgtcttcattccttcccgcntac

SEQ ID NO: 100210 - DNA, 645 bp, Homo sapiens
  misc_feature: GYAE6OF01BEYTG.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagcctggggcctcagtgaaggtctcctgcaaggcttctggttatacttttaacacctatggtatcacctggtgcgacaggccctgggcaaggcttgagtggatgggatggatcagcgattatagtaggaaacacaaactatgacaacagtaaagtttcggggacagacgtacaacagtacgaccacgagacacactaccgacggaccacgacgaccctacacgtaggagtacggtaggggacgcccgtaggaaccctaccgtcggaaccggaccgaccgggtccggttagttaacgttacgtggtacggacggtaagagaacgttaacgtcccgtaccggttacgtaagggttaccggggacccgttcggtcccgttaacgggtccggggacccggtaaccgggtaaccccgttgggttacccttcccggtccttaccccgg

SEQ ID NO: 100211 - DNA, 721 bp, Homo sapiens
  misc_feature: GYAE6OF01DA2IT.24.45.E01.1.454.CMB.1.raw
tcagactactatgtcacgaccggtgctcgatttagtgagtcagtaagggaaagggacccaaaaaccacacccctccttgggagaatcccctagatcacagctcctcaccatggactggacctggagcattccttttctggtggcagcagcaaccggtgccctctcccaggttcagctggagcagtctggagctggaggtgaagaagccgtggggcctcagtgaaggtctcctgctaaggtttctggttattacttttaacacctatggtatcacgtgggtgcgacacggccctgggacaaggcttgaggtggagtgggatggatcgagcgtaatttaataggtaggaaaacactaaaacgtatgaacaacgaaaggttaaacgtttcgggggacaaggtaacgtaccaaacctagtacggaacccaaacgaacggaacccaacgtaacgtacccgaacccgggacccaaacgaaccgacccttaacgaagtacgggacggtccggtaggggaccgtcccgtaggaacccgtacctacggaaccgacgaccgggtccgttagtaacgttacgtcggtagaccggtaagtaacgtaacgttaacgttccgggtaccgttaccggtaacgggtttaccggggaaccttccggtacccgtacgggttaccgggggacccgtaacggggtaacccctgggtaccctcccgttcgtccccgttaccg

SEQ ID NO: 100212 - DNA, 547 bp, Homo sapiens
  misc_feature: GYAE6OF01BP6W6.24.45.E01.1.454.CMB.1.raw
  modified_base (428)..(428): a, c, t, g, unknown or other
  misc_feature (428)..(428): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcgagcgattatagtaggaaacacaaaactatgacacagaaatttcggggacagagtcacatgaccacagacacatccacggccacacgctacatggaagcgtggggacncctgaccaccgtgacgacacggccgtgtaattactgtgcgagagataatcgccgttacgaggttacgggactggccgtacgtcggggacctacgggaaccctgggtcctccgtctcccg

SEQ ID NO: 100213 - DNA, 538 bp, Homo sapiens
  misc_feature: GYAE6OF01A3BZY.24.45.E01.1.454.CMB.1.raw
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatgcacagaaatttcggggcagagtcacatgacacagacacactccacggccacagacctanatggagcgtggggacncctagaccacctgacgacgacggccgtgtacttacgtgtgcgagagataatcgcgttcgaggtttcgggactggcctacgtggggaccacgggacccttggtcctccgtctcccg

SEQ ID NO: 100214 - DNA, 597 bp, Homo sapiens
  misc_feature: GYAE6OF01CRNU0.24.45.E01.1.454.CMB.1.raw
  modified_base (384)..(384): a, c, t, g, unknown or other
  misc_feature (384)..(384): n is a, c, g, or t
tcagactactatgtcacgaccggtgctcgatttagtgagtcagtaagggaaaggggacccaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggtctcctgcaaggcttctggttatacttttaacacctatggtatcacctgggtgcgacaggccctgggcaaggcttgagtggatggatggatcagcgattatagtaggaaacacaaactatgacaacaagaaagtttcgggacagagtcacatcgacanagacacatccacgccacagacctacatggagcgtggggacgccgtagacaccgtaggaccgaacgaccgggccgttagttacttacgtgtagacggaagagaattaagtccggaccggttagacgggtttaacggggacccttcggacccgttacggtcgggggacccgtaaccgggggaaccctgggttacccttcccggtccgttaccccg

SEQ ID NO: 100215 - DNA, 579 bp, Homo sapiens
  misc_feature: GYAE6OF01DHEZ4.24.45.E01.1.454.CMB.1.raw
  modified_base (393)..(393): a, c, t, g, unknown or other
  misc_feature (393)..(393): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcactggtgcgacaggcccctgggcaaggacttgagtggatgggatggatcagcgattatagtaggaaacacaaactatgcaacagtaaagtttcggggacagagtcacatgaccacagacacacnccacggccacacgacctacatcggaagcgtggggacgccgtgacaccgtgacgacgacggccgtagtacgttacgtgtcgacgtagagtataactcgtccgttgaggttacggggaccttggcccgttacggtcggggacccgtaacggggtaaccccttgggtcccttcccggtccgttaccccg

SEQ ID NO: 100216 - DNA, 684 bp, Homo sapiens
  misc_feature: GYAE6OF01C3PJ9.24.45.E01.1.454.CMB.1.raw
  modified_base (559)..(559): a, c, t, g, unknown or other
  misc_feature (559)..(559): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctggaggtgaagaagccgtggggcctcgagtgaaggtctcctgcaaggtcttcgtggttattacttttaacactatggtatctaccgtgggtcgcgacgacggccccgtgggacaaggtacttggaggtggagtgggatggatcgagcgtattagtaagtaggaaacactaaaactatagacaacgaaggtaaaacgtttcggggactaaggacgttaccaaccgtatacggaacccaagacgaacaacactacccgaccggaccaccgacgaccctaacgtacgtagggacgtacgggtacggggacgtccgtacgaacctaccgtacggaacgaccgtaaccgggtcgtacgttagttacgtgngacgagtagaacgtaacgtccggtacgtttacgacgggtttaacgggacccgttacggtcccgtacgggtcccggggaacccgtaccgggtaacccggttcggttcccgtcccgttccgtacccg

SEQ ID NO: 100217 - DNA, 951 bp, Homo sapiens
  misc_feature: GYAE6OF01D2S0V.24.45.E01.1.454.CMB.1.raw
tcagactactatgtcacgaccggtgctcgatttagtgagtcagtaagggaaagggacccaaaaaccacacccctccttgggagaatcccctagatcacagctcctcaccatggactggacctggagcattccttttcttggtggcagcagcaaccggtgccctctcccaggttcagctggagcagtctggagctggaggtgaagagccgtgggcctcgagtgaaggtctccgtgacaaggtcttctggttattacttttacacttatgtatctacgtggtgcgacgacggtcccgtggacaaggtactgaggtggagtgggatggatcgagacgtattagtagtaacggaaaactaactaaactagtagacgtaaacgtaaacggttaaaacggttttaccggggggacaaaggtaaccggttaacccgaaacccgtaaacggtttaacccggaaaacccgaaaccgtaaaacggaaaccctaaacccgtaaaccgttaaccccggaaacccgggaacccccaaccgggtaaacccggtaaccccttaaaacggtaaccggttacgggggtaaaccgggacccggggtaaacggggggtaaccgttaaccccggttaacgggaaaccccggttaaccccgggttaaccgggaaacccgggtaaaccccgggtaacccggggttacccggttttaaaccggtttaacccgttttaaccgggttaacgggttaccgggaaccggttaaacgggtaacggttaaaccttaaacgggttacccccgggtttacccggttttaaccgggttaaaccggggggtttaaccggggttaacccgttaccggttaccccgggttaacccggggtttaccgggggaaacccccggttaaccggggttaaacccccggttaccggtttaccccgggttccccgtttcccggtttaacccccg

SEQ ID NO: 100218 - DNA, 565 bp, Homo sapiens
  misc_feature: GYAE6OF01DHVNI.24.45.E01.1.454.CMB.1.raw
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (372)..(372): a, c, t, g, unknown or other
  misc_feature (372)..(372): n is a, c, g, or t
  modified_base (557)..(557): a, c, t, g, unknown or other
  misc_feature (557)..(557): n is a, c, g, or t
tcagactactatgtcacgaccggtgctcgatttagtgagtcagtaagggaaaggacacagcatggacatgagggtccccgctcagctcctggggctcctgctactctggctccgaggtgccagatgtgacatccagatgacccagtctccatcctccctgtctgcatctgtagganacagntcacatcacttgtggcaagtgacgaccattagcagcttctttgagttgcatcaattcaaaccgaggaaacgaccctaactcctagactctatactgccgtactaatttacacgtaggtcgggtacccactaccgtaggttcaggtcggactaagtgatcgtgggacaggtacttcactctacactatcganctagtctgacaaccgtagaagtactttgactaaacttactacttgacaaacagtacttacctacggtcccccgtactaccgttcgggcgggaacggtaccgaagggtacggaagtactacgaactaacgtaacgttggtacgcgtacgaccacctagtctcgttacttctacttcccttacccgntacttacg

SEQ ID NO: 100219 - DNA, 693 bp, Homo sapiens
  misc_feature: GYAE6OF01CP9XM.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctggaggtgaagacgccgtggggcctcgagtgaaggtctcctgacaggtcttcgtggttacttacgttttaacaccttatggtatcgtaccgtgggtgcgacgcggccccgtgggacaaggtcttggaggtggagtgggatgggatcgaggtacgtattagtaggtaacggaaaactacgtaaattagtagaaccgtaacgaaggttaaaacggtttcgggggactaacggtaacgtacccgaacgtaataccggaaccaacgacgaaccacactacccgacgaccacacgacctacagacgagtcggtacgggacgtacgtcgaacgaccgtcggaaccgaccggtacggtccgttaggtacttacgtggtacgacggtaagtacgaagttacgtaccggtacggttacgaaggggtttcggaccgttcggtaccggtaccgggtaccgggtacccggaaaccgggttacccgtcgggttcctcccggttcgtaccccg

SEQ ID NO: 100220 - DNA, 563 bp, Homo sapiens
  misc_feature: GYAE6OF01CLHJV.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcgagcgtattagtagtaggaaacacaaactatgacacaagaaagtttcggggacagagtcaccatgaccacagacacatccacggccacacgacctacatggacgcgtaggggacgccgtgacaccgtcgacgacgacggccgtagtagttacgtgtgacgagagaatacgtcgtacgttacgtaggttacgggactcggccgtacgtcgggaccgacgggacccgtggtcctcccgtctcccg

SEQ ID NO: 100221 - DNA, 634 bp, Homo sapiens
  misc_feature: GYAE6OF01BP9OS.24.45.E01.1.454.CMB.1.raw
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcacttgttggcaagtgagaccattagcagcttctttgagttgcatcaattcaaacaggaaagccctaactcctagatctatactgcgtccaatttacacagtgggtccatccaggttcagttggacaagtggatcgtgggacagagttcacgtctcacatcagcagtctgacaactgaacgtactttgactaactttactatttgtacaaactagtaacgtttacgtacgtttccccgggtactaacccgtttccgggaccgggtacgggtaacccgtaaagggttcgggaaacgtaccgtaccgtaaccgtaaccgtaaccgttgggtaacgggtacccgttacggacccgtaaacccgttacgttacccgtttaccgggttaccccttttccgtaaaccttttccccggtttacccccggtacccgttaacgtttaaccccgg

SEQ ID NO: 100222 - DNA, 673 bp, Homo sapiens
  misc_feature: GYAE6OF01EG6M8.24.45.E01.1.454.CMB.1.raw
  modified_base (279)..(279): a, c, t, g, unknown or other
  misc_feature (279)..(279): n is a, c, g, or t
  modified_base (350)..(350): a, c, t, g, unknown or other
  misc_feature (350)..(350): n is a, c, g, or t
  modified_base (454)..(454): a, c, t, g, unknown or other
  misc_feature (454)..(454): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcgagtgaaggtctcctgcaaggcttctggttatacttttaacacctatggtatcacctgggtncgacacggccctgggcaaggcttgagtggagtgggatgggatcgagcattagagtacggaaacacaaactntcgacaactagtaaagtttcggggacagacgtcaaccatacgacacgagaccaacactaccgacggaccaacgacgacctacgagtacgggagtcgtggggacnccgtacgaccacgtagaaccgacgtaccggtccgttagttaacgtttaccgtggttaccggacgtaaggtaacgtaacgttaaacgtcccgggttccgttaccggtaagggttttaaccgggggacccttcgggtaccccggttaacgggtccggggggaccccgtaaaccggggttaaccccgttgggttcccccgttcccggttccgttacccccgg

SEQ ID NO: 100223 - DNA, 489 bp, Homo sapiens
  misc_feature: GYAE6OF01DXBT5.24.45.E01.1.454.CMB.1.raw
  modified_base (477)..(477): a, c, t, g, unknown or other
  misc_feature (477)..(477): n is a, c, g, or t
tcagactactatgtcacgaccggtgctcgatttagtgagtcagtaagggaaaggacacagcatggacatgagggtccccgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccaggggccccatcaaggttcagcggcagtagatctgggacattcttcaccttcaccatcagcggcctgcagcctgaggatggttggcacatattactgtacaacaatatgacatatgtactacttttgggccaggggacgtaagggtggagctagaaacgactggtgctgcaccatctgtcttnactctcccgtac

SEQ ID NO: 100224 - DNA, 653 bp, Homo sapiens
  misc_feature: GYAE6OF01C5X5Z.24.45.E01.1.454.CMB.1.raw
  modified_base (397)..(397): a, c, t, g, unknown or other
  misc_feature (397)..(397): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagcctggggcctcagtgaaggtctcctgcaaggcttctggttatacttttacactatggtatcactgggtgcgacaggcccctggcaaggacttgagtggagtgggatggatcagcgtattagtagtaggaaaacacgaaaactatgacacgaagtaaaagtttcgggggacagagtcaacctatgaaccanagaacacactaccgaacggccaacagacctacgacgtaggaacgcgtagggggactccgtgaccgacctacggaaccgaccgaccggtccgttagttaagttaccgttaggtacgacggaacgtagtaagttaaaccgtcggtccggtttaccgtaagggtttaccgggggaccctttcggtacccgttaccggtgggggacccgtaaaccggggtaacccccgttgggttaccccgtcccggttccgtacccccg

SEQ ID NO: 100225 - DNA, 748 bp, Homo sapiens
  misc_feature: GYAE6OF01CTD7R.24.45.E01.1.454.CMB.1.raw
  modified_base (612)..(612): a, c, t, g, unknown or other
  misc_feature (612)..(612): n is a, c, g, or t
  modified_base (722)..(722): a, c, t, g, unknown or other
  misc_feature (722)..(722): n is a, c, g, or t
tcagactactatgtcacgaccggtgctcgatttagtgagtcagtaagggaaaggggacccaaaaaccacacccctccttcgggagaatcccctagatcacagctcctcaccatggactggacctggagcatccgttttcttggtgcagcagcaaccggtgccctctcccaggttcagctggagcagtctggagctgaggtgaagacgcgtggggcctcgaggtgaaggtctccgtgcaggtcttctggttattactttaacacctagtggtatcgaccgttggtcgccgaccgcggtcccgtgggacgaacggtccgttaggacggtacggtaggtcgggtagtcggacgtccgaggcgttaagtttacgtaaggtaacgaaaacgtaactaaacgttagtacgaccaagtaacggtaaacggtttcggggaactaggaacgtacacgtacgtacgaccaacgagtaaccaacgactacccgaacggaccctaaccgaacgtaccctaacggacgtacgggaacggtcggtaacggggaaccgtcccggaacgacccgtaccggtacggaacccggaaccggaccgggtccgttaacgtaacgtttaccggngttaacgacggtaagtacgtaacgtaacgtcccggtaaccgttggtaagggttaccgggtaccctcggttaccgtaccgggtacggggtacccggtaaccgggttacccngggtttccctcccggttcccgtaccg

SEQ ID NO: 100226 - DNA, 717 bp, Homo sapiens
  misc_feature: GYAE6OF01EZ23J.24.45.E01.1.454.CMB.1.raw
  modified_base (276)..(276): a, c, t, g, unknown or other
  misc_feature (276)..(276): n is a, c, g, or t
tcagactactatgtcacgaccggtgctcgatttagtgagtcagtaagggaaagggcacagcatggactatgagggtccccgctacgaaggctcctggggctcctgctactctggctccgaggtgccagatggtggacagtccaggatgacccagtctccatcctcctgtctgcatctggtaggagacagacgtcaccatcacttgtgggacaaggtgagacctattagcagtcttctttggagttggctatactaattacaaaccgagggaaaccncccctaactctagactctaatactggctacctaatttaccacgtacggttcgggtccctatccgtaagggtttcaggtcggactaagtggtaattcggacgggtaacaggtacgtttactactccttacacctatacgacgtctaacggtctacgacctaaccgtagtaacggttactttgaaccttaacttacgttaattactaactaaacgtagtaacgtttacctacccggtttccccggtacctaccgggtttacggggaccgggtaacggggtaacgtaacggggtaggaacgtacgtaaccgaacggtaaacggtaacgttcggtacgggtaccgttacggaacccggtaacccttacggtttaccggtttacccggtttaccttaccgttaccgtttacccccgtttaccccggtaacctcgtttaaaccccgg

SEQ ID NO: 100227 - DNA, 700 bp, Homo sapiens
  misc_feature: GYAE6OF01ECGM4.24.45.E01.1.454.CMB.1.raw
  modified_base (179)..(179): a, c, t, g, unknown or other
  misc_feature (179)..(179): n is a, c, g, or t
tcagactactatgtcacgaccggtgctcgatttagtgagtcagtaagggaaagggcacagcatggacatgagggtccccgctcagctcctggggctcctgctactctggctccgaggtgccagatgtgacatccagatcgacccagtcctccatccctccctgtctgcatctgtagganacagagtccaccatctacgttggtgggactaagtgaacgtacctagttagactagtccttcgtttggagttcggactatactaaacttaccgaaaaccggagggtaaacctcccctaactcctagtactactatacctcgaccgttacctaatttaccgacgtacggtccgggtaccctacgtccgtaggttccgagtcggactaaggtcggtacttcggtaggactaggtactttcccgacctactaccaaccgtacgttacgagtactacgttaccgtacgtacccgtaacgtagtaaacgttacgttacgaccttaaactttcgtaatttcgaacctaagtacggttaacgtttaccgaccggtttccccggtactaacccggtttcgggaaccggtaccgggaaccgtagggtacggaacgacgtaccgaaccgtacgtacgttcggacgttaccgtcgaccctaacctgttccttacgttccttacctaccttacccgtacccgtctacgttaccg

SEQ ID NO: 100228 - DNA, 623 bp, Homo sapiens
  misc_feature: GYAE6OF01COKLN.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttattacttttaacacctatggtatcacctgggtgcgacaggccctgggcaaggacttgagtggagtgggatggatcagcgattatagtaggaaacacaaactatgacacagaaatttcggggacagagtcacatgaaccacagacacatccacggaccacacgccctaacagtgggagcggtggggacgcccgacaccgtacgacgacgacgccggtacgtagttacgtacgtgcgtacggaagtacgtaagtacgtaccggttaccgtacggtaacgggttaccgggtacccgtaccggttaacccggtccgggggtaccggtaaccggggaacccggttacggtacccggttcccggtcccgttcccgttaccccg

SEQ ID NO: 100229 - DNA, 561 bp, Homo sapiens
  misc_feature: GYAE6OF01B6Z2N.24.45.E01.1.454.CMB.1.raw
  modified_base (342)..(342): a, c, t, g, unknown or other
  misc_feature (342)..(342): n is a, c, g, or t
  modified_base (388)..(388): a, c, t, g, unknown or other
  misc_feature (388)..(388): n is a, c, g, or t
  modified_base (430)..(430): a, c, t, g, unknown or other
  misc_feature (430)..(430): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcgagcgattatagtaggaaacanaaactatgacacagtaaatttcggggacaggagtcaccatgaccanagacacatccacggccacagcctacagtggagcgtggggacncctgacacctgacgacacggccgtagtattacgtgtgcgagagataagtcgaccgttcgaaggttacgggaccctggtccgtacggacggggacccgtacgggtacccgttgggtccctcccggtctcccg

SEQ ID NO: 100230 - DNA, 638 bp, Homo sapiens
  misc_feature: GYAE6OF01AL9MV.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagcctggggcctcgagtgaaggtctcctgcaaggtcttctggttatacttttaacaccttatggtatcacctgggtgcgacaggcccctggggcaaggacttgagtggagtgggatggatcgagcgtattagtagtaggaaacacaatatgacaacagtaaagtttcggggactaggagtacaccgtatacgaccagacgaccacactaccgacggacccacgacgacctaacagtcggacgcggtaggggacgtccgtagacccgaccgtagacggaccgacggtccgttgttaactttacgtcggtacgacggaagacggtaacgtaagtccggtaccgttacggttacgggttacgggtcctacggtcccgttacggtacggggacccgtaccggggtaacccgtcggttcccgttccgttcccgtcccg

SEQ ID NO: 100231 - DNA, 727 bp, Homo sapiens
  misc_feature: GYAE6OF01DBV1F.24.45.E01.1.454.CMB.1.raw
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatccctccctgtctgcatctgtaggagacagacgtcaccatcacttggtggacaagtgagacctattagcagtcttcgtttgagttcgactatacaaattaccaaaaccgaacggggaaacctaccccctaaaccttcctagtaactactaactactcgtaccgttaacctaactttaaccacgtacggtacggggtacccaacgttccgtaaggttacgaggttacgggacctaaagttcggggtaacttccggtaggggaaactaggttaacggttttaccaacttcctaccaacccgtacgtacgaacgtacgaagtttccacggtaacccaaacccgttaagggaaacctttactttacgtaaccttaaacgtttaacttaagtttcgtaaacaaccgttaagtaacgttttaccgtacccggtttaccccggtcgttaacccggttccggggtacgggaaacgggtaaccgtaaaggggtcggaactaacgtacgaacgtaacgtacgtgggtcgactcgactaccctattccgtcgttaccttcaaccttcccgttacccgctacttaacc

SEQ ID NO: 100232 - DNA, 807 bp, Homo sapiens
  misc_feature: GYAE6OF01EMRB1.24.45.E01.1.454.CMB.1.raw
  modified_base (399)..(399): a, c, t, g, unknown or other
  misc_feature (399)..(399): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagccgtggggcctcagtgaaggtctcctgcaaggcttctggttatacttttaacacctatggtatcacgtggtgcgacaggccctggcaaggcttgagtggagtgggatggatcgagcgtattatagtagaaacactaaactatgacaacgaagtaaagtttcggggactaggacgtacgaaccagtacgaaccanacggaaccacgactacccgaaccggaccctaaccgaacgtacccgttaacaacggttacgggaacggtaccggtaacggggggtacgtacccggttaacggacccgtaacccgttacggaaaccccgggtaacccgggtaacccggggtacccggttaaggtttaaccgttttacccggttaacgggttaccggtaacccgggtaaggtaaacggtaacgttaaacggttccccgggtttaacccgggtttaaccggttaaaccgggggtttaaacggggggttaccccgttaccgggtaaccccgtttaacccgggggtaccgggggtaacccccgggtaaaccggggttaaccccccgtttgggggtttaaccccccgttccccgggtttacccgttacccccggg

SEQ ID NO: 100233 - DNA, 662 bp, Homo sapiens
  misc_feature: GYAE6OF01AMPLM.24.45.E01.1.454.CMB.1.raw
tcagactactatgtcacgaccggtgctcgatttagtgagtcagtaagggaaaggacacagcatggacatgagggtccccgctcagctcctggggctcctgctactctggctccgaggtgccagatgtgacatccagatgacccagtctccatccctccctgtctgcatctgtaggagacagagtcaccatcacttgttgggcaagtgagaccattagcagcttctttgagttggcatcaattcaaaccagggaaacgcccctaacctcctgactctatactgcgtaccaatttaccacgtacggtcgggtcccatccgaggttcagtgggacaagttggaatcgtaggggactaaggagtttaccactctaccacccgtaattaccgagtaccacgttcctacgacctaaacccgttgaaacgttacgtttacgaacctaaacgtttacttaacgttcgttaacaaaccgtaagtaccgtttaacgtaccggtttccccggtaccttaccgttcgtacggccggggtacgggtaaccgtaagggtacggaacggtactaccgaacgtacggtaaacgttgggtacggccttaggaccctacccgtacgtttccgtacggttaccctttacgtaaccgttttcccgtccccgtaaccttaccg

SEQ ID NO: 100234 - DNA, 761 bp, Homo sapiens
  misc_feature: GYAE6OF01ESKSO.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcactgggtgcgacaggccctgggcaaggacttgagtggatgggatggatcgagcgtatttagtagtaggaaacactaaaactatacgcaacgagtaaagtttcggggactaggaacgtccaaccaagtcgaacccacaagaccaacactccgaaccggacccaaccgacgaccctaacgaacgttagggaacggtccggtacgggggaacgtcccggttacgacccgtaacccgtacggaacccggtaaccggaacccgggtacccggttaaggttaaccgtttaaccggttacggtttacgggacggtaacggtaacggtaacgttaaaccggttcccgggttacccggtttacggttaacggggttttaaccggggggtaacccttcggggtaccccttaaccggggttccggggggtaaccccggtaacccgggggttaaacccccggttaccggggttaccccgttccccggttcccgtttacccccgg

SEQ ID NO: 100235 - DNA, 588 bp, Homo sapiens
  misc_feature: GYAE6OF01C8H2K.24.45.E01.1.454.CMB.1.raw
  modified_base (395)..(395): a, c, t, g, unknown or other
  misc_feature (395)..(395): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggtacttgagtggatgggatgggatcagcgtattagagtaggaaacacgaaactatgacaacaagaaagtttcggggacagagtcaccatcgacacanacacatccgaacggcccaacgacgccctaacagtacgggaacgcggtagggggacgcccgtagaccaccgtacgaccgacgaccggccgttagtactttcgtgtgacgagagtaataacgtcgaccgtttcgagggttacgggacctcgccgtacgtcgggaccgtaacggtacccgtggtcctccgtctccg

SEQ ID NO: 100236 - DNA, 685 bp, Homo sapiens
  misc_feature: GYAE6OF01CZGHD.24.45.E01.1.454.CMB.1.raw
  modified_base (337)..(337): a, c, t, g, unknown or other
  misc_feature (337)..(337): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagcgtgggcctcagtgaaggtctcctgacaaggcttctggttaattacttttaacacctatggtatcaccgtgggtgcgacacggcccctgggcaaggacttggagtggagtgggatggatcagcgtattanagtaggaaaacacgaaaactagtgacaacgaagtaaagtttcgggggacaggaacgtacaacctatacggaaccaacgaagaaccaactacgtacccgaaccgggacccaacgtaacgcccttaaacacgtaggacgcggtggggaacgtccgtacgacacccgtagaaccggaccgtaccgggaccgttacgttacgttacgtaggtcgacggtaagacgtaataacgtacccggtccgtttagacgggtttaacggggacccttacgggtcccctaacgggtccgggggaacccgtaaccgggggtaaaccccttggggttccctaccccggttctttaaccccgg

SEQ ID NO: 100237 - DNA, 566 bp, Homo sapiens
  misc_feature: GYAE6OF01C2TW0.24.45.E01.1.454.CMB.1.raw
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcagtgaaggtctcctgcaaggcttctggttattacttttaacacctatggtatcacctgggtgcgacaggccctgggcaaggacttgagtggagtgggatggatcgagcgattatagtaggaaacacaaactatagacanaagaaagtttcggggacagagtcaccatgaccanagacacactccacggaccacacgacctacagtaggagacgtggggacgccgtacgacaccgtcgacgacgacggccgtagtattacgtgtgacgagagataagtccgcgttagacggttacgggacctggccgtacggtgggaccgtacgggaaccgtggtcctccgtctaccg

SEQ ID NO: 100238 - DNA, 664 bp, Homo sapiens
  misc_feature: GYAE6OF01C5AUN.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggtctcctgcaaggtcttcgtggttatacttttaacactatggtatcaccgtggtgcgacaggccctgggacaaggtcttgagtggagtggatggatcgagcgtattagtagtaggaaaacacgaaaactatgacaacgaagtaaagtttcggggacaaggaagtcaacgagtcgaaccacagaacacaactacccaacggaccaacgacgaccctaacgaacgtcggaacggtcggtacggggacgtacccgtaggaaccgaccgtacggaacgaccgtacgggtccgttagttaacgttacgtcggtaggacggtaagacgtaacttaacgtccgggtaccgtttacgaacgggtttacggggacccttcgggtacccgttacgggtcggggaccgtaacgggtaaccccgtggtttcccgtccgttccgttacccg

SEQ ID NO: 100239 - DNA, 570 bp, Homo sapiens
  misc_feature: GYAE6OF01AK2LR.24.45.E01.1.454.CMB.1.raw
  modified_base (431)..(431): a, c, t, g, unknown or other
  misc_feature (431)..(431): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcgagcgattagtagtaggaaacacaaactatgacacagaaagttcggggacagagtcacatcgaccacagacacactccacggccacacgcctacatggacgcgtggggacnccgtgaccaccgtgacgacgacggccgtagtacttacgtgtgcgagagataacgtcgtaccgttacgacggttacgggacctcggcccgtacggtcggggaccgtaacgggtacccttgggtccctcccgtcgtacccg

SEQ ID NO: 100240 - DNA, 605 bp, Homo sapiens
  misc_feature: GYAE6OF01EC1HL.24.45.E01.1.454.CMB.1.raw
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcacttggttgggcaagtgagaccattagcagcttctttggagttggcatcaattaccaaaaccgagggaaacgcccctaacctcctagactctatactgcgtacctaatttacacgtagtcgggtcccatccgaggttcagtggacaagtggatcgtgggactagtagttcactctacaccatcagctagtctgactaaccgtagaacgtactttagacctaaactttacgtattacgtactaacgtagtacgttaaccgtaccggtttccccggtactaccggttcgggacgggtaacgggaaccgtaaggggttcgaagtactaccgaacgtacggtaacgttggtacggtcgtcgaccctaacctagttccgtcgttaccttacgtaccttcccgttaccccgctagttaccg

SEQ ID NO: 100241 - DNA, 709 bp, Homo sapiens
  misc_feature: GYAE6OF01BE49F.24.45.E01.1.454.CMB.1.raw
  modified_base (242)..(242): a, c, t, g, unknown or other
  misc_feature (242)..(242): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcgagtgaaggtctcctgcaaggcttntggttatacttttaacacctatggtatcacctgggtgcgacgacggccctgggcaaggcttgagtggagtgggatggatcgagcgtattatagtagaaacactaaactatacgacaacgtaagtaaagtttcggggacaaggtacgtacaaccgatacgaccaacgaacgacaactactaccaccggaccctaacgacgtacctaacgacgtaggaacgtccggtacggggacgtcccgttacgaaccgtacccgtaacggacccgaaccggacccgggttaccgttaggttaaccgtttacgtacgggttcggacgtaacggtacgtaacgttaacggttcccgttaccggttacgtaacggggtttaccggggtacccttaccgggtccgttaaccgggtccggggaacccggtaaccggggtaacccccgttgggttaccccgttcccggttcccgttaccccg

SEQ ID NO: 100242 - DNA, 631 bp, Homo sapiens
  misc_feature: GYAE6OF01DI7YQ.24.45.E01.1.454.CMB.1.raw
  modified_base (451)..(451): a, c, t, g, unknown or other
  misc_feature (451)..(451): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttctggtggcagcagcaaccggtgccctctcccaggttcagctggagcagtctggagctgaggtgaagaagcctggggcctcgagtgaaggtctcctgcaaggtcttctggttatacttttaacaccgttatggtaactctaccgtgggtcgcgacgacggccccgtaggggcaaggtcttggagtggatgggattcgggaatcgagacgtattagtaagtacggaaactacgtaaactagtacggacaacgtaaggtaaacgtttcggggacagacgtacacgatacgaccacacgacacacgtccacgtaccacngaccttacaagtggagcgagggacgcctagacgtaccgtgaaccgacgacggacgtacgttattcgtaggtacgtagaggaagacttaacggtcgtaccgttacggaacggttacgggtaaccgtcgtcccggaacgttcggggaccctacgggacccttagggtcctccgtcgtacccg

SEQ ID NO: 100243 - DNA, 672 bp, Homo sapiens
  misc_feature: GYAE6OF01AFCD9.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcagtgaaggtctcctgcaaggcttctggttatacttttaacacctatggtatcaccgtggtgcgacacggccccgtgggcaaggacttggagtggagtgggatggatcgagcgtattagtagtaggaaacacaaactatgacacgaagtaaacgtttcggggactaggacgtccaaccgtagtacgaacccaacgacgaaccaacgacctacccgaaccgacccacgacgtaccctaacgagtacgggacgtccggtaggggacgtccgtacgaaccgtacccgtacggaaccgaccgaccgggtccgttacgttaacgtttaccgtggtacgacgaagacgtacgtacgtccggtacccggttacgtacgggttacgggtaccctcggtacccgtacggtccggggtaccgtaaccggggtacccgttacgggtcccttcccggtccgtccccg

SEQ ID NO: 100244 - DNA, 913 bp, Homo sapiens
  misc_feature: GYAE6OF01ESS36.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattcctttttcttggtggcagcagcaaccggtgccctctcccaggttcagctggagcagtctggagcgtgaggtgaagaacgccgtggggcctcgagtgaaggttcctccgtgacaaggtcttctaggtttattacttttaacaccttatggtactcaccgtgggtgcgacgaccggcccgtgggacgaaggtcgtttggaggtgggagtaggggattgggactcgaaggtcgtaatttagtaaggtacggaaaactaactaaaacgtatacggactaaacgtaacggttaaaacggtttccggggggaactaagggaaccgttaccgaacccgtaagttaccggaaacccctaaacgaaccggtaaaccctaacccgaaccgttaaccccggaaccccggtaccccgtaaaccgaaccggtaaccccgttaaaccgtaacggttacgggaaccggggtacgggtaccggggggtaaccggtaccccggtaaccggaacccggtaaccccggtacgggaaccccggaacgggtaacccgggttacccgggttaacgtttaaccgtttaaccggttaccgggtacggttaaccgggtaaggtaacggtaaacgttaaccggttacccggttacccgggtttacgggttaaacggggtttaccggggttaaccccggttacggtaaccccggttaaccgggtacccgggggtacccgggttaaacccgggggttaaccccgggttacgggtttacccccggtttccccggttcccggttacccccgg

SEQ ID NO: 100245 - DNA, 619 bp, Homo sapiens
  misc_feature: GYAE6OF01EO49E.24.45.E01.1.454.CMB.1.raw
  modified_base (462)..(462): a, c, t, g, unknown or other
  misc_feature (462)..(462): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcgagtgaaggtctcgtgcaaggcttctggttatacttttaacacctatggtatcacctgggtgcgacaggccctggcaaggacttgagtggagtggggatggatcgaggcgtattagtaggtaggaaaacacgaaaactagtcgacaagaaggtaaagtttcgggggacaaggacgtacaaccatacgaaccacgacgacacactaccgacggaccacacgacctacagtggagcggtaggggacnccgtgacaccgtgaccgacgcggaccgttagtacgttacgtggtacgacggagagtaagtaactcggtaccggttagtaagggtaccgggtactacggtcccgtacggtcggggacccgtacgggtacccgttgggttcccgtccggtccgttcccg

SEQ ID NO: 100246 - DNA, 609 bp, Homo sapiens
  misc_feature: GYAE6OF01C4SOB.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctggtcgcgacaggcccctgggcaaggacttgagtggagtgggatggatcaggcgtattatagtaggaaacactaaaactatgacactaagaaagtttcggggactagagtacgaccagtgaaccacaacgacacactaccaacggcccaacacgacctacagtggaagcgtcggggacgccgtgaccaccgtagacgacgacggtaccgtagttacttacgtggtcgacggtagacgtagtaacgtccggccgttacgaggttacggggaccttacggtcccgtacggtcgggaccgtaacggggtacccgtgggttcccgtcccgtccgttacccg

SEQ ID NO: 100247 - DNA, 642 bp, Homo sapiens
  misc_feature: GYAE6OF01BIMEK.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagagccgtggggcctcgagtgaaggtctcctgcaggcttctggttattacttttaacaccttatggtatcaccgtggtgcgacgaggccctgggcaaggcttgaggtggagtgggatggatcgaggcgtaattataggtaggaaacaactaaactatagacctaacgtaaggtaaagtttcggggacaaggacgtacaaccgatacgaaccacgacgacacgactacccgaacgaccaacacgacctaacagtacggacgtcggtacggggagccgtacgacccgactacggacgaccgacggtccgtaacgttacttacgtcggtgacggaagagtaactagtccgtaccggttacgtaacgggttacgggtacctaggtcccgttacggacgggacccgtaacgggtaccccgttgggttccccgtccgtccgtcccg

SEQ ID NO: 100248 - DNA, 674 bp, Homo sapiens
  misc_feature: GYAE6OF01ATAK3.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcagtgaaggtctcctgcaaggcttctggttatacttttaacacctatgtatcacgtggtgcgacgacggccctgggacaaggcttgagtggagtgggagtggatcgagcgtattatagtaggaaacaacaaactatagacaacgaagtaaagtttcggggacagacgtacacatcgaaccacagacacgactaccgacggccacgacgacctacagtggacgtcggtaggggacgccgtagaaccaccgtacggaccgaaccgaccgggtacccgttagttaacccgtttaacgtcggttaccggacggtaacggtaacgtaacgttaaccgtaccggttacccgtttaacggtaccgggtttaacggggacccttggtaccccggtacgggttcccgggggaacccggtaaccgggtaaccccgttcgggttacccgttcccggttccgtacccgg

SEQ ID NO: 100249 - DNA, 759 bp, Homo sapiens
  misc_feature: GYAE6OF01C67T5.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggacctggacctggagcattccttttcttggtggcagcagcgaaccggtgcccctctcccaggttcagctggagcagtctggagctggaggtgaaaggacgccgtggggcctcgaggtaggaaggttctaccgtgacgaaggtctttacgttggttaactttaccttttaaacaccgttagttacggttactacgtaccgttgggtacgccgtaacgaccggtccccgtgggacgtaaggtcgttggaggtaggtaaggtgggaagtggacgttacgaggtacgttaagtttacgtaacggtaacggtaaaaccaacgtaaaagttacgtaacgtaccaaacgtaaaggttaaccggtttacggggaacgaaggtaccggtaaccctaacgtacgtaaccgaaaccctaacgaacgaaaccgacctaacccgtaccccggaaccggtacccaacggaccgtaaccgtaccgtaggtacggaccggtacggtacggggactaccgtacgaccaccgtacggaccgaaccggtccggtacgttacgtacgttacgtggtacgcgaagtacgacgttacgccgtcgtacgtacggttacgggctaccgtcgacggtcggaccggtacggacgttccgctccgttcgtccg

SEQ ID NO: 100250 - DNA, 778 bp, Homo sapiens
  misc_feature: GYAE6OF01C9Q0U.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcagtgaaggtctcctgacaaggtcttcgtggttattacttttaacaccttatggtaactcgaccgtgggtcgcgacgacggcccctgggaccaagggtacttggaggttggagtgggattggatcgagacgtattaagtagtaggaaaactacgtaaaactatacgacgtaaaccgtaaaggtaaagttttccggggaacctaaggtaacgttaaccgaaccgtaagttacgaaccccgaaacgaacgaaccaacctacgtaccccaaccggacccaaccgacacccgttaacgaagtacgggacgtaccggtaggggaacgtccgtacgtacccgaacccttacggaccggaaccgtaccgggtacccgtttacggtaaccgtttacggtacgttcggacggaagtacgtaaacgttaacgtccggttacccgtttagtaaacggggtttaccggggtaaccgttccggtaccccggtttaccgggtaccggggaaccccgggtaaccggggttaaccccgttaggggtttaccccttcccgggtcccctttacccggg

SEQ ID NO: 100251 - DNA, 915 bp, Homo sapiens
  misc_feature: GYAE6OF01A864M.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcaacgtcgtaggagctagtcgtggagtcgtaggaggtagaaaggacgtccggtcggggtccctacgtaggtaggtaacggttccttccgtacgacgtaacggttccttcggttaggtttaactttaaccttttaaccaccttagttaggtactccgtacggtgggtcgacgacgaccggtcccggtggacgtaacggtacgtaggtaggtcggaggtggggacgtggtactacgaggacgttaattagtagggtaacggaaaccaaactaaactgtacgacaacggtaaagttaaacgggttccggggaacgtaaggtaccgttaccgaaccgtagtacccgaaccaacgaaacgaccaacgtaccgtacccggacccgccctaacgaccgtaccctaaacgcggtaacggggaccgacggggttacggggaccttaccgtaacgaaccccgttaccgaccggtaacccggaacccgggtacccgggtacccggttttaacgtttaaccgttacgggttaggggttaaccgaacggggtaaacggtaaccgttaacggtttaacccggtccccggtttaccgggttaaacgggtttaacccggggggttaaccgggttaccccgttacccgggtacccgtttaaaccccggggggtccgggggaaacccccgtacccggggggtttaaaccccgttcccgggggtttaccccctttcccccgggttacccgttacccccggg

SEQ ID NO: 100252 - DNA, 765 bp, Homo sapiens
  misc_feature: GYAE6OF01AIX13.24.45.E01.1.454.CMB.1.raw
tcagactactatgtcacgaccggtgctcgatttagtgagtcagtaagggaaaggggacccaaaaaccacacccctccttgggagaatacccctagatcacagctcctcaccatggactggacctggagcatccttttctggtggcagcagcaaccggtgccctctcccaggttcagctggagcagtctggagctgaggtgaagaagcctggggcctcagtgaaggtctctgcaggcttctggttatacttttacaccgttatggtatcctacgtgggtcgcgacgaggccccgtgggcaaggtcttggagtggagtgggatggactcgagcgtattacgtaggtacggaaacacaaacgtacgtagaccaacgaaggtaaacggtttcggggactaacggtacgtaccaaccgtagtaccggaaccctaacgacggaacctaaccaaccgtacccgaacccgggtacccaaccgtacgaccccttaaacgaacgtgggaaccggtacggacggggggtacgtcccgtacgtaacccgtacccgttacgggaaccgaaccggtacccgggtaccggttacggttaacgttaaccggtcggtacggacggtacgggtaacgtaacgttaacggtaccgttacccggtttacgtaaacggggttacggggtaccccgttacggttaccccggttacgggtaccgggggtacccgttaaccggggaaccccgttaccgggtccccgtttcccggtcccgtacccccggg

SEQ ID NO: 100253 - DNA, 852 bp, Homo sapiens
  misc_feature: GYAE6OF01B2G30.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtcgtggagctggaggtgaagagccgtggggcctgagtgaaggtctcctgacaggtcttctggttacttacttttaacaccttagtggtatcaccgttgggtgcgacgacggtcccgtgggacgaagggtcgttggaggtggagtgggataggatcgaggtcgtaattaagtaaggtaaggaaaacaacgtaaactagtcgacaacgtaaaggtaaacggtttcgggggacaaggtacgtaccaacgtactacggaacctaacgaagaaccaaccgtaacctacccgaaccgggaccctaaccgaacgtacccgttaaacgacggtacgggtacggtaccggttacgggggaaccgtacccggaacggtaacccgtaaccggtaccgggtaaaccggaacccgggtaccgggtacccggtttaaggttaccggttttaacgttacgggttaacgggtaaccggtaagggtaacggttaacgttaaccggttacccgggttaacccggttttaacgggttaaccgggggtttaaacccgggggtacccgtttacccgggttacccggtttaacccgggggtacccgggggtaacccccggtttaaccgggggtaaacccccgggtttcgggttacccccgtttccccggggttaccctttaccccggg

SEQ ID NO: 100254 - DNA, 658 bp, Homo sapiens
  misc_feature: GYAE6OF01BMPIE.24.45.E01.1.454.CMB.1.raw
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacacgggcccctggggacaaggacttggaggtggagtgggatggatcgagcgattagtaggtaggaaacaacaaactatgcaacagtaaagtttcggggacagagtacaccgatcgaaccacaagacaacactccgacgccacacgcctanagtggagcgtaggggcnccgtgaccaccgtcggaacgtaccgacggtcccgtagttaccgttaccgtggtacgacgaaggtacgtaagttaacgtaccggttacccgttacggtacggggtttaaccggggtaccccttagggtccccgttaaccgggtccgggggaccccggtaaaccggggttaccccgttacgggttcccgttccccggtcccgttacccccgg

SEQ ID NO: 100255 - DNA, 605 bp, Homo sapiens
  misc_feature: GYAE6OF01A5NC9.24.45.E01.1.454.CMB.1.raw
  modified_base (374)..(374): a, c, t, g, unknown or other
  misc_feature (374)..(374): n is a, c, g, or t
tcagactactatgtcacgaccggtgctcgatttagtgagtcagtaagggaaagggcacagcatggacatgagggtccccgctcagctcctggggctcctgctactctggctccgagatgccagatgtgacatccagatgacccagtctccatcctcctgtctgcatctgtaggagacagagtcaccatcacttgttgggcaagtgagaccattagcagctctttgagttgcatcaattcaaaaccagggaaactaccctaacctcctgactctatactgtcgtaccaatttacacgtacgtcggggtcccatccgaggttcaggtgctaatggagtctgggacagtagttcactctacacctatcagcaggtcngacaacctgaatacttgactaacgtttactagttacgtaccaactacgtacgttacctacggtttacccccgtctaacccggtttcggacgggtacgggtaacccgtaaggggtcgaacggtaactacccgaaacgaaccggtaccgttacggtaccgggtactaccggacctaaccgtacgttccttcgttacccgtttaccaacgtttcccttcccccggcttaacccg

SEQ ID NO: 100256 - DNA, 642 bp, Homo sapiens
  misc_feature: GYAE6OF01B7HFD.24.45.E01.1.454.CMB.1.raw
  modified_base (411)..(411): a, c, t, g, unknown or other
  misc_feature (411)..(411): n is a, c, g, or t
  modified_base (483)..(483): a, c, t, g, unknown or other
  misc_feature (483)..(483): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagcgtgaggtgaagagccgtggggcctcgagtgaggtctcctgcaggcttcgtgttattactttaacactatgtatcaccgtggtgcgacgacggcccctgggacgaacggtcttggaggtggaagtgggatggatcgagtcgtaattagtaggtaggaaacaacaaactatagacaacgaaggtaaacgttcggggactagacgtcacagtacgaaccanaacgacacgacgtccggcgaccacgtacgcctacgacgtcgggacgtcggtagggaacgtccgtacgaaccnccgtacggacgaccgtacggtccgtagttacgttctcggtaggcgtaggacgtacgtaccgtcggttaccgtacgtaacgggttacggccgtacggtcccggtacgggtacggggacccgtaaccgggttacccgtgtacccgtcccgtcgttaccccg

SEQ ID NO: 100257 - DNA, 681 bp, Homo sapiens
  misc_feature: GYAE6OF01CZO5C.24.45.E01.1.454.CMB.1.raw
tcagactactatgtcacgaccggtgctcgatttagtgagtcagtaagggaaagggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagcctggggcctcagtgaaggtctcctgcaagcttctggttatacttttaacactatggtatcaccgtggtgcgacgcggcccctgggcaaggtacttggagtggagtgggatggactcgagcggtaatttagtaaggtaggaaaacaacaaaacttatgacacgtaaaggtaaacgtttcggggacaaggaacgttaccaactagtacgaccaacgacgaaccaacacgtacccgacggacccaacgtacgaccctaacgagtacggacgtcggtacgggacgccgtacgacgaccgtagaccgacggaccggtccgtagttaacgtttacgtggtagtaccggaagacgtaagttaaacgtccggtacccgtttacggtaacggggttaccgggaccttaccggtcccgttaccgggtaccggggtaccgtaacccggggtaccccttgggtccccttcccggttccgtaccccg

SEQ ID NO: 100258 - DNA, 739 bp, Homo sapiens
  misc_feature: GYAE6OF01C5GJA.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctggaggtagaagacgccgtgggcctcgagtggaacggtctccgtgactaaggtcttcgtggttacttacgttttaacaccgttatggtatcctacgtggtgcgacgacggcccgtggacgaggtacttggagtggagtggagtggatcgagtacgtaatttacgtaaggtaacggaaaactaacgtaaaactatacggacctaaagtaacggttaaacggtttacggggactaaggtaccgttaaccgaacccttaagtaaccgaacccaaacgaacgaccctaactaccgtaccccgaacggtaaccctaaccgaaccggtaccaaacgtagtacgggaacgtcggtaacggggacctccgacgtacccacgtaacggaccgaccggtacggtccgtaacgttacgtacggtaggtacccgagtacgtagaacgttaccgtcggtacccgtttaggacgggttaccgggccctacgtacccgggttacggtacggggtaccgtaaccgggttacccgtcggttcccgtcccgttccgttacccg

SEQ ID NO: 100259 - DNA, 581 bp, Homo sapiens
  misc_feature: GYAE6OF01CVG67.24.45.E01.1.454.CMB.1.raw
  modified_base (282)..(282): a, c, t, g, unknown or other
  misc_feature (282)..(282): n is a, c, g, or t
  modified_base (357)..(357): a, c, t, g, unknown or other
  misc_feature (357)..(357): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcgagtgaaggtctcctgcaaggcttcgtggttattacttttaacactatggtatcacctgggtncgacacggccctgggcaaggtcttgagtggagtgggatggatcgagcgtattagtagtaggaaaacacaaaactntagacacgaagtaaagtttcggggacagagtcaccatcgacacagacacatccacgccaacgacncctanagtggagcgtagggacgcctgacaccgtcggacgaccgcggtaccgtagttacttacgtgtgcgagagtataacgtcgtccgttgaggttacgggacctggtacctacggtcgggaccgtaccggggacccttggtaccgtccgtcgttacccg

SEQ ID NO: 100260 - DNA, 851 bp, Homo sapiens
  misc_feature: GYAE6OF01A80CW.24.45.E01.1.454.CMB.1.raw
tcagactactatgtcacgaccggtgctcgatttagtgagtcagtaagggaaaggggacccaaaaaccacaccctccttgggagaatccctagatcacagctcctcaccatggactggacctggagcattccttttcttggtggcagcagcaaccggtgccctctcccaggttcagctggagcagtctggagctgaggtcgaagaacgccgtcggggcctcgagtgtaacggtcctccgtgacgtaaggtctttcgtaggtttaacttaaccttttaaccaccgttagttacggttactccgtaaccgttggggtcgaccgaacgaccgggtccccgtaggggactaacgggtcttgggaggtagggtagtggggtatgggtaacgttcgaacggtcgtaagtttaacggtaaggttaacgggaaaacctaacgtaaaacgttagtacgaaccgaaacgttaaaggttaaaacgggtttcgggggaacctaaaggtacggttaacccaacgtaagtacccggaaaccaacgaacgtaccgaactaccgtaccgaccgacccaacgaccgtacctaacgtagtacgggtacgacggggttacgggaaccgtaccgttacggaaccctacggttaaccggaaccggtaaccccgggttacggtaccccggtttaaggttaacccgtttaacgtcgggttacgaccgggtaaagtagtaaaccgtttaaccggtcccggtaccggttttaacggtaaccggggtaccgggttaccctacggtacccggttacggggttccgggaaccggttacccgggtacgttccggttacccgttacccgtccttaaccccgg

SEQ ID NO: 100261 - DNA, 860 bp, Homo sapiens
  misc_feature: GYAE6OF01E36RF.24.45.E01.1.454.CMB.1.raw
  modified_base (690)..(690): a, c, t, g, unknown or other
  misc_feature (690)..(690): n is a, c, g, or t
  modified_base (799)..(799): a, c, t, g, unknown or other
  misc_feature (799)..(799): n is a, c, g, or t
  modified_base (850)..(850): a, c, t, g, unknown or other
  misc_feature (850)..(850): n is a, c, g, or t
tcagactactatgtcacgaccggtgctcgatttagtgagtcagtaagggaaagggcacagcatggacatgacgggtccccgctcagctccgtggggctcctgctactctggctccgaggtgccagatgtacgacactccgagactacgaccctagtcctcccacttccctcctgtctgctagtcgtaggaggacacgacgtacctacctacgttacgtacgttacggttagggtacgaacgtacggtacgtacgtaacttacgtacgtacgttcgttcgttaggtacgttacggtacctaactaaaccgaaacccgttaaacccgaaacccggtaacccggggtaaaccttacccccttaacccgttacttacggtaacttaccgtaaccgttaaacccgtttaccggtaccccgtttaaaacgttaaccgttaccggtaacccggtaagggggggtttccccctaaaccggtacgtttaaccggggttaccggtttaagggaacgggttaacgtaccggttaaaaggggtttaccggaccggtttaaacccgggaacgtaaccttaacccgggtttaacccttaacctccccgtaacctaaaccgcgttaaccgtaacgtacggttaccctacgtttaaccgtaccgaactttaaccggaatttacgttactaccgttactaacgtttnaacggttaacaccggtagtaccgtccgttaccgggtaccgtcggaccggacgggaacgggtacgaaaggcgtacggtaacttaacgaccgtacgaacctgtgacccgtncgtacctcctattcctcttacacccgttaccgtccgttccgaattcggtancggttaacgg

SEQ ID NO: 100262 - DNA, 696 bp, Homo sapiens
  misc_feature: GYAE6OF01AJ9BR.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcgagtgaaggtctcctgcagctctgttatactttacactatggtatcacgtgggtcgcgacgacggcccgtgggacaaggtcttggaggtggagtgggatggactacgagtcgtaattagtaggtacggaaaactaacgtaaactagtacgacaacgtaagttaaacggtttcggggactaggacgtaccaactacgtacgaacctaacgaacgaaccactaacgtcccgaaccggacccaacgaccgtaccctaacgtacggtacgggacgtacgggtaggggaacgtcccgtacgacccgtaccgtcggaaccgaccgaccggtccgttagttacgttacgtgtacgacggagtacgtaacgtaacgtccggtaccgttaggtacgggttacgggtaccgtacggtacccgttacgggtaccggggacccgtaaccgggtacccgttcggttaccccttccggttccgttaccccg

SEQ ID NO: 100263 - DNA, 717 bp, Homo sapiens
  misc_feature: GYAE6OF01CQ4VQ.24.45.E01.1.454.CMB.1.raw
  modified_base (370)..(370): a, c, t, g, unknown or other
  misc_feature (370)..(370): n is a, c, g, or t
tcagactactatgtcacgaccggtgctcgatttagtgagtcagtaagggaaagggacccaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcgagtggacggtctcctgcaaggtcttcgtggttattacttttaacacctatggtactcaccgtgggtgcgacaggcccctgggacgaaggtacttggagttaggagtgggatggatcgagcgtattacgtaggaggaaacacaaactatacgnaacgaagtaaacgttcggggactaaggacgtcaaccgtagtacgaaccaaacgaacgaccaacacgtacccgaaccggaccgtaacacggtacctaacaggtacggaacggcgtagggggacgccgttagaccgtaccgtaggaacgaaccgaccgggacgttaacgttaacggtttacgtcggtacggacgttaacggacgttaaacgtaacgttccgggtacccggttaacgtacggggtttaaccggggaccttccggacccggtttaccgggttccgggggaacccggtaaccggggttaacccgttccgggttacccgggttcccgttacccgtttccccgg

SEQ ID NO: 100264 - DNA, 699 bp, Homo sapiens
  misc_feature: GYAE6OF01C9CCA.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcgagtgaaggtctccgtgcaaggtcttcgtggttaattaaccttttaacaccttagttggtactcacgtgggtgcgtacgacggccctgggacaaggtacttggagtggagtgggtagtggatcgagtcgtaattagtagtacggaaaacacaaactatcgacaacgaaggtaaacgtttcggggactaggtacgtacacagtacgaaccaacgaagtaccaacactacccgaccggaccaacgacgacctaacgtagtaggacgacggtacggggaccgacccggaccaccgtacgaccggaccgaccggtacgttacgtacgttacgtgtacgacggaagtacgtacgttaacgtcccggtaccgttacggttaacggtacggggtaccttacggtacccgttacgggtacccgggggtacccgtaacccggggtacccgtttacggtacccgtttcccggtccgttccccgtaaccgg

SEQ ID NO: 100265 - DNA, 767 bp, Homo sapiens
  misc_feature: GYAE6OF01CUUS2.24.45.E01.1.454.CMB.1.raw
  modified_base (259)..(259): a, c, t, g, unknown or other
  misc_feature (259)..(259): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagagccgtgggcctcgagtgaaggtctcctgcagtcttctgttattactttacactntggtatcaccgtggtcgcgacacggccccgtgggacaaggtcttagaggtggaggtgggtatggtatcgagtcgtattaagtagtaaggaaacacgtaaactagtagacaagtaacgtaaagtttcggggacaagtacgtaccgaaccgtatacggaacccaacgtaacgaaaccactacgtacccgaaccggacccaaccgaccgtacctaacgtagtacggaacggtcgggtacggggaccgtcccgtacggaccctaccggtcggaacccgaaccggtccgggtaccgttacggtttaacgttaccgtaggttaccggaacggtaaggtacggtaaacgttaaaccgttacccggttacccggttttacggaaaccggggttttacggggaaccccgtttaccgggtaccccgttaaccgggggttacccgggggtaaccccggttaacccgggggtaaccccgtttccggggttaccccttccccgggttcccgttacccccgg

SEQ ID NO: 100266 - DNA, 687 bp, Homo sapiens
  misc_feature: GYAE6OF01CYAS5.24.45.E01.1.454.CMB.1.raw
  modified_base (178)..(178): a, c, t, g, unknown or other
  misc_feature (178)..(178): n is a, c, g, or t
tcagactactatgtcacgaccggtgctcgatttagtgagtcagtaagggaaaggacacagcatggacatgagggtccccgctcagctcctggggctcctgctactctggctccgaggtgccagatgtgacatccagatgacccagtctccatccctccctgtctgcatctggtagganacagactcaccatcctactttggttgggactaaaggtgaacgacctattacgctagtccttcgtttggagttggctaattctaaatttaccgaaaaccgtaaggggaaacctacccctaaacctcctagtaacttctaactactacgtccgtacctaaacttttaccacgtaacggtcggggtaccctactccgtacggttcaggtcggactaagtcggtacgtcggttacggggaacgtagtacgtttacctacgtctaccacctagtaccagtacctacgttctacggtacctaaccgtagtaacgtactttacgtaacctaactttacttattacgtaactaacgtaagtacgttaccgtaccggttccccgtactaccgttcgggaacggtaccgggtaacgtaagggtcggaacgaacgtccgaaacgtacgtaaccgtgggttcgacgtacgactactctcgttacgttccttaccgacttcccgttaccctctacgttaccg

SEQ ID NO: 100267 - DNA, 715 bp, Homo sapiens
  misc_feature: GYAE6OF01CITK6.24.45.E01.1.454.CMB.1.raw
tcagactactatgtcacgaccggtgctcgatttagtgagtcagtaagggaaagggacccaaaaaccacacccctccttgggagaatcccctagatcacagctcctcaccatggactggacctggagcattccttttcttggtggcagcagcaaccggtgccctctcccaggttcagctggagcagtctggagctgaggtgaaggaacgccgtggggcctcgagtgaaggttcctccgtgcgaaggtcttcgtaggttacttacttttaacacttataggtatctacgtggttcgcgaacacggccccgtggacgaaggtaccttggaggttggaagtgggagtggatcgagcgtaagttaataggtaaggaaaacaacgtaaaactatagaaccaacgaaggttaaaacgtttcggggaactagaacgtccaaccgagtacgaccaacgaacgacacactaccgacgaccaacgacgacccgtaagacgtacggaacgacggtaggggacctaccgtacgaccgtaaccgtgaacccggacgaccgggtccgttagttaaccgttacgtcgggtacgacgtaacggagtaacgtaacgttccgtaccggttaacggtacgggtttaacggggacccgttcggtaaccggttaccggtacggggacccgtaaacgggtaacccccgtggttaccccgttccggtcccgttaccccg

SEQ ID NO: 100268 - DNA, 683 bp, Homo sapiens
  misc_feature: GYAE6OF01CLQR0.24.45.E01.1.454.CMB.1.raw
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (376)..(376): a, c, t, g, unknown or other
  misc_feature (376)..(376): n is a, c, g, or t
tcagactactatgtcacgaccggtgctcgatttagtgagtcagtaagggaaagggacccaaaaaccacaccctccttgggagaatcccctagatcacagctcctcaccatggactggacctggagcattccttttcttggtggcagcagcaaccggtcgccctctcccaggttcagctggancagtctgganctgaggtgaagaacgccgtgggcctcgagtgaagtctccgtgcgaacggtcttcgtggtttacttacgtttaacactatgtactcaccgtggtgccgacgacggccctgggcaacggtacttggacgtggacgtgggaatggagtcgaagcgtagttacgaaggtaaggaaacacgaaaactanacgtacaacgaagttaagtttcggggatacgaagtaccaactacgtcgaaccgaacgaacgacgaacacgtacccgaacgccaactacgaccctagacgtggagccggtagggactccgtacgaccaccgtacggaaccgtaccggaccggtacgttacgttacgttaccgtgggtacgacgagtagtaacgttaacgtccggtaccgttacgtaacgggttaacgggtcccgtacgtcccggttacgggtcccgggtaaccggtaaccgggtaacccccgttggtcccgttcccgtaccgttcccg

SEQ ID NO: 100269 - DNA, 787 bp, Homo sapiens
  misc_feature: GYAE6OF01DSINV.24.45.E01.1.454.CMB.1.raw
  modified_base (127)..(127): a, c, t, g, unknown or other
  misc_feature (127)..(127): n is a, c, g, or t
  modified_base (192)..(192): a, c, t, g, unknown or other
  misc_feature (192)..(192): n is a, c, g, or t
  modified_base (318)..(318): a, c, t, g, unknown or other
  misc_feature (318)..(318): n is a, c, g, or t
tcagactactatgtcacgaccggtgctcgatttagtgagtcagtaagggaaagggacccaaaaaccacacccctccttgggagaatcccctagatcacagcctcctcaccatggactggacctggancatccttttcttggtggcagcagcaaccggtgccctctcccaggttcagctggagcagtctggancgtggaggtgaagacgccgtgggcctgagtgaacggtctcctgcgagtcttcgtagttacttactttaacacttagtgtatcgtacgtggtcgacgaccgtcggccctaggacgaaaggtcttagnggtgagtggagtaggtatcgagtcgtattagtaagtacgaaaacactaaatgtacgacagtaagtaacggttcgggataggactaccaacgtactacgaaccaacaacgaccaacgtactacccgaaccgacccgaaagccgaaccccttaggacttcgggaacgtcggttaacggggctacccgttagaacccgtacgtacgggaacccgtaacccggtcggttacgttacgttaaacgtttacgggtcgtaagggtaccgttaaggaccgtttaaaggttaaacccgggttcccggttaaaccggttttccgggtaaacgggggtttaaacccccggtacccggtttaaccggtacccccgggggtttaaaacccggttcgggggggaaaccccccgttaaaacccggggggtttccccctttaccggggtttcccccgttaccccggtttcccttaacccccgggg

SEQ ID NO: 100270 - DNA, 648 bp, Homo sapiens
  misc_feature: GYAE6OF01A85IJ.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcgagtgaaggtctccgtagcaaggtcttctggttatacttttaacactatggtatcaccgtggtgcgacacggccctgggcaaggcttggagtggagtgggatggatcgagcgtattagtagtaaggaaacaactaaacttagtagacaaacgtaaggtaaacgtttcgggggacaaggtacgttacaactagtacgaaccagaacgaccactactacccgacgaccacaacgcctaacagtcggaggcgtagggacgcgtacgacaccgtaggaccgaccgaccggtacgttacgtacttacgtacgtacgacgaagtacgtaattaacgtaccggtaccgtacgtaacgggtacgggtaccgtacggtccggtacggtacggggaccggtacgggtaacccttgggttacccgtcccgttccgtacccgg

SEQ ID NO: 100271 - DNA, 637 bp, Homo sapiens
  misc_feature: GYAE6OF01AVYB5.24.45.E01.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctggaggtgaagagccgtggggcctnagtgaggtctctgcagcttntgttatactttaacactatgtatcactggtgcgacacggccctgggcaaggacttggagtggagtgggatggatcgagcgtattagtagtaggaaacaactaaactatagcaagaagtaaacgttcggggcaggacgtacactagtacgaccataagacacgactccgacgacaacgcgctacagtggacgtggtacggggactccgtacggaacacccggtgaaccggacggaaccggtccgttagtttaacgttacgtggtacgggcgaaggtacgaagtttaaccgtacggtacccggtttaaggacgggtttaaccggggaccttacgggtccctaacgggtcggggacccgtaacggggaccccgttggttaaccccgtccggttcgttccccg

SEQ ID NO: 100272 - DNA, 787 bp, Homo sapiens
  misc_feature: GYAE6OF01EHJ4S.24.45.E01.1.454.CMB.1.raw
tcagactactatgtcacgaccggtgctcgatttagtgagtcagtaagggaaagggacccaaaaaccacacccctccttgggagaatcccctagatcacagctcctcaccatggactggacctggagctattcctttttcgttgggtggcagcagcgaaccggtcgccctcctcccgtaggttcagtcgtaggagcgtagtcgtggagtcgtaggaggtagaaggacgccggtcgggcctgaggtaggtacgtcctcgtgacgtaggtcttgtagtttacttacttacacttagtgtactcgcggtggtcgcgtacgccggtccggtaggacgaaggtcgtggaggtaggtaggtagggtactacggtatccgtaggtacgttaagttaagtaacggaaacgaaactaacgtaaacgtgtaacgacgtaaacggttaacggtaacgggttcgggaactacggtaacgtccgaactaacgtaccgaacaacgaacgtacctacgtacccgtaccgaaccgaccgtaacgtcgtaccaacggtaggtaacggggcgaccgggtacggtccgtaccgacgacccggtacgtaccgaaccggtccgggaaccggtttccgtaatttaccggttcgaaggtaccggaaggtaacgtacttaaccggttacgggtccgttaccgggttaagttaccggggttacccggaccgtttacgggaacccggttccggggaccgggttaaacccgtaccgggttacccggtcccggtttaccgcccgttcccgtacccg

SEQ ID NO: 100273 - DNA, 573 bp, Homo sapiens
  misc_feature: GYAE6OF01D2HU9.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattagtagtaggaaacacaaaactatgcaacagtaaagtttcggggctagagtcaccatcgaccacagacaacactaccgacggccacacgacctacagtaggagcgtggggacgccgtacgacaccgtacgacgacgacggccgtagtacttacgtgtacgagagagataagtcgtaccgttgtaggttacgggactcggccgtacgtgggcccgtaacgggacccgttggtcctccgtccgtacccg

SEQ ID NO: 100274 - DNA, 605 bp, Homo sapiens
  misc_feature: GYAE6OF01B3NDG.24.45.E01.1.454.CMB.1.raw
  modified_base (263)..(263): a, c, t, g, unknown or other
  misc_feature (263)..(263): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (452)..(452): a, c, t, g, unknown or other
  misc_feature (452)..(452): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaacgccgtggggcctcgagtgaaggtctcctgcaaggcttcgtgttatacttttacactntggtatcaccgtgggtgtcgacgacggccctgggacaacgggacttgaggtggagtgggatggatcgagcgtattagagtaggaaacaacaaatatgacacaagtaaacgtttcggggacagacgtacacanacgacganacgacacactaccgacggtccaacacgactacagtaggagcgagggacnccgtagaccacctagacgacgacggtccgttagtacttacgtgtcgacgtagagtaacgtacgtccgtacgttacggaacggttacgggtaccgttggtaccgtacgggtagggacccgtaacgggacccttacggtccttccggtcctcccg

SEQ ID NO: 100275 - DNA, 706 bp, Homo sapiens
  misc_feature: GYAE6OF01EIRC2.24.45.E01.1.454.CMB.1.raw
  modified_base (316)..(316): a, c, t, g, unknown or other
  misc_feature (316)..(316): n is a, c, g, or t
tcagactactatgtcacgaccggtgctcgatttagtgagtcagtaagggaaagggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcgagtgaaggtctcctgcaaggcttcgtgttattacttttaacacctatgtatcacgtggtgcgacgacggccctgggacaaggtacttggagtggngtggggatgggatcgagcgtattagtaggtacgaaaacaacgtaaactagtcgacaagtaagtaaacggtttcggggataaggacgtacctaaccgaagtaccgaaccaaccgaaggaaccaacctacgtaccccgaaccgggtaacccaaccgaaccgtaccctaagacgtacggggacgtccggggttaggggaccgtacccgtacgacgacccgttacgggaacccgaccggaccgggtacccgttaaggttaccgtttacgtggtacggacggaacggtagtaattaacggtccggtaccggttagtaacgggttacggggacctacgtccggtaccgtggggacccgtacggggtaaccctcgggttcccttcccgcgttacccg

SEQ ID NO: 100276 - DNA, 737 bp, Homo sapiens
  misc_feature: GYAE6OF01A68KO.24.45.E01.1.454.CMB.1.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggacgcagtctggagctggaggtgaagagcgtgggctcgagtgagtctcgngcagtctgtgttactactttacactatgtntcacgtgggtcgacgacgacggcccgtggggacgaaggtcgttggacggttgggagtaggggacgtagggtatacgaggtacgtagttaagtacgggtaacggaaaacaacgtaaacttaggtacgaccgtaaacgtaacggttaaaacgggttcggggaactaggaaccgttaccaacgtactacggaacctacgaagaccaacgtacgacccgaccgacccgaacacggtacctacgaagtcgggacgcgggtaggaccgtaccgtagaacccgtcgtaccgggaaccgtaccgggacggttccgtaagtttaccgtaggttacgggaaggaccgtaggtaactaacgtaccggttcgtaccgttaacgggttacggggtaccggacggttacggtacccgggttccgggaccgggtacccccgggtaaacggttccccgggtaccggtttaccccgtcccgttccggtacccccg

SEQ ID NO: 100277 - DNA, 650 bp, Homo sapiens
  misc_feature: GYAE6OF01ALHZW.24.45.E01.1.454.CMB.1.raw
  modified_base (189)..(189): a, c, t, g, unknown or other
  misc_feature (189)..(189): n is a, c, g, or t
  modified_base (260)..(260): a, c, t, g, unknown or other
  misc_feature (260)..(260): n is a, c, g, or t
  modified_base (380)..(380): a, c, t, g, unknown or other
  misc_feature (380)..(380): n is a, c, g, or t
tcagactactatgtcacgaccggtgctcgatttagtgagtcagtaagggaaaggggacccaaaaaccacacccctccttgggagaatcccctagatcacagcctcctcaccatggactggacctggagcattccttttctggtggcagcagcaaccggtgccctctcccaggttcagctggagcagtcnggagctggaggtgaagagccgtggggcctcgagtgaaggtctcctgcgaggcttctggttatactttaacncctatggtatcaccgtgggtgacgaccgacgggccccgtaggggaccaagggtacttggagtggagtgggatcggatcaggctaagttagtagtaggaaactacgaaactagtgaccaanaggtaaacgttcgggacagacgtccacgatacgaaccagacgacacactaccgaccggacctacgacgcccaatacgtagggacgtcggtacggggacgccgtacgaccaccgtacggaccgtaccgaccggtacgttacgtacggttcgcgggttagaccgagacgtaactacggccgttaccggttagtacggggtcggtaaccgtcgtcgttacccggggtaggacccgtacggggaacccgtcggtaccctcccggttcctacccg

SEQ ID NO: 100278 - DNA, 708 bp, Homo sapiens
  misc_feature: GYAE6OF01C1OSB.24.45.E01.1.454.CMB.1.raw
  modified_base (191)..(191): a, c, t, g, unknown or other
  misc_feature (191)..(191): n is a, c, g, or t
  modified_base (337)..(338): a, c, t, g, unknown or other
  misc_feature (337)..(338): n is a, c, g, or t
  modified_base (342)..(342): a, c, t, g, unknown or other
  misc_feature (342)..(342): n is a, c, g, or t
  modified_base (481)..(481): a, c, t, g, unknown or other
  misc_feature (481)..(481): n is a, c, g, or t
  modified_base (567)..(567): a, c, t, g, unknown or other
  misc_feature (567)..(567): n is a, c, g, or t
tcagactactatgtcacgaccggtgctcgatttagtgagtcagtaagggaaagggacccaaaaaccacacccctccttgggagaatcccctagatcacagctcctcaccatggactggacctggagctattccttttctgggtggcagcagcaaccggtcgccctctcccaggttcagctggagcagtcgnggagctggaggtagaagacgccgtgggcctagagtagacgtctcgtgacgaggtcttcgtgttacttactttaacacttagtgtactccgtacgtggtcgaccgacgtcggcccgtaggacgagtcgtgaggtggaggtggagtgnngagngtatagtacgtaacgaactaacgaatagtacaacgacgtaaaggttaacggttcgggataacggaactccgaacgtagtaccaacccgaagtacgaacaccgtaccgaccgaccgaccaacgtacctaccgtagtacgnggaacgtcgggtacgggaccgtccggaccgaaccgtaccgtacggaaccgtaccggtaccggttacgttaaggtttacgttacggngtacggacgtaagtagtacttacgggtcgtaccgggttaacggtaacgggttaccgggacgtttccggtaccggtaaccggggtacgtacccggttaacccgggtacccgtttaccgtcccgttccccgttcgtaccccgg

SEQ ID NO: 100279 - DNA, 661 bp, Homo sapiens
  misc_feature: GYAE6OF01CPWZ7.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggacaggacctggagcattccttttcttggtggcagcagcaaccggtgccctctcccaggttcagctggagcagtctggagcgtgaggtagaagaacgccgtggggcctcgagtgaaggtcctccgtgacgtaaggtctttcgtaggtttaacttaacttttaacgaccttagtcggtatccgtaaccgtgggtcgacgacgacggtccccgtgggacgaaggtactttggaggtggaggtggagtggatcgagtacgtattagtaggtaggaaacaactaaatatgacaacgaagtaaacgtttcggggacaggacgtaccaactagtacgaccgaacgagaacacactaccgacggaccacgacgactacgagtacggacgacggtacgggacgtcgacgaccaccgtacgaacgaaccgaccggtaccgttagttacttaccgtggttacgacgaagtagacgtaacgtccgtcgttacgtagttacggacgcgtacgcccgtacggcggaccggtaccggtaccgttcgtcccgtccgttacccg

SEQ ID NO: 100280 - DNA, 784 bp, Homo sapiens
  misc_feature: GYAE6OF01ENKZ1.24.45.E01.1.454.CMB.1.raw
tcagactactatgtcacgaccggtgctcgatttagtgagtcagtaaggaaaagggcacagcatggacatgagggtccccgctcagctcctggggctcctgctactctggctccgaggtgccagatgtgacatccagatgacccagtctccactcctccctgtctgcatctagtaggagacagacgtcaccatcacgtttggttcgggacaagtgaacgtaccctaagttacgctaagtcctttcgttttaggtaacggtttcggacctaacttacctaaaacgtttaacccggaaaaacccggtaacgggggtaaaacccctaccccccttaaacccttccgttacggtaactttaccttaacgttaaccgtcggtaccgtttaaccctaaacgttttaaccgaacgttacggggttacccggggtacccctacgttacccgtaagggtttaccgagggttaccggactaaggtcggaacttccggtaagggactaagtacgttctaacctccgtacaacccgcttaccgagtccgtagtcctacgacctaacctacggtaacgtacgtttagtaccttaacgttaacttacttagtaacctaaacgtaacgttaaccgttaccgttaccggtttaccccggtaccgttaccggtaccgggtacgggaacgggtaaccgggtaagggtaggtaacgtaacgtacgaaccgtacgacggtgtaccggaccgtacgacctactcgtacgtcgttacttcttaccgtacccttccgtacctcgtacg

SEQ ID NO: 100281 - DNA, 646 bp, Homo sapiens
  misc_feature: GYAE6OF01D4K6A.24.45.E01.1.454.CMB.1.raw
  modified_base (360)..(360): a, c, t, g, unknown or other
  misc_feature (360)..(360): n is a, c, g, or t
  modified_base (476)..(476): a, c, t, g, unknown or other
  misc_feature (476)..(476): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcgagtgaaggtctcctgcaagcttctggttatacttttaacactagtggtatcaccgtgggtgcgacacggcccctgggacaaggtacttggagtggagtgggatggatcgaggcgtattagtagtaggaaacactaaactntgacaacgaagtaaagtttcggggacacgtacgtacaaccagtacgaacctacacgtacactaactcccgaaccggtccaacgacgaccctaacgagtcggagtccggtggggacnccgtacgacctaccgtacgaccgacgaccggaccgttagtacgttaaccgtggtacgccgaagacgtaataacgtccggtacccgttaagtacgggttacggggccttacggtcccgttaggtccggggaccgtacgggtaccccgttggtcccttccggtcgtaccccg

SEQ ID NO: 100282 - DNA, 807 bp, Homo sapiens
  misc_feature: GYAE6OF01A57DL.24.45.E01.1.454.CMB.1.raw
  modified_base (161)..(161): a, c, t, g, unknown or other
  misc_feature (161)..(161): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttgggtggcagcagcaaccggtnccctctccaggttccagtctggagcagtcgtggagcgtgaggtgaagacgccgtgggcctacgagtagaaggttcctaccgtgtacaggtccttagttaggtttaactttaacctttttaacaccgttagttaggttactccgtaccgttggggtcgtacggacgtaccgggtccccgtaggggacctaaagggtaccttagggaggttagggtacggttaggggtagtacggtatacgaggtacgttaagtttaacgtaagggtaacggaaaacctaaaccgtaaacttaagtcgaacgaaacgtaaggtaaacgggtttcgggaactaacggtacgtaccaacgtaacgtacgaaccgaactaacgtaaccgaacaccgtaaccgaccggtaacccacgtacggtaccctaacgtacggtacgggaacggtcgggtacggggacgtacccggaacggtacccgaccggtacggaccggtaaccggaccggtaccgttagttaccgttacggtacggtacggtacgaagtacgtaactaccggttaccgtacggttacggtaacgggttaccgggtaccgttaccgaccggttacgggaccggaccgttaaccgggacgttaccgttccgtaccgtcccgtaccg

SEQ ID NO: 100283 - DNA, 735 bp, Homo sapiens
  misc_feature: GYAE6OF01C2P9Q.24.45.E01.1.454.CMB.1.raw
  modified_base (197)..(197): a, c, t, g, unknown or other
  misc_feature (197)..(197): n is a, c, g, or t
  modified_base (602)..(602): a, c, t, g, unknown or other
  misc_feature (602)..(602): n is a, c, g, or t
  modified_base (662)..(662): a, c, t, g, unknown or other
  misc_feature (662)..(662): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagctattccttttcttgggtggcagcgagccgtaaccgggtcgcccctccttcccgaggttccagcgtggancaggtctggagctggaggtgaagacgccgtgggacctcgagtggacggtctcgtgacgtaggtcttcgtggttaattaccgtttaacactagtgtactcgtacgtggtcgactacgcgcccggtggacgaggtacgtgaggtggagtggagtagctagagtacgtattaggtacgtaagaaacctaagtaactagacgaccgtaagtaacggtaaacgggttcggacgttaagacgtaccaacgtaagtaccgaacgtacggaaccaaactaccgacgtaaccccggacgacccaacggtccgtaacctagacggttacggacgggacggtacgggtaccgaccgtccggtaaacctcccggtaacgtaccggaccgtaccgggtcgttaacttacggttaccgngtacgggacgttaaggtacgtaacgtacgtccgttaccggtaagtacggggtaacccggngttaaccggtccggttacgggtaccggttaccggaaccggttacccggtcgttcccggtccgtccgtacccgg

SEQ ID NO: 100284 - DNA, 957 bp, Homo sapiens
  misc_feature: GYAE6OF01CX89T.24.45.E01.1.454.CMB.1.raw
  modified_base (143)..(143): a, c, t, g, unknown or other
  misc_feature (143)..(143): n is a, c, g, or t
tcagactactatgtcacgaccggtgctcgatttagtgagtcagtaagggaaagggacccaaaaccacacccctccttgggagaatcccctagatcacagctcctcaccagtggactggacctggagcattcctttcgtggtgnagcagccaaccggtcgccctctccgaggttcagctggagctagtcgtggacgtcgttaggaggtagaaacggacggtccgggtcggggacctcggtaaggttacggaacggttccgtacccgtaggaccggtaacggtctttacggttaggttaacttttaacccgtttaaaccgtaccttagttacggtacttccgtacggttgggtacgaccggtaaccgccgggtccccggtagggaacgtaacggtacgtagggaggtagggtacggtaggtagtacggagtacgtacggtaacgttaataacggttaagggaaaccgtaaaactaacgtaaacgtacgtacgaaaccgtaaggttaaacggttaaacggggtacggaacgtacggtaaccgacctaacgtaacgtaaccgaaccgaacgtaaaccggaacctaccgaacccgtccggaacccggaaccgtaacgtacccgtacccgttaaggaccggtaacgggtccggtaacgggtacccggggtacgttaccggaccggtaacccccgtaggtacccggaaacgggtcccgttaacccggggttccgtttaacggtttaccgttcgggaccgggtaaacgacgggttaacgtaaccgggtaacgtttaccccgggttaccggttaaccggggttttaacggaaacccggggggtttcccgaaccggtttccgggttaacccccggggacccggggggttaacccggtaaccccggttaacccgggggttccccgtttaccgggttaccccccgttaccgggttcccccggtaacccg

SEQ ID NO: 100285 - DNA, 776 bp, Homo sapiens
  misc_feature: GYAE6OF01APB68.24.45.E01.1.454.CMB.1.raw
tcagactactatgtcacgaccggtgctcgatttagtgagtcagtaagggaaagggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagccgtggggcctcgagtgaaggtctcctgcaaggtcttctggttatacgtttacacctatggtatcgaccgtgggtcgcgacgacggccccgtgggaccaaggtcttggagtggagtgggatggactcgagcgtattagtagacggaaactacaaagtgtacgactaacgaaggtaaagtttccggggagtaacgtacgttaccaaccgtagtaccgaaccaacgacgaacacctaactacccggtaaccgaccctaacgaccgtacccgttaagacggttacgggacggtcggttacggggaaccggttcccgtacggtaaacccgtaccgtaacggaccggtaacccggaaccggggttccctttaagggttaaccgtttaccggtacgggttccgaacggtaacggtacgttaaacgtaccggttaccggtacccggtttaaccgggtaaacggggtttaccgggtaccccgttacggtacccggttaacccggggtacccggggtaaccccgggtaccgggtaaccccgtttccggggttaccccgttccccggttcgttcccccgg

SEQ ID NO: 100286 - DNA, 646 bp, Homo sapiens
  misc_feature: GYAE6OF01BUFN0.24.45.E01.1.454.CMB.1.raw
  modified_base (358)..(358): a, c, t, g, unknown or other
  misc_feature (358)..(358): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctggaggtgaagaagccgtggggcctcagtgaaggtctcctgcaaggtcttctaggttatacttttaacactatggtatcaccgtgggtgcgacacggccctgggcaaggacttgagtggatggggatgggatcgagcgaattatagtaggaaaacataaaactntagacacgaagtaaacgtttcggggacaggagtccgaacatacgaaccagaacgaacactactacccgacggacccacgacgaccctaacagtaggacggcgtaggggacgtccgagaccgaccgtacgaaccggacgacggaccggttgtaacttacgtgtaggtcggaagagtaagtaacgttcccggtacggttacgtacgggttacgggtaccctcggtacccgtaccggtcggggacccgtaacggggtacccgttcggtacccgtttcccgtcttaccccgg

SEQ ID NO: 100287 - DNA, 714 bp, Homo sapiens
  misc_feature: GYAE6OF01BBEX6.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtagaagagccgtggggcctgagtgaggtctctgcagtcttcgtggttattactttaacactatggtactcacgtgggtgcgacgacggccccgtggggacaaggtcttaggaggtggagtgggatggctacgagcgtattagaggtaggaaacaactaaatagtagactacaaggtaacggttcggggacagtacgtccactacgtacgaaccacgacgaacacactcccgaccgaccaccgacgtaccactaggacggacggtcgggtacgggtaccgcccgtaacgaccgtaacccgttacggaacccggtaccccggtaccgggttaccggttacgttaacgtttaccggtacgggttcggaacggtaaggtaacggtaaacgttccggtacccgttacccggtttacggtaccggggttaacgggtacccgttcggtaccccgttacgggtaccccgggggacgtacccggggttacccggtccgggttacccttccccgttcgttaccccg

SEQ ID NO: 100288 - DNA, 888 bp, Homo sapiens
  misc_feature: GYAE6OF01CBGHF.24.45.E01.1.454.CMB.1.raw
  modified_base (277)..(277): a, c, t, g, unknown or other
  misc_feature (277)..(277): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagcctggggcctcagtgaggtctctgcaggcttctggttatacttttaacacctagtggtatccacgtgggtcncgacacggccctgggcaaggcttgagtggagtggggatgggatcgagcgtattaagtacgtaggaaacacgtaaaactagtcgaccaacgaaggttaaacggtttcgggggacaacggtacgttaccaaccgtaatacgaaacccaactaagaccaacgacgtaccccgaaccgggtacccaaacgtaccgacccttaaacgacgttacggggaacgcccgggtttacgggggaaccgtacccgttaacgggaacccgaaccccggtttacggggaaccccggtaacccggtaccgggggtttacccccggttaaggttttaaccccgtttaaccggttacggggtacccggtaaccgggttaaagggtacggttaaaaccgtttaaccccggttaccggggttaccccggttttaaccggggttaaaaacggggggtttttaacccccggggggaaccccttttacccgggggttaaccccggttttaaacccggggggtacccgggggggtaaaccccccgttaaaacccggggggggtttacccccctttaaccggggggtttccccccgtttacccccgggttttaacccccggttacccccccggg

SEQ ID NO: 100289 - DNA, 645 bp, Homo sapiens
  misc_feature: GYAE6OF01DURQT.24.45.E01.1.454.CMB.1.raw
  modified_base (119)..(119): a, c, t, g, unknown or other
  misc_feature (119)..(119): n is a, c, g, or t
  modified_base (131)..(131): a, c, t, g, unknown or other
  misc_feature (131)..(131): n is a, c, g, or t
  modified_base (318)..(318): a, c, t, g, unknown or other
  misc_feature (318)..(318): n is a, c, g, or t
  modified_base (432)..(432): a, c, t, g, unknown or other
  misc_feature (432)..(432): n is a, c, g, or t
tcagactactatgtcacgaccggtgctcgatttagtgagtcagtaagggaaagggcacagcatggacatgagggtccccgctcagctcctgggcctcctgctgctctggctctcaggtnccatatgtgacntccagatcgacccagtcctccatcccgtccctgtctgcatcgtggtcgggagacagacgtccaccattccttacgtcgccgaggacgaggtccgaggactaactttaacttacgtttagtaattggtatacaataaccaaaaccgtaggaccgtaaccggtaccctaaactccgtagtacaacgtancgacactacgagtcggacgccgacgggcccagtacgaagtcgacggcgacgtaggtacgacgtcgtagtaactcgtttcctacgtaccctacacctacgtaccacggtccgacnggtccgacgtacgtagaagttgtacggtcacgtactaagtttacttacgagtaacaactaacgttagtaacgtactaattacgttcgttaacttacgggtttacgggaccggtaaagggggtacctaagggtcgaaccgtccgttaacgaaaccgttgtacggtcgactcggaactccgtattccggtcttactaccgccttccgtccgtacg

SEQ ID NO: 100290 - DNA, 799 bp, Homo sapiens
  misc_feature: GYAE6OF01CY2ZP.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagagccgtgggcctcgagtgaaggtctcctgcagcttcgtgttattacttttaacactatcggtatcaccgtgggtcgacgacgacggcccgtgggacaaggtacttggaggtggaggtgggagtggatcgagacgtattagtaagtaggaaacaactaaactagtgacacgtaagtaaacggtttcggggactaggaacgtaccaaccgtaacgtacgtaaccgaacctaacggaacccaacctacgtacccgaacccggaccctaaccgaaccggtaccctaacgacggtacgggacggtcgggtacggggtacgaccccggtacggaaccccgacccggttaacggacccggtaaccgggtacccgggttaccggttaacgtttaccggttttaaccgttcggggtacgtaacgggtaacggtaacgtaacggtttaaaccgttccccggttaccggtttaaccggtaacggggtttacccggggacccgttacccgggtacccggttaaccggggttcccgggaaccccgggttaaccggggttaacccccggtttaccggttcccggtccccgtttccccgtttacccccgg

SEQ ID NO: 100291 - DNA, 592 bp, Homo sapiens
  misc_feature: GYAE6OF01B3DI0.24.45.E01.1.454.CMB.1.raw
  modified_base (438)..(438): a, c, t, g, unknown or other
  misc_feature (438)..(438): n is a, c, g, or t
tcagactactatgtcacgaccggtgctcgatttagtgagtcagtaagggaaaggggacccaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggccctgggcaaggcttgagtggatgggatggatcgagcgattagtagtaggaaacacaaactatagacacaaggaaatttcggggactaaggacgtacaccgatacgaccagagacacatccacgccacacgacctacagtggagcgtggggacncgtagacacgtacgacgacgacggtccgtagtactacgtgtacgcgagtagaagtagtccgtacgttacgaggtttaccggggaccttcggaccgttaccggtacggggacccgtaacggggtaccccttgggtaccctccggttcgttacccg

SEQ ID NO: 100292 - DNA, 733 bp, Homo sapiens
  misc_feature: GYAE6OF01E5MC2.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggtcctcctgcaaggtcttctggttatacttttaacaccttataggtatcaccgtgggtcgtcgacacggccccgtgggacaaggacgttggagtgggagtgggatggactcgaggcgtattacgtaggtacggaaacacaaaacgttatacgcaacgtaagtaaaggtttacggggactacggtagtaccgaaccgtataccgaccaacgtaacgaccaacgaacgtacccgaccggacccaacgacgtaccctaacgacgtacgggagtaccgggtcggggaaccgccccggaacgtacccgtacggacccgaccggaccggtacggtagttacgttacgtgggttacgccggtaagaagtacgttaaccgtccgttaccggttaccgtaacggggttacccgggaccgttcgggtacccggttaccgggtacccgggggtaccgaacccggggttaccccgggttaccgttcccggttaccccggtaccctcccggttaacccgg

SEQ ID NO: 100293 - DNA, 727 bp, Homo sapiens
  misc_feature: GYAE6OF01A0RGE.24.45.E01.1.454.CMB.1.raw
  modified_base (161)..(161): a, c, t, g, unknown or other
  misc_feature (161)..(161): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttgggtggcagcagcaaccggtnccctctcccaggttcagctggagcagtctggagctggaggtagaagaacggccgtggggacctgaggtgaaggtcctccgtagacgtaaggtcttacgttaggtttaacttaaccttttaaccaccgtttagtacggtacttaccgtacggtggggtacgaccggaacgaccggtccccgtagggactaaggcttggagtggagtgggatggtactcgagtacgtaattaagtaggtaaacggaaactaacaaattagacgtaacgaacgtaaggtaaaggtttacgggactaaggtacctacgaactaagtaccgtaaccaacgaagaacctaaccaccgtacccgaaccggtacccaaccgtaacgtacctaaacgaggttacggaacggtccgggtaggggacctccgtaacgacctaccgacggaacgaaccggtacggtacctagttagtacgtaggtacgacgaagactacacgtccggtaacgtaccggtaaggtcccgggacctcggtacggtacggtacggaccggacgggttacctcggtcctcccggttctaccg

SEQ ID NO: 100294 - DNA, 736 bp, Homo sapiens
  misc_feature: GYAE6OF01C2EQR.24.45.E01.1.454.CMB.1.raw
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
  modified_base (527)..(527): a, c, t, g, unknown or other
  misc_feature (527)..(527): n is a, c, g, or t
tcagactactatgtcacgaccggtgctcgatttagtgagtcagtaagggaaagggacccaaaaccacacccctccttgggagaatcccctagatcacagctcctcaccatggactggacctggagcattcctttctggtggcagcagccgaaccggtcgccctctcccgaggttacagcgtaggagcgagtcgtggagtcgtaggagggtacgaaaggtaacggccgtggggccctagagtaggaacggtcctccgtgacgtaaggtcttagtggttaacttacgtttaacacgtagtggtactacgtacgtggtcgacgacgtacggtcccgagggactaacggtgttaggaggtggtagtggaagtggatacgagtacgtaagtttagaggtaaacggaaaactaacgtaaaactagtcgaacgtaagtaagttaaacgggtacgggacagtaacctacgactaagtcgaaccagagacaagtccacgacgcaacngaccganagtagggactcgggtacggacnccgtaagacccgttacgtaacgaaccgaccggacggttcgttaagttaccgttacgtaggtgaacgggttaacgtagttaaacgtaccgtaccccggttggttaaccggtaacgggttaacggttacccgtaggtaccccgtagggggttccgggaaacccggtttaccgggaccgtttccggtaacccgtccccgttaccgtacccgg

SEQ ID NO: 100295 - DNA, 720 bp, Homo sapiens
  misc_feature: GYAE6OF01BUCZF.24.45.E01.1.454.CMB.1.raw
  modified_base (610)..(610): a, c, t, g, unknown or other
  misc_feature (610)..(610): n is a, c, g, or t
tcagactactatgtcacgaccggtgctcgatttagtgagtcagtaagggaaaggggacccaaaaaaccacacccctccttgggagaatcccctagatcacagctcctcaccatggactggacctggagcattccttttcttggtggcagcagcaaccggtgccctctcccaggttcagctggagcagtctggagctgaggtggaagagccgtggggcctcgagtgaaggtcctcctgacgaaggtcttcgtggtttactacctttttaacacttatggtactcgaccgtgggtacgccgaccgacggtccccgtggggacaaggtccttaggagtgggagtggggatggactcgagcgtagtttagtagttacggaaaactacaaacttagcgtaccaagtaaggttaaacgtttcggggacgtaaggtacgtacgaaccgtagtacggaacccaacgacgaccaacaccgtacccgaccggacccacgtaccgtaccctaagtacgtacgggtaagtccgggttacggggaacctccggttacgtaaccccgtaccgtaccggaacccgggtaccgaccgggttacccggtagtttaacgtttaccggnggttaccgggagtagtaacgtaactacggtaccggttacgtacggtagggttaaccgggtcccaggtcccgtaggcgggactaccgggcccgttgtcctcgttccgtccg

SEQ ID NO: 100296 - DNA, 772 bp, Homo sapiens
  misc_feature: GYAE6OF01ENSOR.24.45.E01.1.454.CMB.1.raw
  modified_base (127)..(127): a, c, t, g, unknown or other
  misc_feature (127)..(127): n is a, c, g, or t
  modified_base (165)..(165): a, c, t, g, unknown or other
  misc_feature (165)..(165): n is a, c, g, or t
tcagactactatgtcacgaccggtgctcgatttagtgagtcagtaagggaaagggacccaaaaaccacacccctcttgggagaactcccctagatcacagctcctcaccatggactggacctggacnctacttccttttcgtgggtgcagcagccgaaccggtcnccctctcccgtaggttcagtcgtggagcagtcgtggagcgtggaggtagaacgtacgtccggtgggacctagaggtacgtacggtcctaccgtgacgtacgttcgttagtttacggttaactttaaccgtttaaccactttagtacgttaccgtcgtaccggttgggtaccgaccgtaacggccggtaccggtaggaacgtaacggtacggttaggacgggttaggtacggtacggagttacggtactacggtacgtaacgttaagttaacggttaaagaaaccggaaaacttaaagtacgttagtaccgaccgttaaaggtaccggttaaacggttggaactacggaacgtaacaacgttagaacccgtaacgactaacgccttaacgacctaccgaaccgacctacgtaccgacgtaagtagacgggaggtacccgggtaggccgtaccgaacgccgaacgtaccggaaccgtacgtccggttaactacttaacggtcggtagaccgtaagaggtataccgtgttacccggttacgtagggtacggtcgtacggtcggtacgggtccgggacgaccggttcgtaccttcggcccttcgtctaccg

SEQ ID NO: 100297 - DNA, 770 bp, Homo sapiens
  misc_feature: GYAE6OF01C0VBI.24.45.E01.1.454.CMB.1.raw
  modified_base (287)..(287): a, c, t, g, unknown or other
  misc_feature (287)..(287): n is a, c, g, or t
tcagactactatgtcacgaccggtgctcgatttagtgagtcagtaagggaaaggggacccaaaaaaccacacccctccttgggagaatcccctagatcacagctcctcaccatggactggacctggagcattccttttcttggtggcagcagcaaccggtgccctctcccaggttcagctggagcagtctggagctggaggtgaagagccgtggggcctcgagtgaaggtctcctgacaggtcttcgtggtttactacttttaacacctatggtatcaccgtgggtncgacgcggccctgggcaaggcttggaggtgggagtgggatggatcgagtcgtatttagaaggtaggaaaacaacgtaaaactagtagaccaagtaaggtaaacggtttcggggactaagacgtaccaacctagtccgaaccaacgagaccaaccgaccgtacccgaacccgggtacccaaccgtaaccgtacccgtaacgacgtaacgggacgtccgggtacgggggacctacccgtacggacccgtaacccggtacggaacccggaacccggtaccgggtaccgtttaacggttaacgtttacgggttcggtacggtacggtaacggtaacgtaacgttaaccggttccgggttacccggttacgggtaacgggtttaaccggggtcccttaccgggtaacccggttaccgggtacccgggggacccggtaacccggggttaccccgttccgggtttccccgtcccggttcccgttacccgg

SEQ ID NO: 100298 - DNA, 901 bp, Homo sapiens
  misc_feature: GYAE6OF01CGBPO.24.45.E01.1.454.CMB.1.raw
tcagactactatgtcacgaccggtgctcgatttagtgagtcagtaagggaaaggggacccaaaaaaccacacccctccttgggagaatcccctagatcacagctcctcaccatggactggacctggagcattccttttcgttggtggcagcagcaaccggtcgccctctcccaggttcagcgtggagcagtcgtggagcgtggaggtagaagacgcgtggggcctagaggtaggaacggtctccgtgcgaagtcttacgtaggtttaacttactttaccacttagtaggtactaccgtacggtgggtcgaccgaacgtccgggcccgttgggaacgtaacggtacttggtaaggtcggtaggtgggagtggatacggagtacgttaagtttaacgtaagggtaacgaaaacctaactaaagtacgtacggtaactaaacggtaaaggttaaaccggtttaccggggaacgtaacgggtaaccgtaacctaaccgtaaatacccggtaaaacctaaacggaactaaaccgtaccgtaaccgaccccggaaccggacccgaaaccgtacccgtaccccgtaaaggtaacggaccggggtaccggtacgggtaccggggtaccctccggtaaccgtaacccgtaccggtaaccggaaaccgggtacccgggtaaccggttaccggtttaagtttaaccgttacggttacggacggtaaaccggtaggttaaacggttaacttacccgggttacccggtaaccggggtttaaccggttacggggttaacccgggttacccgttacgggtaacccccgggtttaccggggggacccgggttaaccccggttaaacccgggtttcccggtacccgggttttacccttcccggttccccgttacccgg

SEQ ID NO: 100299 - DNA, 894 bp, Homo sapiens
  misc_feature: GYAE6OF01BML36.24.45.E01.1.454.CMB.1.raw
tcagactactatgtcacgaccggtgctcgatttagtgagtcagtaagggaaaggggacccaaaaaccacacccctccttgggagaatcccctagatcacagcctcctcaccatggactggacctggagcattccttttcttggtggcagcagcaaccggtcgccctctcccaggttcagctggagcagtctggagctgaggtgaagagccgtgggcctcgagtggaaggtcctccgtgacgaaggtctttcgttaggtttaacttaacttttaaccaccgttagtacggttactccgtaccgttgggtcgaccggtaaccgaccgggtcccccgtaggggtacctaaagggtaccgtttaggacggttagggaaggttgggggtaagtttggggaactttacccggtaaggtaccggtttaagtttaacgggtaacggttaaaccggggaaaaaccttaaaccgtaaaaccgtttaacgtaccggtaacgtaaaccgtaaacgggtttaaaacgggtttacccggggggaacgttaacggtaaacccggtaccctaaaccgtaaccgttaaccgaaacccgaacgtaaccggaaacctaaccgaacccgttaaccccgaacccgaccctaaacccgtaccggaacccgttaaacaacgggttacgggacggtaccggtacggggacgtacccgttacgacccgtacgtaccggaaccggtccggtaaccggtcgttaagttaccgtacgttcggtacgaggtactaggtacttaccggtacgttaccggttaccggttaacgggttacggtacccgttacggtaccgggtaccgggttaccgggaccggttaccgggtaccggtaccggtttcccgttaccccgtcggttcccg

SEQ ID NO: 100300 - DNA, 1095 bp, Homo sapiens
  misc_feature: GYAE6OF01DFCDX.24.45.E01.1.454.CMB.1.raw
tcagactactatgtcacgaccggtgctcgatttagtgagtcagtaagggaaaggggacccaaaaaccacacccctccttgggagaactccctagatcacagctcctcaccatggactggacctggagcattccttttcttggtggcagcagcaaccggtgccctctcccaggttcagctggagcagtctggagcgtgaggtagaagacgccgtggggcctcgaggtaggtaacggtcctccgtgacgtaaggtcctttacgtagggtttaacttaacctttttaaaccaaccgttagttgggtaacttacccgtaacccggttgggggttccgaccggtaaccggtaacccggggtccccccggttagggggacccgtaaaaacggggtaccgtttaggggaacgggtttcgggggtaaacgggtttcgggggggtaaagtttacgggggtaacgtttacggaaaccggggttaccggttaaaacgttttttaaaaggtaaacgggggttttaaacggggaaaaaaaccctaaacccggttaaaaaaaccgttagttacgggaaacccgtaaaccgtaaaaggggttaaaaacgggttttttcccgggggggaacttaaacggggtaacgtttaacccgaaaccgtaaacggttaccgggaaacccaacggaaacggtaacccaaaccggtaccgtaaaccccggaacccggggacccctaaccgtaaccggtaaccccttaaaaccgtaggttaacggggaacgggtaccccgggtaggggggtaacctaccccgggtaacggtaaccccgtaaccgttacgggaacccggtaaccggaacccggggttcccgtttaaggttaaccggttttaacgtcgggtaaccggtacggaacgggtaacgttaaacgggtaccgtttaccgggtacccggtttaacggttaaacggggggtttaaccccgggggtaaccttccgggttaacccccgggttaaccggggttcggggggtaacccccgggtaaaccccgggggtttaaacccccgggttgggtttacccccggttcccggggtttccccttaaccccccggg

SEQ ID NO: 100301 - DNA, 799 bp, Homo sapiens
  misc_feature: GYAE6OF01BU3Y3.24.45.E01.1.454.CMB.1.raw
  modified_base (127)..(127): a, c, t, g, unknown or other
  misc_feature (127)..(127): n is a, c, g, or t
  modified_base (197)..(197): a, c, t, g, unknown or other
  misc_feature (197)..(197): n is a, c, g, or t
  modified_base (524)..(524): a, c, t, g, unknown or other
  misc_feature (524)..(524): n is a, c, g, or t
tcagactactatgtcacgaccggtgctcgatttagtgagtcagtaagggaaaggggacccaaaaaccacacccctccttgggagaatcccctagatcacagctcctcaccatggactggacctggancattccttttcgtggtgcagcagcaaccggtcgccctctcccgaggttcagcgtggagcgagtcgtggancgtggaggtacgaaggacgccggtcggggccctagaggtacggaacggtccttaccgaggacgtaaggtcctttcgttaaggtttaacttaactttttaaccgaccgttagtcggtactaccgtaccggtaggtcgaccgtacgaccggtcccgtagggactaaacggtcgttaggtagggtaggtaaggtggggtaacgtggtaacgtacgaggtacgtaaatttaggtaacgtaaacggaaaactaacgtaaaatgtacaacgtaaagtaaggtaacggttcgggactaacggtacgtaacaaccgtactacggaacctacgaanaaccgactaaccgtccgaaccggaccaacgaccgtaaccgtactaacgggagaccggtacgggtaggggaccctacgtacgtaacccgaccgttaaggaaccggtaaccggtacgggttccgttaaagttaccgttaacggtcggacggaaacgaacgtaggtaaccgtacggttcccggtaccggttaagggtaacggttaccgggacccttaggtaccctagggacccgggtaccgaaccggttaccgtcggttaccctcccgtcgtaacccg

SEQ ID NO: 100302 - DNA, 868 bp, Homo sapiens
  misc_feature: GYAE6OF01AV0OC.24.45.E01.1.454.CMB.1.raw
  modified_base (267)..(267): a, c, t, g, unknown or other
  misc_feature (267)..(267): n is a, c, g, or t
  modified_base (334)..(334): a, c, t, g, unknown or other
  misc_feature (334)..(334): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtcgtggagcgtggagggtgaagagccgtgggcctcgagtgaggtcctctgacagtctctgtattacttacactagtgtacncgacgtgggtcgcgactaccggcccgtaggacaaggtcttggaggtggagtacggggactaggtacncgtaggtacgtaagtaacgtaggaacggaaaacaacctaaacttgacgtacaaacggtaagttaaacggttcgggactaaggtcggtaacctaaccggaataccggtaaacccaagtaacggtaatacctaacgtacgtacgttaccggaccaaccgacgtaacctaacgtacggtacgggtaacggttacgggacggggtaaccgttcccgtaaacggtacccgtaaccggttaacccggaacccgggttaaccccggtacccgggggtttaacccgtttaaaccggggttttaacctttaaccgggttacggggtaaccgttaacggggaaaccggtttacgaaacgtttaaccgggttccccgggtttaaacccggggttaaacggggtaccgggttttaaccggggggtacccccgtaaccggggtttacccgggttaaaccgggggtacccgggggtaaccccggtttaaccccgggggttaaaccccgggtttcggttaaacccccggtttccgggtttaaccccccg

SEQ ID NO: 100303 - DNA, 895 bp, Homo sapiens
  misc_feature: GYAE6OF01C64G3.24.45.E01.1.454.CMB.1.raw
tcagactactatgtcacgaccggtgctcgatttagtgagtcagtaagggaaagggacccaaaaccacaccctccttggagaatcccctagatcacagcctcctcaccatggactggacctggagcattccttttcgttgggtggcagcagaccgaaccggtcgtcccctcgtacccgtaggttcagcgtaggacgctagtcgtggagcgttggaggtaggaaacggaacgtccggtacggggcctgaggtacggaacggtccgtacgtcggaccgtaggttctttacgttacggtttaacttttaacccgtttaacctaccgttaagttacggttacgttaccgtaccggtaggggttaccgaccggtaccggtaccgggtcccggtagggaccgtaaggttacggtaggtaggtaggtaaggtggtacgtaggtacgtacgaggtaacgtaagttaaggaacgtaaggtaaaccaactaaacgttagacgtaacgaaacgtaaaggttaacggtacggggactaacggtacgtaaccgaaccgtagtaaccgaaaccgaccgaaacgtaaccaccgtaaccgaacccggacccgtaaccgaaccgtacccgtaaccgtaacggtaacgttaacgggacgggtacgggtaccgggaacttacccggaccgtaccgtaaccgggaccgaaccggtaccgggaccggttaacgtacgttacgtacggtacggaacggtacgaacggtacgtaacgttaccggttacggtccccgggtttaaaggtacccgggttaaccggtaccgttaccggtaccggtacccggggtacccgggttaacccggttaaccggggttaaccccgtcggttaaccccggttccgttcccggtaaccccg

SEQ ID NO: 100304 - DNA, 994 bp, Homo sapiens
  misc_feature: GYAE6OF01E39UB.24.45.E01.1.454.CMB.1.raw
  modified_base (128)..(128): a, c, t, g, unknown or other
  misc_feature (128)..(128): n is a, c, g, or t
  modified_base (164)..(164): a, c, t, g, unknown or other
  misc_feature (164)..(164): n is a, c, g, or t
  modified_base (206)..(206): a, c, t, g, unknown or other
  misc_feature (206)..(206): n is a, c, g, or t
  modified_base (334)..(334): a, c, t, g, unknown or other
  misc_feature (334)..(334): n is a, c, g, or t
tcagactactatgtcacgaccggtgctcgatttagtgagtcagtaagggaaaggggacccaaaaaccacacccctccttgggagaatcccctagatcacagctcctcaccatggactggacctggacnctacttccttttctggtggcagcagccgaccggtcnccctcctccgtagttcacgcgtggagctagtcggtaggacgngtggaggtagaacggtacggtcggtcggggtcctacgaggtacgaacggtccgtccgtacgtacggtaacggttcttacgtttacgttttaactttaacctttttaaccgaccgttagtggtttaacnccggacggttcgggtaccgaccgaccggtacccggtaccggtaggggtaaccggtaaggtacggttagggtaacggtaggggtacggtagggagttaccggtaagttacgacggtttaaaaggttacgttaaaagggtaaaccgttaaaccgtaaaaaccgaaacgttaaacgtaccggtaacgttaaaccggtaaaacggttaaacggggttaacccgggtaacggtaaaccgggttaaaccggtaaaccctaacccggtaaacgttaaccccggaaacccgtaaacgaaaaccctaaccccgggtaaacctaacccccggtaaccgggtaaacccgaccccggtaaaacttaccgggtaacccggtaacgtacgggtaaacggggtccggggtaacgggtacccgggtaccgtaaaccggttcccgtaaaccgaacccgggtaccccggacggttaacccggttcggtacccggttcgttaaacgtacggtcccgttaagggaccgtacgttaacggtaacccgttcgtaccggtttacgggtacggttaaccggggtccgttaccggacccggtaccggtccgggtaacccgggttacccgtaacccggggttaccctaccgggtttccccggttaccctccccgtcttaacccggg

SEQ ID NO: 100305 - DNA, 741 bp, Homo sapiens
  misc_feature: GYAE6OF01AM9T9.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagcgtgaggtgaagaagccgtggggcctcgagtggaacggtctcctgcaaggtcttcgtggttattactttaacacctatgtatcaccgtggtcgcgacacggtcccgtgggctaaggcttggagtggagtagggatggatcgagacgtattagtagtaggaaaccaacgtaaactagtacgacaaacgtaagtaaacggtttcggggacgaacggacgtaccaaccgtaacgtaccggtaacccaacgtacggaaaccaccgtaaccgtaccccgaacccgggaacccaccgaacgtacccctaacgacggtacgggacggtaccgggtacggggcctaccgtacgaccgtaccgtacgggaaccgaccggaccgggtccgttacgttacgttacgtcggtaggacgtaacggagtaacgttacgtccggtacccgtttacggaacggggtttacccgggacccttacgggtaccccggttacgggttacccgggggtacccgaacccggggttacccgtccggtttccccgtcccggttcctaccccgg

SEQ ID NO: 100306 - DNA, 811 bp, Homo sapiens
  misc_feature: GYAE6OF01CKHZ1.24.45.E01.1.454.CMB.1.raw
  modified_base (127)..(127): a, c, t, g, unknown or other
  misc_feature (127)..(127): n is a, c, g, or t
  modified_base (182)..(182): a, c, t, g, unknown or other
  misc_feature (182)..(182): n is a, c, g, or t
tcagactactatgtcacgaccggtgctcgatttagtgagtcagtaagggaaaggggacccaaaaaccacacccctccttgggagaatcccctagatcacagctcctcaccatggactggacctggancacttctttctggtggcagcagcaaccggtgccctctcccaggttcagcgtgganctagtcgtggagtctggaggtgaagtacgcggtgggcctacgagtagacgtctcgtggactaaggtcttacgtacgtttaacttaacgtttaccaacttggtacgtactaccgtacggtcggtacgaccgaccggtaccggtcccggttagggaaccgtaagggttacgttagggaggtagggtagggtagggtaagttcggagtacgacggttacggttaaacgtttaagtaacgggttaaacggaaaacctaaacgttaaaccgttacgacgtaaaccggtaaacgtaaacggtttaacgggttcccggggactaacggtacgttaacccgaacgtaagtacccgaaactaccggtaaacgtaaccgacgtaacccgtacccggaacccggaccgtaaccgaaccgttaaccgtaagccgggttaacggaaccgggttcggggaccggaccggtaccgtacgaccgtaacggtccgaccggaccgtcgtacgttagttacctagtcggttacgagacggtactaacgtcgtaccgtaggttaccggtaagggttccgacggtacggtccggtaccgggtaccggtacggtaccgggttaccctccgggtactccccgtcgttacccg

SEQ ID NO: 100307 - DNA, 708 bp, Homo sapiens
  misc_feature: GYAE6OF01AHS3Q.24.45.E01.1.454.CMB.1.raw
  modified_base (629)..(629): a, c, t, g, unknown or other
  misc_feature (629)..(629): n is a, c, g, or t
tcagactactatgtcacgaccggtgctcgatttagtgagtcagtaagggaaggggacccaaaaaccacacccctccttgggagaatcccctagatcacagctcctcaccatggactggacctggagcattcctttttcttggtggcagcagcaaccggtgccctctcccaggttcagctggagcagtctggagctggaggtgaagaacggccgtggggcctcgagtgaaggtcctcctgacgaaggctttcgtaggttaacttacttttaaccacctagttaggtatccgacgtgggtacgcgacgacggcccgtggacaaggacgttggagtaggacgtggactaggagtacgaggtacgtattaagtaaggtacggaaactaacgaacttagtacgaccgtaaacgtaaggttaaacggttacggggactaaggtactaccgaactaagtacccgaaacccaagtaaccggaactacccgaacgtaacccggacgaccaaccgtacgtaccctaaacgtaaggtcgaacgggtacgtacggggactaccgtacggaccctaaccggtacaaccggaccgtaccggtacgttacgtagtttacagtacgaacgaggtaacagttaacnccgtacgttgacgggttcgaccctacggtaccggtcgtaggacccgtaacgggtacccgtcgttacctccggtctaccg

SEQ ID NO: 100308 - DNA, 804 bp, Homo sapiens
  misc_feature: GYAE6OF01DITTT.24.45.E01.1.454.CMB.1.raw
  modified_base (127)..(127): a, c, t, g, unknown or other
  misc_feature (127)..(127): n is a, c, g, or t
tcagactactatgtcacgaccggtgctcgatttagtgagtcagtaagggaaaggggacccaaaaaccacacccctccttgggagaatcccctagatcacagctcctcaccatggactggacctggancattccttttctggtggcagcagcaaccggtgccctctcccagttcagctggagcagtctggagctaggaggtagaagacgcgtgggcctcgagtagaagtctctgcagtcttcgtgttattactttacactgtgtatcacgtggtcgcgtacgacggtcccgtaggacgtacggtacgttaggaggtggaacggtgggtactagggtactacggaggtacgttaagttaagtaaggttaaacggaaacctaactaaaacgttgtacgactaaacggtaaaggttaaacgggtttaccggggactaaggttaccgtacccgaacgtaacgaccgtaaacccgaacgaaacgacccgtaaacgtacccgtaaccccggaaccggtacccaaccgaaccgttaccctaaggtacggtacgggtaacggcgggttacgggacggttacccgaacgggtaccctaccggtcggaaaccggttacccgaacgggttcccgttaaggtttaccttacgggttacggtacgaccgtaagaacgttaaccggttaaccgtccgggtaacccgttgggttaaacgggtacgggtaccccggttacgaacccgggttaccgggacggggaacccgttaacccggggtacccgttcggtttaccccggttcccgttcccttacccggg

SEQ ID NO: 100309 - DNA, 776 bp, Homo sapiens
  misc_feature: GYAE6OF01CKN1A.24.45.E01.1.454.CMB.1.raw
  modified_base (491)..(491): a, c, t, g, unknown or other
  misc_feature (491)..(491): n is a, c, g, or t
  modified_base (763)..(763): a, c, t, g, unknown or other
  misc_feature (763)..(763): n is a, c, g, or t
tcagactactatgtcacgaccggtgctcgatttagtgagtcagtaagggaaaggggacccaaaaaccacacccctccttgggagaactcccctagatcacagctcctcaccatggacctggacctggacgccactttccttttcttgggtggcagcacgccgaaccggtcgccctccgtcccgtaggttcagcgtggacgctagtccgtaggacgcgtggaaggttacggaaaggaacgtccggtcggggaccttaggacggtaggaacggttcctaccgtacgacgtaacggttccgttttacgtacggttttaactttaaccgttttaaccgtaacctttaggtacgttaacgttcccgtaacggttcgggtacgaccggtaaccggtaccgggtcccgtaggaacgttaacgggtcgttaggagggttcggaggtacggagtacgtacgacgtacggtataagtttagaagaacgaaacacgtaactncgaacagtaagtacggtgacgtagcgtacactacgactaacgactacgaccacgaccgtccgaccgacacgacgtacaggtcgaggtacggtcgggtacgcgtaacccgtacgccgtaacgtcgtaccggtaaccggtcgtaacgtaggttcggtacggtggtaccggaagtacggaccttaacggtccggttaccggtaacgttcgggtaacgtccgggtacgaccggttcggacgggtccggaaccggttcggaccttccggttacccgnggttaccctccgg

SEQ ID NO: 100310 - DNA, 808 bp, Homo sapiens
  misc_feature: GYAE6OF01B40EC.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagctattccttttcgttgggtcggcagcagcaaccggtgccctctacccaggttcagctggagcagtcgtggagcgtgaggtgaagagccgtaggggcctcgagtggaacggtctccgtgacgaagggtcctttgtaggttacttacgtttttaacacgtatggtatctaccgtgggtacgcgtaacgacggtcccgtaggcgaagggtcttaggcggttaggaagtggggatcggactcgtagtacgtaagtttaagtacgggtaagaaaaccgtacaaaacgtttacgagaaccgtaaacggtaaggtaaacgggtttaccgggggattaacgggaacgttaaccgaaccgtcgtaaaccgaaccgaaccggtacgaaaccttaacggaaccctaccgaaccggacctacgaaccctacccgtaactacggtacggaacggaccgggttacggggactaccggtacgaccgtaacgtcggaacgtaccgtcggtaccggtattaccgttacggtgtacggtaacggtacggaacgtaacgttacggtacccggttcgttaaccgggtacgggtttacgggacccttacgggcccggttaacccgggtccgggggttaacccgtacccgggggtaacccggttaccgggtttcccctaacccggggttcccttacccccggg

SEQ ID NO: 100311 - DNA, 695 bp, Homo sapiens
  misc_feature: GYAE6OF01C6AHN.24.45.E01.1.454.CMB.1.raw
  modified_base (197)..(197): a, c, t, g, unknown or other
  misc_feature (197)..(197): n is a, c, g, or t
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
  modified_base (683)..(683): a, c, t, g, unknown or other
  misc_feature (683)..(683): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagctattccttttcttggtggcagcagcaaccggtgccctctccccaggttccagctggagcacgtctgganctggaggtgaaggagccgtggggcctcgaggtgaaggtctccctgacgaaggtcttcgttaggttacttaacgttttaaccaccgttagttcggtataccgtaccggtgggtcgacgtacgaccggtcccgtggacgaaggtcgttggaggtcggtaggtgggtacgtggactacggacggtacgttaagtttaggaaggttaacggaaactaacgtaaactgtacgaactaagtaaagtaacgggttcggggactcggaacgtaccaacgtacgacgacacacgacctactacaccgaccnccgaacaccgtactatacggnggacggtcggtacgggaacgtccgacgtaccaccggacgaccgtaccgcggttacgtacgttacgttaccgtggacgtgaaggtactagttaaaccgtccggtacgttgacgggtcggtacgtccggtccgtaggtccgggcgtacccggtctacggttcccncgttcgtacccg

SEQ ID NO: 100312 - DNA, 800 bp, Homo sapiens
  misc_feature: GYAE6OF01DF98I.24.45.E01.1.454.CMB.1.raw
  modified_base (271)..(271): a, c, t, g, unknown or other
  misc_feature (271)..(271): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagctattccttttcttggtggcagcagcaaccggtcgccctctcccgaggttcagctggagcgtagtcgtggagcgtggaggtagaagagtccgtcgggcctcgagtagaggtctcctgacaggtcttcgtagttacttacttacnctagtgtatcacgtggtacgcgacgcggtcccgtaggacaggtactggaggtggaggtggtagtggacgtagacgtagttagttaacgtaaggtaacgaaaactaccgtaaaatcgtagacctaaagtaaagggttaaacggttccgggaagaacggtaacgtccgaaacgtagtaccgaacctaaacgaacgttaaccaccgaaccgtacccgaacccgggtaccaaccgtaacccggtaccttaacggtaacggtacggggtaaccggacgggtaccggggaaccgttaccccggtaacgaaccccggttacgtaaccggaaccggtaaccccggtacgggttaccttaagggttaccctttaggttacggagggtaacgttaagggtaactaacggttaacccggttcggttaacccgggttaacgggtaacgggttacccgggtacgttacccggtaccggtaccggggtaccggggacccggtaccggtaacccggtcgtttcccgggttctcccggttacccg

SEQ ID NO: 100313 - DNA, 750 bp, Homo sapiens
  misc_feature: GYAE6OF01AOQ4C.24.45.E01.1.454.CMB.1.raw
tcagactactatgtcacgaccggtgctcgatttagtgagtcagtaagggaaaggggacccaaaaaaccacacccctccttgggagaatcccctagatcacagctcctcaccatggactggacctggagcattccttttcttggtggcagcagccaaccggtgccctctcccaggttccagctggagcagtctggagctgaggtgaagacgccggtgggcctacgagtgaaggtcctcctgacaaggtcttcgtaggtttacttaacgttttaacacctttagtacggttactcctaaccggttcgggtcgccgaccgtaccggtccccgttagggacgaacggtcgttggaacgttgggacggtgggtataggactgaaggtacgtattagtacggtaacggaaaactaaccgtaaactgtacacaacgtaaaggttaaacggtttcgggaactaaggtacgtaccgaactagtaccgaacctacgaacgacaaccaaccgccgaacccggacaccgaaccgacctaacgtactacgggagtcggacgggtactccgaagtacccgacgtacggaacggccgtaaccgggtcgtaagttacgtacgtacgtaggacgagtaacgaagttacgtccggtaccggttacggtaacgggtttaccgggccggttaccgaccggttaccgggtacggggtaacctacccggggtaaccccggttcggttacccgtccggttcccgttaacccgg

SEQ ID NO: 100314 - DNA, 937 bp, Homo sapiens
  misc_feature: GYAE6OF01D6M18.24.45.E01.1.454.CMB.1.raw
tcagactactatgtcacgaccggtgctcgatttagtgagtcagtaagggaaagggacccaaaaaccacacccctccttgggagaatcccctagatcacagctcctcaccatggactggacctggagcacttccttttcgttggtggcagcagctaaccggtcgccctctcccgaggttcagtcgtggacgctagtcgtggatcgtaggaggtacgaagaacgccgtacgggcctacgaggtagtaacgttcctccgtgacgtaggtctttcgttacgttaactttactttacacttagtcgtactacgtacggtgggtacgccgacgtacccggtcccgtagggaacgtaacggtacgttaggacggttagggacggttacggggtagttagggtactaccgtagggtacgttaattaaggtacgtaaacggtaaaacctaactaaaacgtctacgaactaaacggtaaaggttaacgggttaccgggaacgtaacggtacgtaaccgaacgtacgtaccgaaaccgaacgagaacctaccgtaacccgtacccggaaacccgtacccgtaaaccgaccgtttaacccgtaaaccgtacgggttaacggtaacgggtccgggttacggggtaacccgtccggttaaccgtaacccgtaacccgggtacggttaacccggaaccgggttacccggggttaccgtttaacgttaaccggttttaccggtgggtaaaccgggttacggtaacggttaaccgttaaccggtacggttacccgggtttacgttaaaccgggtttaaccggggttaaccccgggttaaccggtaccggttcccggttaaacgggggtaccccggggttaaaccccgggttaaccggggttaaaccccggtttcgtttaccccggtttaccccggttaccgtttaacccccggg

SEQ ID NO: 100315 - DNA, 630 bp, Homo sapiens
  misc_feature: GYAE6OF01APZNW.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagcctggggcctcagtgaaggtctcctgcaaggcttctggttatacttttaacaccttatggtatcacctgggtgcgacaggccctgggcaaggcttgagtggatgggatggatcgagcgattagtagtaggaaacaacgaaactatgacaacagtaaacgtttcggggacaggacgtcactatcgaccacagacacactaccgacggaccacacgaccgtaacagtacggacggcgtgggggacgccgtacgaccaccgtacggaccgacggacggccgttagttacgttacgttcggtacgacgaacggacgaagttaacgtccgtccggttacgtaacgggtttacgggaccgttacggtcccgtacgggtccggggaccgtaaccgggtaacccgttcgggtacccgtccggtccgttacccg

SEQ ID NO: 100316 - DNA, 766 bp, Homo sapiens
  misc_feature: GYAE6OF01BMSOF.24.45.E01.1.454.CMB.1.raw
  modified_base (360)..(360): a, c, t, g, unknown or other
  misc_feature (360)..(360): n is a, c, g, or t
tcagactactatgtcacgaccggtgctcgatttagtgagtcagtaagggaaaggggacccaaaaaccacacccctcctgggagaatcccctagatcacagctcctcaccatggactggacctggagcatccttttcttggtggcagcagcaaccggtcgccctcctcccaggttctagctggagcagtctggagcttggaggtagaaggaaggccgtggggtcctcgagtggaacggtcctaccgtgacgagtcttctaggtttattaactttacactagtgtactcacgtggtgccgacgacggcccgtggacgtaacggcgttaggtagtggtagaggggtactggaactcgaacggntaagttacggtaaggttaaacggaaaacaaaccgtaaagttaacacggtaactaaccgaaaggtttaaacggttcgggaacgaaggttacgacctaacgatacgaaccgtaacaacgacctaagtaccgacccacggaccctaaccgacgacctacaggtagggacggtaggtacgggtccgaacgttcggaaccctacgtaacggacccggtaacccgccgggtttaaccgtaggtttaaccttagggtacggtccgtaacggaagttacgtaaacctttcgggtcccgggttaaaccttacgggttacgggttacccgggttaacgtccggaccgggtttacccgagggggtaccccgtaacgggtaccccgttcggttcccgttcccggtcccgttaccccgg

SEQ ID NO: 100317 - DNA, 800 bp, Homo sapiens
  misc_feature: GYAE6OF01ALQV5.24.45.E01.1.454.CMB.1.raw
  modified_base (408)..(408): a, c, t, g, unknown or other
  misc_feature (408)..(408): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttgggtggcagcagcgaaccggtgccctctccaggttcagcgtggagcagtcgtggagctggaggtaggaaggaacggtccggtcggggacctcgaggttacggaaggttccgtcgtgacgtaggtcttgtaggtttaacttaacctttaactaccttagtacggttactcgtacggtggtcgaccgacgtacggcccgtagggactaacgggcgttaggtaggtggtagtggggatggactacgagcgtagttaacgtaggacgtaaanaacctaagtacacgacgaacgtaagtaacggtttacgggactaagacgtacgaaccgtagacgaaccgaacgaacgtaaccaacctacgaacccggtacggaacccaacgtaccgtacctaacggtacgtagggacgttcgggacccggggactaccgacggtacccgacgtacggtacccggtaaccgggttaaccggtcgttaacgttacgttaccggttcggacggacgggtaacgtaaggtaaccgttacgggtaccggttacgttaccggtaacggggttaaccgggttccgttacggtacccgggttacgggttaacccggggaacccgggttacccgggtaaacccggttccgggttaccccgtttaccggcccctttacccggg

SEQ ID NO: 100318 - DNA, 751 bp, Homo sapiens
  misc_feature: GYAE6OF01E14QF.24.45.E01.1.454.CMB.1.raw
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctcctgtctgcatctgtaggagacagagtcaccatcacttgttggacaagtgagaccattagcagtcttctttgagtttgctatcaattacaaaccgaggaaacgcccctaacctcctgactctatactgccgtacctaatttacgacgtacgtggggtacccattccgacggttcacggtaggaccgaaagttcggacgttcgtaggggtaactacggtacgtttaccaccttaccgtcctaaaccctagttaaccgacgtaccgtaaggttccgttacgtaacccgtaaacccgttaacggtaacgttaacctttacgggtaacctaaccgttttaacgttaactttaccgttactaaaccgtaaacggtacgttttaaacccgtaacggtttttaccccccgggaccgttaaccccggtttccggggaccgggttaacgggggtaacccgtaaggggttaccggaacgttaacgtaccgaaccgtaaccggtaaaccgttcgggtacggtccgttcggtacccacccgttacgttccgttacgtttccgtttaaccctacgttacccctttccccggtaaccgtgtttaaccccg

SEQ ID NO: 100319 - DNA, 881 bp, Homo sapiens
  misc_feature: GYAE6OF01AVQ1B.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaccgggtcgccctctccctaggttcagcgtggagcagtcgtggagtcgtggaggtagaacggaacggtccggtcggggcctcgaaggtacggaaggtcctccgtgaccgtaaggtcctttacggttcggtttaaactttaccttttaaaccgaccgttaagttacggttactaccgtaccgttggggtaccgaccggtaaccggaccgggtcccccggtaggggaaccgtaagggttaccgttgggacggtgggtaggtaggggtagtcggtagtacgagaccgtattagtaaggaacgtaaactaacgtaactagacgtacgaagtaacggttaaggttacggggacaggactacgactacggaccacgaacgacgaccacgtaccgtacccgaccgtaccacgtaccgtaccaacgtacgggtaggacggtacgggacgggacctccgtacgaaccgtaccggtacgaaccggaaccccggtaccggtaccgttaggttaacggtttacggtacgggtaacgggacggtaacggttaacggtacgggttaaccccggttacccgggttaccggtttaacgggggtaaaccggggtttaccccggggtaaccccttacggggttacccccggtaaccgggggggtacccggggtaaaccccccggtaagggggtttaaccccccggttccggtttaaccccgggtttcccgttacccccgttacccggg

SEQ ID NO: 100320 - DNA, 870 bp, Homo sapiens
  misc_feature: GYAE6OF01EER6T.24.45.E01.1.454.CMB.1.raw
  modified_base (614)..(614): a, c, t, g, unknown or other
  misc_feature (614)..(614): n is a, c, g, or t
tcagactactatgtcacgaccggtgctcgatttagtgagtcagtaagggaaaggggacccaaaaaccacacccctcttgggagaatcccctagatcacagcctcctcaccatggactggacctggagtcattccttttcgttgggtggacagcagccgtaaccggtcgtccctccgtccccgtagggtttccaggtcgttagggaacgtcgtacggttcgtggacgtcttaggaaggtaggaaacggtaacggtcccggtggggcctacggtaggtagaacggttcctccgtagacgtacggttcttcgttaggtttaaccttaactttaccgacgttacgtagtaccttcgtaccggtgggtacacggtacgaccgggtcccgtaggaactaacggtcgttaggaggttacgggaagttcggggattacgggtaacgtcggtaggttacggttaacgtttaaggttacgggtaaacgaaaaaccctaactaaacggttacgttaccgaaccgtaaacggtaaagggtttaacgggttccgggaataacggttaccaacgaacctacgtacgaaacccaggaacgtacaacgtaccaccggtaccaccggtacncgttaacacgtaaggtcgaaggtcggagggctaccgtacgacgtaccgtaggaacccgttacggaccgggttactacggtttaaccgacgggttaggtaaccgtacggacggttaacgtaagtttaccccggacgttttacccgggttaaggttaaccggggtttacccggacttaccgggtacccgggttaacggtcccggggaaccttaacccggggtacccttcccgggttaaccttcccggtacgttacccg

SEQ ID NO: 100321 - DNA, 793 bp, Homo sapiens
  misc_feature: GYAE6OF01D3Z2N.24.45.E01.1.454.CMB.1.raw
  modified_base (667)..(667): a, c, t, g, unknown or other
  misc_feature (667)..(667): n is a, c, g, or t
tcagactactatgtcacgaccggtgctcgatttagtgagtcagtaagggaaagggacccaaaaaccacacccctccttgggagaatcccctagatcacagctcctcaccatggactggacctggagcattccttttcttggtggcagcagcaaccggtgccctctcccaggttcagctggagcagtctggagctgaggtagaagaacgccgtgggcctcgagtggaacggttctcccgtagacgaaggtcctttacgttaggtttaactttaacctttttaaaccacccgttagttacggtaactaccgtaccgttaggggtccgaccgtaaccggaccgggtaccccggtaggggaccgtaaacgggtacgtttagggagggttagggtaaggtacggggtagtgggtaactacggacggtagttaatttaacggtaaggtaacggaaaactaactaaaacgtatacgacgtaacgtaacgttaaaacgggttcgggaagtacggtaagtacccaacgtaacgtacgacccgaactaacgaacctaaccgtacctacccgaccggacccaccaacgtacccgttaacaggtacggacgcgggtagggacctccgacacccgtaaccgcggtacaccggtacggtccgttagttacgttacgtacgnggtaccgaagtaacgtacgtaactccgggtacgttacggtaacgggtacggtccgttacggcccgttaggggcccgggtaaccggtaccggttaccccggttcgtcccgttcccgtcccgtacccg

SEQ ID NO: 100322 - DNA, 783 bp, Homo sapiens
  misc_feature: GYAE6OF01D00K6.24.45.E01.1.454.CMB.1.raw
  modified_base (275)..(275): a, c, t, g, unknown or other
  misc_feature (275)..(275): n is a, c, g, or t
tcagactactatgtcacgaccggtgctcgatttagtgagtcagtaagggaaagggacccaaaaaccacacccctccttgggagaatcccctagatcacagctcctcaccatggactggacctggagcatccttttcttggtggcagcagcaaccggtgcctctcccaggttcagctggagcagtctggagctgaggtgaagaagccgtggggcctcagtgaaggtctcctgcagtcttctggttatactttaacacctatggtatcacctgggtncgacacggccctagggacaaggtacttgaggtggagtgggagttggatcgagacgtattagtaggtacgaaaacaactaaaactatgaccaagtaaggtaaacgtttcgggggacaaggtaacgtaccgaacctagtacgacaacacgaaccaacgactacccgaaccggacccaacgacgtacccgtaacaggtaacggacggtaccggtagggggtacgtacccgttacggaacccgttacccgtaaccgggaaccggaaccgaaccggggttacccgttacggttaacgttttaaacccgtgggttaaccggacggaaaggtacggttaaacgttaaacccggttccggttaccccgggtttaaggtaaccgggggtttaaaccgggggtaccccgttaccgggtaccccggtttaaacggggtccccggggggtaaaccccgtaaccggggggtaaacccccgtttggggttaccccgtttcccgggttcccgttaacccccgg

SEQ ID NO: 100323 - DNA, 1035 bp, Homo sapiens
  misc_feature: GYAE6OF01AQ03X.24.45.E01.1.454.CMB.1.raw
  modified_base (153)..(153): a, c, t, g, unknown or other
  misc_feature (153)..(153): n is a, c, g, or t
tcagactactatgtcacgaccggtgctcgatttagtgagtcagtaagggaaagggacccaaaaaaccacacccctccttgggagaatcccctagatcacagcctcctcaccaatggactggacctggagcacgttccttttcttgggtggacngcagaccgaccggtcgccctcctcccgtacggttcacggtcgtgggacgccgtagtcgtggacgacgtggagggtaacgaaggtaaccggtccggtacggggccctagaggtaggtaacggtctccgtcgaacgtacggttccgttacttacgggtttaactttaacctttaactaacctaggtagttaactcctacgtgggtacggacgaaccgtcggtcccggtaggacggtaacgtacggttcgaggtggtacgtacgggagtaggtactacggtagacgttaacggttaaggtaacggtaaacgtaaaaaccgaaactaaaacgtacggtacgaaccgtaaacggtttaaacggaaaccgggtttaaccggggaacggttaaaccgtaaccgggtttacccaaaccggtaaacgttacccggaaaaccgtaaaccgaaaccggttaaacgaaaccccggtaaccgtaaccccggtaacccggtaacccccgtaaccgttaacccccggttaaccctaaaccccggtaaccgggtaacgggttaacccgggtacgggacccggggaaccgtacccggtaccgtaaacccggtaacccggtaacggggttaaacccgaccgggtaacccggttacccgggtttaaccggtttacgtttaaaccggggttcggaaccgggtaacgttaaagggtaacccgttaaaccgttaccgggtttaaccggttacccgggttaaaggggttacccgggttaaacgggggttccccttaacccgggaaaaccggggtttccccgggaaccgggggacccccggttaaacccgggtccccgggttaaaccgggtttccccgttaacccgttccccgggttaaaccccgg

SEQ ID NO: 100324 - DNA, 879 bp, Homo sapiens
  misc_feature: GYAE6OF01BV972.24.45.E01.1.454.CMB.1.raw
  modified_base (306)..(306): a, c, t, g, unknown or other
  misc_feature (306)..(306): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
tcagactactatgtcacgaccggtgctcgatttagtgagtcagtaagggaaaggggacccaaaaaccacacccctccttgggagaatccctagatcacagctcctcaccatggactggacctggagcattccttttcttggtggcagcagcaaccggtgccctctcccgaggttcagcgtgggagcacggttctgggagctggaaggtgaaagacggtccgtgggggcctacggaggtagaacggtcctccgtagacgtaacggtcttacgttggttaactttacctttaacgacttagtcggtancgtacgtgggtagccgtacgaccggcccgtggacgtaaggtactaggacggtgagtacgggagtcggtanacggtanacggtattaaggtacgtaaggaaaacctaacgtaaaccgtagacgtaactacggaaacgttaaacggttcggggaaactagggtaacgtccaacgtacgacgaaccagaacgaactaccggtactaaccccgacggtaacccacgtaaccgtacccgttaaggtacggacgggttaccggaccgggtacgggggttaaacccctagggtaaccccgtaacgtaaccccggtaacgggtaacccgggtacccgggtaaacccggttcgggttttaaccgttaacggttacccggtttagggtcccgaaaacgggggttacgtaaaggttacctacccggggtttaacccgttccggggttaacggttaacccggggtttaaccgggtacccgttaaccgggggtacccgtttaaccggggggaccgggtaacccccgggtaaacggtccccggtttaccgggttttccccgaaaccgggtttccccttaaacccggg

SEQ ID NO: 100325 - DNA, 529 bp, Homo sapiens
  misc_feature: GYAE6OF02FM23Y.24.45.E01.1.454.CMB.1.raw
  modified_base (416)..(416): a, c, t, g, unknown or other
  misc_feature (416)..(416): n is a, c, g, or t
tcagactactatgtcacgaccggtgctcgatttagtgagtcagtaagggaaagggacccaaaaaccacaccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatgcacagaaatttcggggcagagtcacatgacacagacacatccacgccacagcctacatggagctgggganccgtgacacctgaccgacacggccgtgtatactgtgcgagagataatcgccgttcaggttacggggacctggcctacgtggggccacgggaaccctgggtcctccgtctcccg

SEQ ID NO: 100326 - DNA, 549 bp, Homo sapiens
  misc_feature: GYAE6OF02IUILW.24.45.E01.1.454.CMB.1.raw
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
tcagactactatgtcacgaccggtgctcgatttagtgagtcagtaagggaaaggggacccaaaaaccacaccctccttgggagaatccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatggggatggatcagcgattatagtggaaacacaaactatgcacagaaatttcggggcagagtcacatgaccacagacanatccacgccacagcctanatggagctggggacncgtgaccacctgaccgacacggccgtgtacgttactggtgcgagagactaatcgccgttagacggttagggacctgcccgttacgtcggggcccgaggggaacccctgggtcccttccggtccttacccg

SEQ ID NO: 100327 - DNA, 607 bp, Homo sapiens
  misc_feature: GYAE6OF02HDH66.24.45.E01.1.454.CMB.1.raw
  modified_base (382)..(382): a, c, t, g, unknown or other
  misc_feature (382)..(382): n is a, c, g, or t
  modified_base (473)..(473): a, c, t, g, unknown or other
  misc_feature (473)..(473): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctggtgcgacaggcccctgggcaaggcttgagtggatgggatggatcagcgattatagtggaaacacgaaactatgacacagaaatttcggggcagagtcacatagaccanagacacataccacggccacacgcctacatcggagcgtaggggagccgtagaccgaccgtagaccgacgacggcccggtagtactttaccgnggttacgacgtaaggagtataacgtccggtaccgtttacgtacggtttaacgggggacccttggacccgttacggtacgggggacccgtaacggggaaccccgttcgggtcccgtttaccggtccttaccccgg

SEQ ID NO: 100328 - DNA, 674 bp, Homo sapiens
  misc_feature: GYAE6OF02H9PXC.24.45.E01.1.454.CMB.1.raw
tcagactactatgtcacgaccggtgctcgatttagtgagtcagtaagggaaagggacacagcatggacatgagggtccccgctcagctcctgggctcctgctactctggctccgaggtgccagatgtgacatccagatgacccagtctccatccctcctgtctgcatctgtaggagacagagtcacatcacttggtggcaagtgagaccattagcagcttctttgagttgcatcaattcaaacaggaaagcccctaactcctgatctatactgcgtactaatttacacagttcgggtacccatccctaggttcagtggtacaagttggactcgtggggaactaggtatttccgactcgtaccaacctatcagctagttctcgaccaaccgttggaaacgttaccttttggaccttaaaactttacgttacgttacgtacctaaaacgtagtaacgtttaaccgtacggttttaccccccggattaacccgtttccggggaccgggtaacgggtaacccgtaaaggggttcggaacgtacgttaccaaaccggtaaccggttaaacgcgggtttacgggtacctacgggtaacccacccgttaaagttccggttttactttacccgttaccttaccgtttacccccgtttaccccgtacctaacgtttaaccccg

SEQ ID NO: 100329 - DNA, 592 bp, Homo sapiens
  misc_feature: GYAE6OF02H86TX.24.45.E01.1.454.CMB.1.raw
  modified_base (255)..(255): a, c, t, g, unknown or other
  misc_feature (255)..(255): n is a, c, g, or t
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcacttgtgggcaagtgagaccattagcagcttcttgagttggcatcaattcaaaaccagggaaacncccctaacctcctgatctatactgctaccaattacacagtcggccatccaggttcagtgcaatggatcgtgggacagagttcactctcacatcagcagtctgcaacctgaaacgtctttagacctaaactttactaagtttcgacaaaacgtagaacgttaacaacgtttccccggactaaccgtttcggggacggtaacggggaaccctaaagggtggaagtaactccgaaaccgtaaccggtaaacttgggtacgggtcctacggaccctaaccctaagttcccgttggttccctttacgaacctttccccgtttcccccaccgttattacccgg

SEQ ID NO: 100330 - DNA, 543 bp, Homo sapiens
  misc_feature: GYAE6OF02GV6UM.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatagcacagaaatttcggggacaggagtcaccatcgaccacagacacatccacggccacagcctacatggagcgtggggacgccgtgacacctgacgacgacggccgtgtacttactgtgcgagagaatagtcgccgttcaggttacgggacctcggcctacgtcggggaccacgggaccctggtcctccgtctcccg

SEQ ID NO: 100331 - DNA, 631 bp, Homo sapiens
  misc_feature: GYAE6OF02JK70H.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctggtgcgacaggcccctgggcaaggacttggagtggagtgggatggatcgagtcgattatagtaggaaacacaaactatgacacaagtaaagttcgggacaagagtcacagtgaaccaacacgacacgactaccgaccggaccaacacgacctaacagtacggacggtcgtaggggacggtcctacggaaccgtaccgtaggaaccgaaccgaccgggtacccggtagttaacgttacgtggtacggacgtaaggagtaagtaactccggtaccgttacgtacgggttaacgggaccttggaccgttacggtgggacccgaagggtaccccggtaggtccgttcccgtaccgttcccgg

SEQ ID NO: 100332 - DNA, 549 bp, Homo sapiens
  misc_feature: GYAE6OF02HBPKY.24.45.E01.1.454.CMB.1.raw
  modified_base (413)..(413): a, c, t, g, unknown or other
  misc_feature (413)..(413): n is a, c, g, or t
  modified_base (437)..(437): a, c, t, g, unknown or other
  misc_feature (437)..(437): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcacaggttcagctggagcagtctggagctgaggtgaagaagcctggggcctcagtgaaggtctcctgcaaggcttctggttatacttttaacacctatggtatcacctgggtgcgacaggcccctgggcaaggcttgagtggagtgggatggatcgagcgaattagtagtaggaaacacaaaacttatgacaacaagtaaagtttcggggacagagtcacatcgaccacagacacactccacggccanacgcctacagtggagcgtgggacncctgaccacgtgaccgacgacggccgttagtattacgtgtgcgagagatacgtcgcgttcgaggttacggctcgccgtacgtcgggacgacgggacccgtggtcctccgtcg

SEQ ID NO: 100333 - DNA, 510 bp, Homo sapiens
  misc_feature: GYAE6OF02ISJLI.24.45.E01.1.454.CMB.1.raw
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcacttgttgggcaagtgagaccattagcagctctttgagttggcatcaattcaaaaccagggaaacgcccctaaacctcctgatctatactgcgtccaatttacacagtggggtcccatccaggttcagtggcaatggatctgggacagagttcactctcaccatcagcagtctgacaacctgaagactttgactaacttactattgtacaaacagacgttaacacgtttccccggtctaccttcggacggacgggaccaagggtgagacgtcaacgacgaactggtagcgtgccacatctgtcttctatcctccgcatcg

SEQ ID NO: 100334 - DNA, 534 bp, Homo sapiens
  misc_feature: GYAE6OF02JICR2.24.45.E01.1.454.CMB.1.raw
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagactactatgtcacgaccggtgctcgatttagtgagtcagtaagggaaaggggacccaaaaaccacacccctccttgggagaatccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatgcacagaaatttcggggcagagtcaccatgaccacagacacatccacggccacagcctanatgganctgggagcctgacacctgacgacacggccgtagtattacgtgtcgcgagagataacgtcgaccgttcaggttacggggacctgcctacgtggggccagggaaccctggtcctccgtctcccg

SEQ ID NO: 100335 - DNA, 708 bp, Homo sapiens
  misc_feature: GYAE6OF02HKZFJ.24.45.E01.1.454.CMB.1.raw
  modified_base (275)..(275): a, c, t, g, unknown or other
  misc_feature (275)..(275): n is a, c, g, or t
  modified_base (431)..(431): a, c, t, g, unknown or other
  misc_feature (431)..(431): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaggtctcctgcaggcttctggttatacttttaacacctatggtatcacctggtncgacaggccctgggcaaggacttgagtggatgggatggatcagcgattataggtggaaacacaaaactatagcaacaaggtaaactttcgggggacaaggagtacaaccgatgaaccaacgaagaacacatacccaacggacccaacacgccctanacgtcgggaacgccggtagggggacgtccgtacgaccgtacctcggaccgtaacgaccgggtacccggttacggttaacgttttaaccgttagggtttcggaccgggtaaggaacggtaaacgttaaacgtccgggttacccgtttacgggttaacggggtttaaccgggggacccgtttaggtaaccccgttaaccgggtacggggggtacccggtaacgggggttaaacccccgttcgggggtttacccgttaccccgggttcccgttaccccgg

SEQ ID NO: 100336 - DNA, 534 bp, Homo sapiens
  misc_feature: GYAE6OF02G41Z9.24.45.E01.1.454.CMB.1.raw
  modified_base (470)..(470): a, c, t, g, unknown or other
  misc_feature (470)..(470): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacgaaactatgcacagaaatttcggggcagagtcacatgaccacagacacatccacgccacagcctacatggagcgtggggagccgtgacacctgaccgacgacggccgtagtatactgtgcgagagataancgccgttgacggttagggaccttggcctacgtgggccacgggaaccctggtcctccgtctcccg

SEQ ID NO: 100337 - DNA, 605 bp, Homo sapiens
  misc_feature: GYAE6OF02IUTC3.24.45.E01.1.454.CMB.1.raw
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatccctccctgtctgcatctgtaggagacagagtcaccatctacttggttgggacaagtgagacctattagcagtcttctttgaggttggctatacaattaccaaaaccgagggaaacgcccctaaacctcctagactctatactgccgtacctaatttacacaggtcgggtcccagtcctaggttcagtggacaagtggatcgtaggacagtacgttacactcctcaacctatacagcagtctacgcaacctagaacgtactttacgacctaacttacttaattgtaacctaaactagtaacgttaacctaccgggttccccgtctacccggttccgggaccgggtacgggaaccgtaagggtacggagtacgtaccaacgtaacgacgttgtacggcgtcgacctactcttacgtcgttaccttcgtaccttcccgtttacccgctactaccg

SEQ ID NO: 100338 - DNA, 553 bp, Homo sapiens
  misc_feature: GYAE6OF02GITQR.24.45.E01.1.454.CMB.1.raw
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatggggatggatcagcgattatagtggaaacacaaactatgcacagaaatttcggggcagagtcaccatgaccanagacacatccacgccacagcctacatggancgtggggancctgaccactgacgacgacggccgtgtattactggtcgcgaagagaataacgtccggaccgttcgaggttacggggaacctggcccttaacgtcggggccaaggggtaaccctggtccgtcccgtctcccg

SEQ ID NO: 100339 - DNA, 571 bp, Homo sapiens
  misc_feature: GYAE6OF02GOPYR.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatgcacagaaatttcgggacagacgtcaaccatcgaacacacgacacactccgacggccaacacgcctacgatggacgcgtggggacgccgtagacaccgtgacgacacggccgtgtacttactgtacgcgaagagaataacgtcgccgttagaggttacgggaccttcggccgttacgtggggacccgagggtaacccgttgggtaccgttcccgtacgttcccg

SEQ ID NO: 100340 - DNA, 611 bp, Homo sapiens
  misc_feature: GYAE6OF02J04JX.24.45.E01.1.454.CMB.1.raw
tcagactactatgtcacgaccggtgctcgatttagtgagtcagtaagggaaaggggacccaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcagtgaaggtctcctgcaaggcttctggttatacttttaacacctatggtatcacctggtgcgacaggccctgggcaaggcttgagtggatgggatggatcgagcgattatagtggaaaacacaaaactataggacaacgagtaaagtttacggggactaaggaaggttcaaccaagtgaaccgaacaacgacaacaactaccaacggaccaacgtagaccctaaccaagtcggagacgtgggggacgccgttcgacaccgtagacgacaacgggcctagtacttacgtgtagacgagacgaataatcggccgttagacggtttagggacctggcccttaacgtcgggggaccctaacggggaaccccgtttgggtaccttcccggtctaccccg

SEQ ID NO: 100341 - DNA, 621 bp, Homo sapiens
  misc_feature: GYAE6OF02HBZXG.24.45.E01.1.454.CMB.1.raw
tcagactactatgtcacgaccggtgctcgatttagtgagtcagtaagggaaaggggacccaaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctgggggcctcagtgaaggtctcctgcaaggcttctggttatacttttaacacctatggtatcacctgggtgcgacgaggcccctgggcaaggcttggagtggatgggatggatcgagcgattagtagtaggaaacacaaactatgacaacgagtaaagtttcggggacagacgtcaccatcgaaccacagacacactcccacggaccaacgacgccctaacagtggacgcgtggggacgcctaggaccaccgtacggacgaccgaccgggccgttaggttactttacgtgtcgaccgaggacgtaagtaacgtcccgtcgttacgtagggtttaacgggaccgttcggtacccgttacggtcggggtaccgtaaccggggtaccctcgggtacccgtcccggttcctccccg

SEQ ID NO: 100342 - DNA, 638 bp, Homo sapiens
  misc_feature: GYAE6OF02FR6PE.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcgagcgattatagtaggaaacacaaactatgcacaagtaagtttcggggacaggagtacaaccgatacgaccacagaccacactccaacggccacacgcctaacagtggacgcgtgggggacgtaccgtgacctaccgtcggaccgaaccgccgggtaccgttaggttactttaccgttggtcggaccggtaagacggtaactaacgttccggtacccgtttcgaagggtttaacgggggacccttacgggtacccgttacgggtccgggggaccgacgggggtaacccccgttgggttacccttcccggtcttccccg

SEQ ID NO: 100343 - DNA, 639 bp, Homo sapiens
  misc_feature: GYAE6OF02HNKOI.24.45.E01.1.454.CMB.1.raw
  modified_base (310)..(310): a, c, t, g, unknown or other
  misc_feature (310)..(310): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggangggatggatcagcgattagtagtggaaacaacaaactatgacacaagaaagtttcggganagagtacacatgaaccanagacacactcaccggcaacacgcctacagtaggagcgtggggacgccgtagaccaccgtagaccgaccgaccgggtaccgtagttacgttacgtggtcgtaccgagtaacgaattaacgtccggttacccggtttacttaacggggtttaacggggtacccgttacgggtaccccgtttaccggtcgggggtaccccgtaacgggggtaaacccccgttcgggtacccgtttcccgggtcctttaccccgg

SEQ ID NO: 100344 - DNA, 593 bp, Homo sapiens
  misc_feature: GYAE6OF02GH014.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggcttgagtggatgggatggatcagcgattatagtgaaacacaaactatgacacaagaaagtttcggggacaggagtacaccaagtcgaccacgagaaccacaataccacggccacacgcctaacatggacgcgtaggggacgccgtagacctaccgtacgaaccgacgaccgggccgtaggttaactacgttggtcggacgagacgtaactaatcgaccgtttacgacggttacggggacctcggccgttacgtcggggaccaggggtaacccctgggtaccgttccggtctcccg

SEQ ID NO: 100345 - DNA, 739 bp, Homo sapiens
  misc_feature: GYAE6OF02IUH9J.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatcctttttcttggtggcagcagcaaccggtgccctctcccaggttcagctggagcagtctggagctgaggtgaagaagccgtggggcctcgagtgaaggtctcctgcaaggcttcgtggttataccttttaacacctatgtactcaccgtgggtgcgacgacggccccgtagggcaaggtcttggagtaggagtgggatgggatcgagcgtaattagtaggtacggaaaacactaaactatagaccaacgtaaagtaaaggtttccgggacaaggtataccgaaccgtaagtaccgaaccacgaacgtaaccacgaaccgtcccgaaccggacccaacgaaccgtaccctaacgtagacgggacggacggtcggggaacgtcccgtacgaccctaccgtacggtaaccgaccggaacccggtaccggttacgttaacgtttaccgttggttacggacgtaacggtaacgtaaacgttaaccgttacccggttaccggtttacggtaacgggttaaccggggtaaccgttccgggtaccgttaccgggttaccggggacccgtaccggggtaccccggttacggtccccgttcccggttccgttaccccgg

SEQ ID NO: 100346 - DNA, 532 bp, Homo sapiens
  misc_feature: GYAE6OF02G79KW.24.45.E01.1.454.CMB.1.raw
  modified_base (421)..(421): a, c, t, g, unknown or other
  misc_feature (421)..(421): n is a, c, g, or t
  modified_base (478)..(478): a, c, t, g, unknown or other
  misc_feature (478)..(478): n is a, c, g, or t
  modified_base (506)..(506): a, c, t, g, unknown or other
  misc_feature (506)..(506): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatgcacagaaatttcggggcagagtcaccatgacacagacacatccacggccacagcctacatggagcgtgggganccgtgacacctgacgacacggccgtagtatactgtgcgaagagaagtatcgccgttnaggttgggacctgcctacgtgggacccngggaaccctggtcctccgtcttcccg

SEQ ID NO: 100347 - DNA, 598 bp, Homo sapiens
  misc_feature: GYAE6OF02JA92F.24.45.E01.1.454.CMB.1.raw
  modified_base (193)..(193): a, c, t, g, unknown or other
  misc_feature (193)..(193): n is a, c, g, or t
  modified_base (243)..(243): a, c, t, g, unknown or other
  misc_feature (243)..(243): n is a, c, g, or t
  modified_base (340)..(340): a, c, t, g, unknown or other
  misc_feature (340)..(340): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagactactatgtcacgaccggtgctcgatttagtgagtcagtaagggaaaggggacccaaaaaccgacacccctccttgggagaatcccctagatcacagctcctcaccatggactggacctggagcatccttttcttggtggcagcagcaaccggtgccctctcccaggttcagctggagcagtctgganctgaggtgaagaagcctggggcctcagtgaaggtctcctgcaaggcttcnggttatacttttacacctatggtatcactggtgcgacaggcccctgggccaaggacttcgagtggtatgggactggatcagcgattatagtcggaanacaaactatgcacagaatttcgggcagagtcacatnaccacacacaacacnccacggaccatacgcctacatggaancgtaggggagctacggactacctgacacgccggacgtgttagttacgttgacgtcgaacgtaggaactaacggtaccgtaccgttacgtacgggttaacggggtaaccttcgggaacccgttacggttcggggaccgtacggggaacccgttacgggtccgttacccgtccgttaccccgg

SEQ ID NO: 100348 - DNA, 559 bp, Homo sapiens
  misc_feature: GYAE6OF02JF20Q.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcgagtgaaggtctcctgcaaggcttctggttatacttttaacacctatggtatcacctgggtgcgacaggccctgggcaggacttggagtggatgggatgggatcgagcgacttatagtggaaacacaaacctatggacacagaaagttttcggggcaagagtcaccatcgaccacagacacatccgacgccacacgacctacatggagcgtgggacgcctgaccaccgtgaccgacacggccgtgtacttactgtgcgagagataatcgacgttcgaggttacgggacctggaccttacgtcgggaccgacgggtacccgtcggtccgttcccgtctccccg

SEQ ID NO: 100349 - DNA, 608 bp, Homo sapiens
  misc_feature: GYAE6OF02GLY06.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggagtgggatggatcagcgattatagtaggaaacacaaactatgacaacagaaacgtttgggacagagtcacatacgaccacgagacacactccacggaccaacgacgacctaacagtcggagcgttaggggacgtccgtagaccaccgtacgacggaaccgaccgggccgtagtacgttacgtgtacgacgagacgattaacgtccgtccgttagacgggttacggggaccttcggtacccgttacggtcggggacccgtaacgggtacccgttcgggtaccgttccggtccgttaccccg

SEQ ID NO: 100350 - DNA, 550 bp, Homo sapiens
  misc_feature: GYAE6OF02GXLQZ.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatgcacagaaatttcgggcagagtcacatgacacagacacatccacggccacagcctacatggagcgtggggagcctgacaccgtgacgacgacggccgtgtacttacgtgtcgcgagagataagtccgcgttacgaggtttacggggaccttacggccgtacgtcggggaccgacggggaaccccgttggtcctccgtctcccg

SEQ ID NO: 100351 - DNA, 555 bp, Homo sapiens
  misc_feature: GYAE6OF02HKNVN.24.45.E01.1.454.CMB.1.raw
  modified_base (385)..(385): a, c, t, g, unknown or other
  misc_feature (385)..(385): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggcttgagtggatgggatggatcgagcgattatagtgaaacacaaactatagacacaagtaaatttcggggacagagtcacatgaccanagacacatccacggccaacacgacctacagtggagcgtggggacgcctagaccaccgtgacgacacgggccgtagtactacgtgtgcgagagataatccgcgttagtaggttcgggacctcggtacctacggtcgggaccgtacgggaccctggtccctccggtctcccg

SEQ ID NO: 100352 - DNA, 636 bp, Homo sapiens
  misc_feature: GYAE6OF02GVFB9.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctggtgcgacaggcccctgggcaaggacttgaggtggatgggatggatcgagcgattatagtaggaaacacaaactatgacaacgaagtaaagtttcggggacagagtcaacatacgaaccacgagacaacactaccgacggccaacgacgaccctaacaagtaggacgtcggtaggggacgtacctagaccgtaaccgtcgaaccgaccgaccggacccgttagtactttacgtggtacgacgtaaggacgtaaacgtaagtcccggtaccgttacgtagggttaccggggtacctacggtacccgtacggtccggggacccgaacggggtaccccgttgggtcccttcccggtccttaccccg

SEQ ID NO: 100353 - DNA, 692 bp, Homo sapiens
  misc_feature: GYAE6OF02IL63E.24.45.E01.1.454.CMB.1.raw
  modified_base (383)..(383): a, c, t, g, unknown or other
  misc_feature (383)..(383): n is a, c, g, or t
  modified_base (485)..(485): a, c, t, g, unknown or other
  misc_feature (485)..(485): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacactatgtatctaccgtggtgcgacacggccctgggcaaggtcttggagtggatgggagtggatcgagacgtattagtagtaggaaacaacgtaaactagtgacaacgaaggtaaagtttcgggganaggacgtacaaccgagtacgaaccacgaacgaacaccgtactacccgacggaccctaaaccgacgtaccctaagacgtacgggacgtcggtagggggaaccncccgttacggaacccacccgtagaacccggaccggacccgggtaccgttacgtaacgttaccgttgtcggacgaacgaagtaacgtagtcccggtaccgttacgttagggttaaccggggaccttacgggtacccgttaccgggtacgggtacccgggaaccgggtaaccccgtttccggtacccgttccggttccccgtaccccgg

SEQ ID NO: 100354 - DNA, 640 bp, Homo sapiens
  misc_feature: GYAE6OF02G14Y4.24.45.E01.1.454.CMB.1.raw
  modified_base (389)..(389): a, c, t, g, unknown or other
  misc_feature (389)..(389): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatactttaacacctatggtatcacctgggtgcgacaggcccctgggcaaggacttgagtggatgggatggatcgagcgattatagtaggaaacacaaactatgacaacagtaaagtttcggggacagagtcacatacgaccanagacacactccacggccacgacgccctaacagtacgggacgcggtacgggggacgcccgtacggaaccacccgtaggaccgaccgaccgggccgttacgtaacttacgtggtacgacggaagagtaagttaacgtccggtaccgttacgtacggggtttaacggggacccttcgggtacccgttaccgggtcggggtacccggtaacggggtaaccccgttacgggtcccgtttacccggtccttccccgg

SEQ ID NO: 100355 - DNA, 741 bp, Homo sapiens
  misc_feature: GYAE6OF02HXTZH.24.45.E01.1.454.CMB.1.raw
  modified_base (281)..(281): a, c, t, g, unknown or other
  misc_feature (281)..(281): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggtctcctgcaaggtcttctggttatacttttaacactatggtatctacgtgggtncgacacggcccctgggacaaggtacttggagtggagtggggagttgggatcgaggcgtaatttaagtaggtaaggaaaaccaacgtaaaacgttatacgactaacgaaggtaaacggtttcggggacaaggtacgtacgaacctagtacgaccaacagaaccaactacgtacccgaaccggacccaacgaacgaccctaacgtaacgtacggggacggtaccggtagggggtaccaccggtacgaacccgtaccgtacggaaccggaaccggaaccgggtccggttacgtaacgtttacgtgggtacggtacggaaggtaagaaacgttaaccgtacccggttaccgtttacggtaacgggttaccggggtaccgttaccggtacccgttacgggaccggggtaccccggtaacggggtacccccgttgggtttccccgttcccggttaccttaccccgg

SEQ ID NO: 100356 - DNA, 629 bp, Homo sapiens
  misc_feature: GYAE6OF02JF3NV.24.45.E01.1.454.CMB.1.raw
  modified_base (283)..(283): a, c, t, g, unknown or other
  misc_feature (283)..(283): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacnggcccctggcaagaacttgagtggatgggatggatcgagcgattagtagtggaaacactaaactatagcacaagtaaactttcgggggacaggacgtacaaccatacgaccacagaccaacatacccacggccaacgacgacctacgatcgggagccggtaggggtacgccgtacgaccacccgtggaacccgacgaccgggtccgttacgtaacttacgttcggtagacgaaggagtaacgtacgtccgtaccgttacgacgggtttaacggggaccttacggtacccgtacggtacggggacccgacggggtaccccgttgggtcccgttcccggtccttcccg

SEQ ID NO: 100357 - DNA, 576 bp, Homo sapiens
  misc_feature: GYAE6OF02JUIP0.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggtcagcagcaaccggtgccctctcccaggttcagctggagcagtctggagctgaggtgagagcctggggcctcagtgaaggtctcctgcaaggctactggttatactttaacgacctatggtatcaccttggtgcgacacggaccccctgggcaaggacgttggagttgggacttggggatggaatcgagcgtattacgtagtaggaaacacaaatagtgtcacagaaagtttcgggacagtagtcacagtacgacacagacacactcacggcacacacctacaatcggagcgtcggggaacgtcgttcggaactccgtagaccgacgacggccgtgtacttaaccgtgttacgcgaagagatacgccgtcgtagtacggtaacgggactcgaccgtagtacggcgaccgggacctggtccgtccgtcgtccg

SEQ ID NO: 100358 - DNA, 574 bp, Homo sapiens
  misc_feature: GYAE6OF02HPQ48.24.45.E01.1.454.CMB.1.raw
  modified_base (443)..(443): a, c, t, g, unknown or other
  misc_feature (443)..(443): n is a, c, g, or t
  modified_base (569)..(569): a, c, t, g, unknown or other
  misc_feature (569)..(569): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctggtgcgacacggcccctgggcaaggcttgagtggatggggatggatcgagcgattatagtaggaaaacacaaactatcgacaacgagtaaagtttcgggacagagtacacatcgaaccacagacacactaccgacggccaacacgacctaacagtggagacgtggggacnccgtagaccaccgtgaccgaccgacggccgtagtacttacgtgtagcgaagagaatagtcgaccgttgaggttacgggccttgcccgttagtcggggaccacgggaacccgttggtacctccggtntcccg

SEQ ID NO: 100359 - DNA, 630 bp, Homo sapiens
  misc_feature: GYAE6OF02IAZP1.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggtctcctgcaggtcttctggttatacttttaacactatggtatcaccgtggtgcgacacggcccctgggcaaggacttgagtggagtgggatggatcgagcgattataggtaggaaacactaaactatgacaacgagtaaagtttcggggacagacgtacaccatacgaccacagacacactaccgacggaccaacgacgacctacagtcgggaacgcgtaggggacgccgtacggaccacccgtggaccgaaccgtacgggacccgttaggttacttacgtggtacggacgaggacgaattaacgtccgtaccgttacgtagggttacggggtaccgtaggtcccgttaacggtcggggaccgaacgggtacccgttcgggtaccttccccggtcttccccgg

SEQ ID NO: 100360 - DNA, 690 bp, Homo sapiens
  misc_feature: GYAE6OF02GY3QV.24.45.E01.1.454.CMB.1.raw
  modified_base (202)..(202): a, c, t, g, unknown or other
  misc_feature (202)..(202): n is a, c, g, or t
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagactactatgtcacgaccggtgctcgatttagtgagtcagtaagggaaaggggaccgaaaaaccaacaacccctaccttcgggagaataccctagactcacagctcctcaccactggactggacctggagcatccttttcttggtggcagcagcaaccggtcggccctcctcccacggttcagcctggagcagtctggngctgaggtgaagaagcctggggcctcgagtgaagggtctcctgcaaggctctggtttatacttttaacacctatggtatcaccgtggtgcgagacgcccgtggcgaaggtacgttgacggttaggatggggatggatacgagacgtagttagtagtacggaaactaanaaactatagacaacaggtaaaagtttcgggganaacggtagtaacaccgtaagtacggaacaacgaacgtaacactaactaccgaacgaccaactacgaccctaacgactaggtacgcgtacgggaacgcgtacgaaccgtaccgtaggaccgaccgtaaccgggccgtacggttaccgttaacgttcggtaggtccgtaaggacgtaacgtaacgttaccggtccgttaaccgtaggttaaccggggtacctaccggtacccgtacggttcgggacccggacggtaacccgttcgggtaccttcccggtccttacccgg

SEQ ID NO: 100361 - DNA, 587 bp, Homo sapiens
  misc_feature: GYAE6OF02HX77K.24.45.E01.1.454.CMB.1.raw
  modified_base (349)..(349): a, c, t, g, unknown or other
  misc_feature (349)..(349): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatcctttttcttggtggcagcagcaaccggtgccctctcccaggttcagctggagcagtctggagctgaggtgaagaagcctggggcctcagtgaaggtctcctgcaaggcttctggttatacttttaacactatgtatcacctggtgcgacaggccctgggcaaggacttgagtggatggatgggatcagcgattaataggtggaaaacacaaaactagngacacaagaaatttcggggacagagtacaccatgaccaatgacacatacgaacggccaacagtacctaacaatgggaacgcgtaggggaagtcctgaactaccctgaacgaccgacgggccgtagttaacgtttacgtagtcggcaaggaagaattaaatccgacgttcgtaggttaacgggacctggccttaacgtcggggaccaacggggaacccttgggtacttccggtctaccg

SEQ ID NO: 100362 - DNA, 848 bp, Homo sapiens
  misc_feature: GYAE6OF02I6YX9.24.45.E01.1.454.CMB.1.raw
tcagactactatgtcacgaccggtgctcgatttagtgagtcagtaagggaaaggggacccaaaaaccacacccctccttgggagaatccctagatcacagctcctcaccatggactggacctggagcattccttttcttggtggcagcagcaaccggtgccctctcccaggttcagctggagcagtctggagctgaggtgaagaagccgtggggcctcgagtgaacggtctccgtgacaaggtccttcgtaggttattaccgttttaacaccttattggtaactccgtaaccgtgggtgcccggtaaccgaccgggtcccccgtgggaaccgtaacgggtaccgtttaggaacggttcgggtaagggtcggggtaacgtaggggtaacgttacggaaggaccggttaagttttaaagtaacgggttaacgggaaaaacctaacgtaaaaacgttacgttacgacgtaaaccgtaaagggttaaaaacgggttttccgggggaccgttaaaggtacgtacccgaaacgtacgttacggaacccgtaacgaacggaaccaacctaacgtacccgtaacccggacccaaccgtaccgaccctaaacgacgtacggggaacggtccggtacgggggacctacccggtacggaacccgtaacccgtacgggaaccccggtaaccggtacccgggtaccggttaacggttaccgttaccggtggttacggacggttaacgaggttaaactaacgttccggtaccggtttacgtaacgggttaacgggaccttcggtaccgttaccgggacgggtaccgtaccgggaccgttcggtaccttcccggtcttcccgg

SEQ ID NO: 100363 - DNA, 603 bp, Homo sapiens
  misc_feature: GYAE6OF02IJVOB.24.45.E01.1.454.CMB.1.raw
tcagactactatgtcacgaccggtgctcgatttagtgagtcagtaagggaaaggggacccaaaaaaccacacccctccttgggagaatcccctagatcacagctcctcaccatggactggacctggagcatcctttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacacggcccctgggcaaggacttgagtggatgggatggatcgagcgattatagtaggaaacaacaaactatgacaacaagtaaagtttcggggacaagacgtcaacctatcgaaccaacaacgaacacactacccgaacggcccaaccacgaccctaacagtaggacgtcggtacggggagccgtacgaccaccgtagaccgaaccgacggtcgtacgttattacgtgtgacgagagaatagtccgtaccgttactaggttaacgggtcctgtaccgtacgtcggggacctacgggacccgttggtccgttccgtctcccg

SEQ ID NO: 100364 - DNA, 550 bp, Homo sapiens
  misc_feature: GYAE6OF02JJLRP.24.45.E01.1.454.CMB.1.raw
  modified_base (349)..(349): a, c, t, g, unknown or other
  misc_feature (349)..(349): n is a, c, g, or t
  modified_base (405)..(405): a, c, t, g, unknown or other
  misc_feature (405)..(405): n is a, c, g, or t
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcacttgttgggcaagtgagaccattagcagcttctttgagttggctatcaattcaaaccagggaaacgcccctaacctcctgatctatactgcgtccaatttacacagtcggggtcccatccaggttcagtggcaatggatcgtgggacagagtcactcncacctatcagcagtctgacaaccgtgaacgtactttacgactaacttaactacttntacaaacagtacgttaaccacgtttccccgacctaccttcgggacgacgggtaccaagggtcggagtactacgaccacgaacgttgtaggcgttggaccaccgtactcgttgttccttactactcccgttcccgtactactaccg

SEQ ID NO: 100365 - DNA, 717 bp, Homo sapiens
  misc_feature: GYAE6OF02GXVNE.24.45.E01.1.454.CMB.1.raw
  modified_base (239)..(239): a, c, t, g, unknown or other
  misc_feature (239)..(239): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaacgccgtggggcctcgagtgaggtctctgcagctntgttatactttaacactatgtatcaccgtggtgcgacacggccctgggacaacggtacttggagtggagtgggtatggatcgagcgtaattatagtaggaaactactaaactagtgactaacgaagtaaacgttttcggggactaaggtacgtacgtaaccgtagttaccgaaacccgtaacgaactaaccaacgtaccctacgaacccggacctaaccgacgaccctaacacgtacggaaggtccggtaggggtacgacccgttcgaactacccgtacgaccggtaccgaacccgggtccgtacgtttaacgttaccgttacggtacggtacgtaaggtaaacgtaacgtaacgtccggttacccgttacgttaacgggttaccggggtaacccttacggtacccgttaacgggtccgggtaacccgggtaccgggtaacccggttccggttacccggttcccggtacctttccccg

SEQ ID NO: 100366 - DNA, 690 bp, Homo sapiens
  misc_feature: GYAE6OF02I8EM3.24.45.E01.1.454.CMB.1.raw
  modified_base (524)..(524): a, c, t, g, unknown or other
  misc_feature (524)..(524): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggtctcctgcgaagtcttcgtggttatacttttaacacctatggtactctaccgtgggtcgcgacgacggccccgtgggacaaaggtcttggacggttggagtgggatcggatcgaggacgtagtttaagtaggtacggaaaactacgtaaaaacttgtacgaacgtaacgaaggtaaacggtttcgggacgtaaggacgtccaaaccgtactacggaacctaacgaacgtaaccaacgtactacccgaacccggccaaaccacgtaccctaacgaagtcggacgccggttaggggacnccgtacgaccgtaccgtcgaccgacgtaccggtcgtacgttacgtacgtcgtacgacgaggactaagtacgtaccgtccgttaagtacgggttccgggtaactccggtaccgtacggtaccgggtaccgtaccgggtacccgtcggtacccgtcccgtccgtaccg

SEQ ID NO: 100367 - DNA, 650 bp, Homo sapiens
  misc_feature: GYAE6OF02IXWRQ.24.45.E01.1.454.CMB.1.raw
tcagactactatgtcacgaccggtgctcgatttagtgagtcagtaagggaaaggggacccaaaaaaccacacccctccttgggagaatcccctagatcacagctcctcaccatggactggacctggagcatccttttcttggtggcagcagcaaccggtgccctctcccaggttcagctggagcagtctggagctggaggtgaagaagcctggggcctcgagtgaaggtctccgtgcaaggcttctggttatacttttaacacctatgtatcacctgggtgcgacacggccctgggcaaggacttgacgtggatgggagtgggatcgagacgattataggtaggaaacacaaaactatagacacaagtaaagtttcggggacaggagtcaacgatacgaccaacgaaggaaccacactacccgaacggtacccaacacgaccctaacgtagtacgggagtcggcgggggaacgccgttacggaccaccgtacggaccggtaccgaaccgggtccgttacggtacttacgtgtacgacgaaggaagtaacgtaacgtcggtaccgttacggaaggttacggggacctacggtccctaacgggtcgggacccgtacgggaacccgttggtacccgttaccggtccgtacccg

SEQ ID NO: 100368 - DNA, 641 bp, Homo sapiens
  misc_feature: GYAE6OF02JT2KB.24.45.E01.1.454.CMB.1.raw
  modified_base (127)..(127): a, c, t, g, unknown or other
  misc_feature (127)..(127): n is a, c, g, or t
  modified_base (137)..(137): a, c, t, g, unknown or other
  misc_feature (137)..(137): n is a, c, g, or t
  modified_base (153)..(153): a, c, t, g, unknown or other
  misc_feature (153)..(153): n is a, c, g, or t
  modified_base (162)..(162): a, c, t, g, unknown or other
  misc_feature (162)..(162): n is a, c, g, or t
  modified_base (166)..(166): a, c, t, g, unknown or other
  misc_feature (166)..(166): n is a, c, g, or t
  modified_base (168)..(168): a, c, t, g, unknown or other
  misc_feature (168)..(168): n is a, c, g, or t
  modified_base (170)..(170): a, c, t, g, unknown or other
  misc_feature (170)..(170): n is a, c, g, or t
  modified_base (172)..(175): a, c, t, g, unknown or other
  misc_feature (172)..(175): n is a, c, g, or t
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
  modified_base (575)..(575): a, c, t, g, unknown or other
  misc_feature (575)..(575): n is a, c, g, or t
tcagactactatgtcacgaccggtgctcgatttagtgagtcagtaagggaaagggacccaaaaaccacacccctccttgggagaatcccctagatcacagctcctcaccatggaacctggacctganctatcctttntggcagcagcaccgtnccctctccngtcngngngnnnngngngngagagagagcgcgtcgcgtacgtcgtcgacgacgngtctagtactacttacgtacttattacgtacgtactacgtagtcgcgtcgacggccgtacggcttacggacgtgagtggagtggtagtgcgagtnacgagtccgtacctccgttaacgtaagtaagtaacgtacgaacgtaagtacggtacgacgcaacgtacgtaccgtaacgacgtacgaaccgaacacgacctacgaccgaccgaccgacgacgtaccgaccgtacgacggttacggtacgttacgacgtacggccgaccgtacgaccgtacgtacgtaccgtacgtacgtaccgtacgtagtacgtaagtaccgtacggagtacgtacgttacggtaccgcgtctcgtaacggtntaccctagggtacccgttacggttcggtacccgttaccggttcccgtcggtaccgtaccgttcccg

SEQ ID NO: 100369 - DNA, 659 bp, Homo sapiens
  misc_feature: GYAE6OF02ISEIC.24.45.E01.1.454.CMB.1.raw
  modified_base (400)..(400): a, c, t, g, unknown or other
  misc_feature (400)..(400): n is a, c, g, or t
  modified_base (480)..(480): a, c, t, g, unknown or other
  misc_feature (480)..(480): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcagtgaaggtctcctgcaaggcttctggttatactttacactatgtatcactggtgcgacacggcccctgggcaaggacttggacgtgggtactgggatgggatcgagtcgattagtagtaggaaacacaaactagtgacaactaagtaaagtttcggggacaaggagtcacatacgaccaanacgaccaacgacgtcccaaccggaccacgacgtaccctaacgagtacgggagacggtcgggaacgacccgacgacccgtnaccggaccgaccgggaccgttagttacgttacgtggtacgacggaacgtaacgtaacttaaagtcccgttaccgttacggtacggtttaaccggggtccttacggtcccgttacggtaccggggtacccgaacgggttaccccgttgggttaccctacccgggttccttcccgtacccg

SEQ ID NO: 100370 - DNA, 734 bp, Homo sapiens
  misc_feature: GYAE6OF02G6R8V.24.45.E01.1.454.CMB.1.raw
  modified_base (274)..(274): a, c, t, g, unknown or other
  misc_feature (274)..(274): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagcgtgaggtgaagaagccgtggggcctcgagtgaaggtctcctgcaaggcttctgttatactttaacactatgtatcactggncgacaggccctggcaaggcttgagtgagtgggatggatcgagcgtattagtagtaggaaacactaaactagtacgacaacgtaaggtaaacggttttcggggactaacggtacgtaccgtaaccgagttacgaacccgtaagaaccgtaaacctaacctaaccgttaccccgaacccgggtaccccaaaccgtaacgaccccttaacgaacggtacggggtaaccggtccgggttacgggggaacgtcccggtacggtaacccgaaccggtacggaaccgaaccgaacccggggttccggttaacgttaacgttaccgttggtaacggaccgtaaggtaacgtaaagttacgttacggtacccgttacgtaacggggttaacgggaccttcggtaccggttaccggtacggggtcccggaacgggtacccgttgggttaccctcccggttccgttccccg

SEQ ID NO: 100371 - DNA, 694 bp, Homo sapiens
  misc_feature: GYAE6OF02G4GN2.24.45.E01.1.454.CMB.1.raw
  modified_base (281)..(281): a, c, t, g, unknown or other
  misc_feature (281)..(281): n is a, c, g, or t
  modified_base (390)..(390): a, c, t, g, unknown or other
  misc_feature (390)..(390): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcagtgaaggtctcctgcaaggcttcgtggttatacttttaacacctatggtatcaccgtgggtncgacaggccccgtgggcaaggacttgaggtggagtgggatgggatcgagcgtattagtagtaggaaacaacgaaactagtcgacaagaaggtaaaacgtttcggggganaaggtacgtaccgaacctagtacgaacccgaaacacggaaccaacgtaactacccgaaccgggcccaaacgaccgaccctaaaccgagtacgggaacggtcggtaggggacgtacccgtaggaccgaccgtacggaccgaccgaccgggtcccgtagttaccgttacgtggtacgacgtaagagtaaacgtacgtccgtaccgttacgtaacgggtaacgggacctaggtaccccgttacgggttaccggggacccggtaccgggtaacccgtttcgggtacccgttccggtacccgttcccgg

SEQ ID NO: 100372 - DNA, 637 bp, Homo sapiens
  misc_feature: GYAE6OF02IP1DR.24.45.E01.1.454.CMB.1.raw
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (468)..(468): a, c, t, g, unknown or other
  misc_feature (468)..(468): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagcctggggcctcagtgaaggtctcctgcaaggcttctggttatacttttaacacctatggtactctacgtggtgcgtacaggcccctgggaccaaggtacttgaggtggtagtcgggtatgggatcgagcgtatttagtaggtggaaacactaaaactatacgacacaagaaagtttcggggacagtagtacactaatgaccaanacgacacnctacccgacggacccacgacgaccctaacagtggacggcggtacggggacnccgtacgacctaccgtcgaaccggaccgtacgggtccggtagttacgttaacgtggtacgacgagtacgaaacttactcggtaccgttcggacgggtttacgggaccttcggtacccgttcggacgggtacgaccgggtaacccgtgtaccggtcccggttctacccgg

SEQ ID NO: 100373 - DNA, 674 bp, Homo sapiens
  misc_feature: GYAE6OF02I8XZ2.24.45.E01.1.454.CMB.1.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
  modified_base (380)..(380): a, c, t, g, unknown or other
  misc_feature (380)..(380): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagccgtggggcctcagtgaaggtctccgtgcaaggtcttcgtggttattacttttaacactatggtactcacgtggtgcgacncggccctgggacaaggcttgagtggagtggatggatcgagcgtattagagtaggaaacactaaacgtnacgacaacgaagtaacggttcggganagtacgtacacgatacgacctaacacgaacacacgtaccgaccggaccaacgtaccgacctacgacgtacgggacgtcgggtacggggactaccgacgaacccgaccgtacgaaccggaccggtacggtccgttacgttaccgtttacgcggtacgacggaagtacgtaacgttacgttcccgtccggttaacgtaccggggttaacgggtacccttggtaacccggtaccgggtacgggaaccccggtacgggttaacccgtcgggtttacccgtaccggttcctaaccccgg

SEQ ID NO: 100374 - DNA, 633 bp, Homo sapiens
  misc_feature: GYAE6OF02G7NM0.24.45.E01.1.454.CMB.1.raw
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
  modified_base (629)..(629): a, c, t, g, unknown or other
  misc_feature (629)..(629): n is a, c, g, or t
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcacttgttgggcaagtgacgaccattagcagcttcttgagttggcatctaattacaaaccgagggaacacccctaacctctgatctatactgctacaatttaccacgacggtcgggtacccatccgagttcaggtggacatggatcgnggacagtacgtcactctacacctatacganacgtagttcctcgacctaaacctgtaagtacttttacgacttaaacccgtttaattacgtttacgtaacctaaacgtaacggtaacgtttacccggtaccggtttacccccggtaacccgttaacccggttccggggtaccgggaacggggtaacccgtaagggttacggaagtaccgtacgaacgaaccgtacgttcggtacggacgtcggacctacgtacttccgttagttaccttcgtaccttcccgtacccgaccttntacg

SEQ ID NO: 100375 - DNA, 774 bp, Homo sapiens
  misc_feature: GYAE6OF02FMKLK.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctccccaggttcagctggagcagtctggagctgaggtgaagaagcctggggcctcagtgaaggtctcctgcaaggcttctggttatacttttaacacctatggtatcacctgggtgcgacaggcccctgggcaaggcttgagtggatgggatggatcgagcgtaatttagtagtaggaaacacgaaaactatagacaacaaggtaaatttcgggggactaggaacgttacaacctagtacgaacccgaacaacgaaccaacaactcccgaacggacccaacgaacgacccttaacaacgtacgggaacgtcgtacgggggaacgtcccgttaggaacccgtacccgtacggaaccgggaacccgtaaccggggtacccggttaggttaaccgttttaaccggttcgggttacgggaccgggtaaacggtaacggtaaacgtttaaaccgttcccgggttaccccgggtttacggtaacgggttttaaccgggggggacccctttacgggtaccccggttaaccgggttccggggggtaaccccggtaaccgggggtaaaccccccgtttcggggttaccccgtttaccccggttacccggtttacccccgg

SEQ ID NO: 100376 - DNA, 718 bp, Homo sapiens
  misc_feature: GYAE6OF02FL90V.24.45.E01.1.454.CMB.1.raw
tcagactactatgtcacgaccggtgctcgatttagtgagtcagtaagggaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgagaagcctggggcctcagtgagtctctgcaggctctgttatacttttacacctatggtatcacgtggtgcgacgacggccccgtgggacaacgggtacttggagtggagtgggatggatcagcgatttagtagtaggaaacacaaactctacgacaacgtagtaaacgtttcggggacagacgtcaacagtacgaccgacaggaaccacgacgtacccgacggacccaaccgtaacgccctaacgtacgtacgggtacgtaccggtaggggaccgtacccgttacggaaccgtaacccgtacggaaccggtacccgtaaccgggtaccgttacggttacgtttaacggtaggtacggtaccggaacgtaacggtaacgtttaacgtccggttacccgtttaggtacccgggtttaacggggtaacccttcgggtaaccccgttgggttacccgggggtaccccgtaaacggggtacccccgttggggttaccccgttacccggtacccgttaccccgg

SEQ ID NO: 100377 - DNA, 570 bp, Homo sapiens
  misc_feature: GYAE6OF02GV30T.24.45.E01.1.454.CMB.1.raw
  modified_base (330)..(330): a, c, t, g, unknown or other
  misc_feature (330)..(330): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatggggatggatcagcgattanagtaggaaacacaaactatgcacagaaagtttcggggcagagtcaccatgaccacagacacactccacggccacagcctanagtggagcgtggggacnccgtagacaccgtgaccgaccgacgggccgtagttactacgtgtcgcgagagaatacgtcgtccgttgacggtttacggggaccttcggtaccgtaccgtggggaccgacggggaacccttgggtaccttcccggtctcccg

SEQ ID NO: 100378 - DNA, 736 bp, Homo sapiens
  misc_feature: GYAE6OF02GM20Y.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggtctctgcaaggcttctggttatacttttaacactatggtatcacgtggtgcgacacggcccctgggcaaggacttggaggtggagtgggatggatcgagcgtattagtagtaggaaacacaaactatgacaacgtaagtaaacgtttcggggacaagtacgtacaaccagtacgaacctacgaacgtaccaacgtacgtacccgaaccggtacccaacgacgtaccctaacgacgtacggggacgtcggtacgggggaccgtacccgtacgaaccctaccggttacggaacccggtaccggaaccgggtcccggttaacggtttaaccgtttaccgttcgggttacggtacggtaaggtaacgttaacgttaacgttcccggttacccgtttacggtaacggggttaaccggggtacccttcgggtacccgttaaccgggtaccggggtacccggtaaccggggttaaccccgttcgggtttacccgttccccggtacctttaccccgg

SEQ ID NO: 100379 - DNA, 761 bp, Homo sapiens
  misc_feature: GYAE6OF02GN10N.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcgagtgaaggtctctgcaaggcttctggttatacttttaacacctatggtactcacctggtgcgacacggcccctgggcaaggtacttggagtggatgggatggatcgagcgtattatagtaggaaacacgaaactatagacaacgtaagtaaacgtttcggggacaggacgttcaaccgatacgaaccacgtacgacaacactaccgaacggacccaacacgtacccgtaacaacgttcgggaacgtccggtcgggggtaacgtacccgtaggtaaccgtacccgtacggaaacccggtaccggaccgggtacccggttaacggttaaccgtttaaccggtcggtacggtaccgggaacggtaaacgtaaaccggttaagttcccggttacccggtttacggtaaacggggttttaacggggggtaaccccttaccggggtaaccccgttaccgggttaccgggggtaacccgggttaaaccgggggttaaccccggttccgggtttaccccggttaccccgggttaccccgtttaaccccggg

SEQ ID NO: 100380 - DNA, 631 bp, Homo sapiens
  misc_feature: GYAE6OF02FH9VV.24.45.E01.1.454.CMB.1.raw
tcagactactatgtcacgaccggtgctcgatttagtgagtcagtaagggaaaggacacagcatggacatgagggtccccgctcagctcctggggctcctgctactctggctccgaggtgccagatgtgacatccagatgacccagtctccatcctccctgtctgcatctgtaggagacagagtcaccatcacttgtgggcaagtgagaccatagcagtctcgtttgagttggctatcaacttacaaaccgagggaaactcccctaacctcctagatctatactgtccgtacctaatttacacgtaggtcggggtcctacgtacctaggttacaggtggactaagtggactcgtagggactaggtacgtctacgtctacacctatcagtactagtactgaccaaccgtgtaacgtactttacgtactaaactttactacttacgtacaaactacgtacgttaccgacgtttccccgtacgtaccggttacgggacgggtaacgggaccgtagggtacgtacgtaacgtaccgaacgtaacggtaacgttcgggtacgtaccgttagaccctaacgtaccgtttcgtacgtttaccttaccgtaccttcccgttaccccgtacttacttaccg

SEQ ID NO: 100381 - DNA, 779 bp, Homo sapiens
  misc_feature: GYAE6OF02GUXGT.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcagtgaaggtcctcctgcgaaggtcttcgtggttactacttttaacaccttatggtatcacctgggtcgcgacacggccccgtgggccgaaggacgttggagtggagtggggatggatcgaggcgtaagtttagtaaggtaggaaaacgtaactaaaaccttagtagacgaactaaggtaaagtttccggggactaagtagtaccaaccgtagtacgacccgtaacaacggaacaacctacgtccgaaacccggacaccgaacgtaccctaaacacgtagggacgtacgggtacggggacggtaccgttacggaaccctacccggtacgtaacccggaacgaccccgggttaccgtacgttaaccgtttacgttcggttacgggacggtaaacggtacggttaaaacgttaacggtaccggttacccggtttaaccgggtaacggggttttaaccggggtaacccgttacgggttaacccccgtaacggggtttcggggaaccccgtaccgggtaaaccggttaaacccccgggtcggtttacccgtccccggtttaccccg

SEQ ID NO: 100382 - DNA, 716 bp, Homo sapiens
  misc_feature: GYAE6OF02I4MG9.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctggaggtgaagagccgtggggcctcagtgaaggtctcctgcaagcttctggttatacttttaacacctatggtactcaccgttggtgcgacgacggccccgtgggacaaggtacgttaggaggtggaagttggggagtaggattcgaggtacgtattaagtaacggtaggaaaacaactaaacggtatacggactaacgaaggtaaagttttaccggggactaagtacgtaccgtaaaccaagttacgaacccacgaaacggaacacgtaactccgaaccggacccaacgtacgaccctaacgagtacggacggccgtaggggacgttccacggactaccgtacaaccggacgacggtaccgtagtaacgtacgtagttaccggagtaaagacggtaacgttaacgtcggtacccgttacggttaacgggttaacggggtaacccttacggacccgtaaccgttcgggggaacccttaccggggtaaacccgtcgggttaacccgttccggtacccgttccgg

SEQ ID NO: 100383 - DNA, 719 bp, Homo sapiens
  misc_feature: GYAE6OF02JM5DE.24.45.E01.1.454.CMB.1.raw
  modified_base (128)..(128): a, c, t, g, unknown or other
  misc_feature (128)..(128): n is a, c, g, or t
  modified_base (185)..(185): a, c, t, g, unknown or other
  misc_feature (185)..(185): n is a, c, g, or t
  modified_base (662)..(662): a, c, t, g, unknown or other
  misc_feature (662)..(662): n is a, c, g, or t
tcagactactatgtcacgaccggtgctcgatttagtgagtcagtaagggaaaggggacccaaaaaccacacccctccttgggagaactcccctagatcacagctcctcaccatggactggacctggancattccttttctggtggcagcagccaaccggtcgccctcgtcccaggtcagctggancagtcgtggagcgtaggaggtgaaagacggccgtcgggcctacgaggtagaggtctaccgtgaccgaggtcttacgtaggttaactttaccgtttaaccacgtagttcgtaacttccgtacggttgggtcaccgtacgtaccggtccccggtaggaccgtaaaggtccgttacgggaggttaggacggttagggtatcggtataccgaggtacgtagtaacgtaggaacggaaactaacgaacgtagtacgaccaagtaacgggtagtcggactaagagtaccagtacgaacaccgaacgaataccgactaccggaccgtaccgaccacgacccgtaacacgtacgtaggtaccgtacgggtacgggacctaccggtacaccgtaacgcgaaaccgggtccgaccggttacgtacgtaaccgtaggtgtaccgagttaccgagtacgtacgtccgtacgtaacgtcgggtaccgtanccggtcgtaccggacggttaccggaccgtaccggttcgtcccgtacgttcccctacg

SEQ ID NO: 100384 - DNA, 696 bp, Homo sapiens
  misc_feature: GYAE6OF02I7G9K.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctggaggtgaagaagccgtggggcctcgaggtgaaggtctccgtgacaaggtcttcgtaggttatacttttaacaccttatgtactcaccgtgggtgcgacacggccctgggacaaggtcttggagtggagtggggatggatcgagcgtattagtagtagaaacataaacgtatagacaagtaaggtaaacggtttcggggaactaggtacgtaccaacctagtacgaacccaacgaacgacctaacacgtacccgaaccggacctaacgtaaccgacctaacgaggtacggaggtccggtagggggaccgtccgacgaacccaccgtacgaccggaccgaccgggtccgttagttacttacggtgtacgacgtaagacgtagttaacgtccggttcgttacggtaaggggttaacccgggccgttacggtacccgttaccgggtacggggaccccgtaacggggttaaccccgttcggtcccggttcccgtaccgttacccg

SEQ ID NO: 100385 - DNA, 901 bp, Homo sapiens
  misc_feature: GYAE6OF02F7JGH.24.45.E01.1.454.CMB.1.raw
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatcctttctggtgcagcagcaaccggtgccctctcccaggttcagctggagcagtctggagctgaggtgaagagcctggggcctcgagtgaagtctccgngcgaaggcttctggttacttacgtttaacacctatggtactcacctgggtncgtacgacggcccgtggacaaggtaccttaggacgttggagttacgggtagtggactccgaggtaccgtagtttacgtaggtaacggaaaacctacgtaaaaccgttagtacggtaaccgaacgtaaacggtaaaccggttttccggggaacgtaacggtaaccgtaccgtaaaccgtaacgttaccgggaaacccgtaaccgtaacggtaaccctaacgaaccgtacccggaaaccggtacccgaaccgtacggaacccttaacgaacgtacggggtaacgccgggtaaggggtaccgtacccgtacggtaacccgtaaccggtacggtaaaccgggtaacccggtaccgggttacccgggttacggttaacccggttttaaaccggttccgggttaaccggaaccgggttaaacggtaaccggttaaaccggttaaccgggttaccccgggttacccggggtttaacccgttaaaccggggggtttaccggggtaaccccgtttacggggtaacccccgtttaacggggttaccccggggtaacccgggttaacccggggttaaaccccccggttggttacccccggggtttaccccgtttacccccggttaacccccgg

SEQ ID NO: 100386 - DNA, 813 bp, Homo sapiens
  misc_feature: GYAE6OF02IVDZ1.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctccccaggttcagctggagcagtctggagctgaggtgaagagcctggggcctcagtgaaggtctcctgcgaaggcttcgtggttataccttttaacacctatggtatcaccgtggtgcgacacggcccctgggcaaggacttgaggtggagtgggatgggatcgagacgtattacgtagtacggaaacaacaaacttatagaccaacgtaaggtaaacgttttccggggactaacggaacgtacctaaccgaagttacgaaccctaacgaacggtaaccaaccgtaacctacccgaaccccggacccaaccgaccgtacccctaacgacgtacgggtaacgccggtacgggggtaccgtacccgtacgacccgtaacccgttaccggaacccggacccgtaacccggggtaccgtttaccggttaacgttttaccggtacgggttcggtaacccggtaaggtacggtaaacgttaacgttaccccgggttacccggttttacggtaaaccggggttttaacggggtaaccccgttacgggttaacccccggttaccggggttacccgggggtaaccccggtaaccgggggttaaccccggtttacccgggttaaccccggtttcccccggtttacccggttacccccgg

SEQ ID NO: 100387 - DNA, 677 bp, Homo sapiens
  misc_feature: GYAE6OF02H2FHI.24.45.E01.1.454.CMB.1.raw
tcagactactatgtcacgaccggtgctcgatttagtgagtcagtaagggaaagggacccaaaaaccaacacccctccttgggagaatccctagatcacagctcctcaccatggactggacctggagcatccttttcttggtggcagcagcaaccggtgcccctctcccaggttcagctggacgcagtctgggagctggaggtgaagaacgccgtgggggcctcgagtgaaggtctcctggcaaggcttgtagttattacttttaacacttatggtatctaccgtgggtgcgacgtacggccccgtgggacaaaggtaccgttggaaggttcggaagttggaagttggatacaggtcgtagttaagtagtaaggaacaaacgtaaactatacgacaacgtaagaaaacggtttcggggacaagtacgacaccgtacgagaaccacgataacacacgtaccacggacccaagacgtaccctactaagcgggaacgcggtacggggacttaccgacggaacaccgagaaacccgacgaaccgcccgtttagtactttaccgtgtcgacgagaagtaataactcggccgttaacgtagggtaacggttaccgttcgaaccggttaccggtaccgggaccggtaaccggggtaccctagggttcctaccggttacctcccgg

SEQ ID NO: 100388 - DNA, 653 bp, Homo sapiens
  misc_feature: GYAE6OF02I85GV.24.45.E01.1.454.CMB.1.raw
  modified_base (357)..(357): a, c, t, g, unknown or other
  misc_feature (357)..(357): n is a, c, g, or t
  modified_base (455)..(455): a, c, t, g, unknown or other
  misc_feature (455)..(455): n is a, c, g, or t
tcagactactatgtcacgaccggtgctcgatttagtgagtcagtaagggaaaggggacccaaaaaaccacacccctccttgggagaatcccctagatcacagttcctcaccatggactggacctggagcatccttttcttggtggcagcagcaaccggtgccctctcccaggttcagctggagcagtctggagctgaggtgaagaagccgtggggcctcagtgaaggtctcctgcaggcttctggttatacttttaacacctatgtatcaccgtggtgcgacacggcccctgggacaaggacttggagtggagtgggatggatcgaggcgtattagtagtaggaaacacgtaaactntgacaacgagtaaagttcgggacagagtaccacatacgaaccacacgtacacatcccgacgacccaacacgacctacagtcgacgtcgtacggggacnccgtagaccaccgtaggaaccgtaccgaccggtcgttagttaccttacgtggtaccgacgtaagaagtacttaagtccggttaccgttacgtaacgggttaccggggtaccttacggtacccgttaacgggtaccggggtaccgtaaccggggtacccgttgggttccccttacccggttccgtacccgttaacccgg

SEQ ID NO: 100389 - DNA, 796 bp, Homo sapiens
  misc_feature: GYAE6OF02GW1S5.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtgaaggttctccgtgcaaggtcttcgtggttactacttttaacacctatggtactcaccgtggtgcgacgacgccccgtggacaaggtcttggagttcggagtgggtactggactcgaggacgtaattagtaggtacgaaaacaacgtaaacgtatacgacgaacgtaaggtaaacgtttccgggactaagggtactaccgaaccgtagtaccgaacccacgtaaacgaccaactacgtacccgaaccgccctaaaccgaccggtaaccctaagtacggttacgggaacgggttccggtaacgggggaccgttacccggtaaggtacccgtaaccggtacggaacccggaaccggtaaccgggtccgttaacggttacgttacggtacggttacgggacgtaacggtacggtaaagttaaccggtcccgttacggtttaccggtaaggggtttaaccggggtaacccttacggggtaacccggttaccggggttacccgggggtaacccggtaacccgggggttaaccccgttcgggtttaaccccggtttaccccggttcccggttaaccccgg

SEQ ID NO: 100390 - DNA, 603 bp, Homo sapiens
  misc_feature: GYAE6OF02GQ1X5.24.45.E01.1.454.CMB.1.raw
  modified_base (504)..(504): a, c, t, g, unknown or other
  misc_feature (504)..(504): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacactatggtatcacctggtgcgacaggcccctgggcaaggacttgagtggatgggatggatcgagcgattagtagtaggaaacacaaactaatgacaacaagtaaagtttcggggacaagacgtacacatacgaccacacgacacactaccgacgaccaacgacgaccctaacgacgtcggacggtcgtagggggacgcccgtagaccgtaccctagacgaccggacggaccgtagtacgttacgtgngacgagtagactaagtcgtccgttacgtacgggttacgggacctcgccgttacggtcgggaccggacgggtacccgtcggtacccttccggtctacccg

SEQ ID NO: 100391 - DNA, 658 bp, Homo sapiens
  misc_feature: GYAE6OF02JMS2K.24.45.E01.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgcctctcccaggttcagctggagcagtctggagctggaggtgaagaagccgtggggcctnagtgaaggtcnctgcaagcttctggttatacttttaacactatggtatctaccgtgggtgcgacgaggtccccgtgggacaaggtacttggaggtggagtgggatcggaatcgagacgtattataggtaggaaacanaaacttancgacagaataagttcggganagtgactacgatacgaacacgtacgacacgactaccgacgacactacgcctaacngtagacggtacggtgggaacgtccgtacgaccgtaccgtacgacggaaccgtacgggtaccgttagttaccgttacgtggttacggaacgtccggtaaagtaacgtaccgtccgggtaccttagggttaacgggtacggggtacctacggtacccgttaacggtccggggtaacccggacgggttaaccccgttgggttacccgtccggttacctcccgg

SEQ ID NO: 100392 - DNA, 727 bp, Homo sapiens
  misc_feature: GYAE6OF02GZT2T.24.45.E01.1.454.CMB.1.raw
  modified_base (331)..(331): a, c, t, g, unknown or other
  misc_feature (331)..(331): n is a, c, g, or t
tcagactactatgtcacgaccggtgctcgatttagtgagtcagtaagggaaagggggacccaaaaacccacacccctccttgggagaatcccctagatcacgagctcctcaccatggactggacctggagcatcctttctggtgcagcagcaaccggtgccctctcccaggttcagctggagcagtctggagctagaggtgaagaagccgtggggcctcgagtgaggtctctgacagcttctgtattactttacacttatggtatcgtacctggtgcgacgacggccccgtgggaccaaggtcgtggaaggttggaaggtgggatggtacncgaggtcgtattagtaagtaggaaactacgtaaatgtagactaacgaagtaaacgtttcgggacctaggacgtacgtaaccgaactaccgaaccaacgacggtaccaaacgaccgtacccgaccgggaccaaaccgtacggtaccctaaacggacgttaaccgggacggtaccgggtacggggtaccctaaccggttaccggaaaccttacccgggtacgtaaacccggtaccggaacccgggttcccgggttaacgttacgtttaccgttaccgggtacgaaccgggtacgtaaacggtacttaaccgtccgtaccgttacggtacgggtaccggtacgtacggtccacgggtcgacggtaccggtaacccgtgggtaccctccgtacctacccg

SEQ ID NO: 100393 - DNA, 792 bp, Homo sapiens
  misc_feature: GYAE6OF02JZ7NI.24.45.E01.1.454.CMB.1.raw
tcagactactatgtcacgaccggtgctcgatttagtgagtcagtaagggaagggacccgaaaaaccacacccctccttgggagaatcccctagatcacagctcctcaccatggactggacctggagcattccttttcttggtggcagcagcaaccggtgccctctcccaggttcagcgtgggacgcgtagtcgtgggacgccgttggacggtagaaggacgtccggtcggggtccctcgaggtaggtaacggtccgtcgtacggcgaacgggttccttagttacggttaactttaaccgttttaaccaccgttagttacggtactccgtaccggttgggcgtacgacgtaccggccccggttaggaaccggtaaggtcgtttaggaggtttaggggacgtgggatggactacgagtacgtagttaacgtaaggactaaaaccataacgttagcgacaaacgttaggtaaacggttggaactagaacgtacaccgtaagtaccgaaccgaactacggactaaccgacgtaccgaaccgtacccgacgtaacaccgttacgaaggtacggggtacgaccgggtacgggaacttacccggtacctaaccgggtacccgtaaggtaccggaccccggttaccggttacggtttacttaacggttcgggtacgtagaaccgtacgtaagtaccgttacgttaccggtagttacggtaacgggtccggtactaccgtacggttaccgggaggaccggttacccgggtccttacggttcccggtcccgttacgtcccgg

SEQ ID NO: 100394 - DNA, 686 bp, Homo sapiens
  misc_feature: GYAE6OF02F94OK.24.45.E01.1.454.CMB.1.raw
tcagactactatgtcacgaccggtgctcgatttagtgagtcagtaagggaaagggggacccaaaaaccacacccctccttgggagaatcccctagatcacagctcctcaccatggactggacctggagcatccttttcttggtgcagcagcaaccggtgccctctcccaggttcagctggagcagtctggagctgagggtgaagaagcctggggcctcgagtgaaggtctcctgcaaggcttcgtggttatacgttttaacacctatggtatctacctgggtgcgacaggcccctgggcaaggacttggagtggactggggatgggatcgaggcgtaattagtagttacggaaactaacaaaactatcgacaacaaggtaaagtttccggggactaaggtaacgtcaaccgtatgtaacccacaacgtacaacactacccgaacggtacccaacaacgacctaactagtacgggaacggccggtagggggaaccgtacccggaacccaccgttacggaaccgaccgaccgggtccggttagtaacttcgtaggtcgcggaagtacgaaacttaacgtccgtaccggtttacgacgggtttacggggaaccctaggtacccgttaacggtacggggaccgtaacggggtaacccgtcgggttaccgtacccgtccgtacccgtaccg

SEQ ID NO: 100395 - DNA, 752 bp, Homo sapiens
  misc_feature: GYAE6OF02IKC1V.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcagtgaaggtctcctgcaggcttcgtggttatacttttaacacctatggtatcaccgtggtgcgacaggcccctgggcaaggacttgagtggagtggagtggatcgagcgtattagtagtaggaaacacaaactatgacaacgaagtaaagtttcggggacagtacgtacaacagtagaacccacacgaacacctaactacccgaaccggtacccaaccgaacgtacccgtaagtacggtacgggaacggtccgggtagggggaccgtacccggacgaacccgtaacccggtacggaacccggaaccggtaacccgggtaccggttagttaaccgttaacgttcgggttacggaccggtaaaggtaacgtaaacgttaacggttacccggtaccggttttacggtaacggggtttaaccggggtaacccgttacgggtacccggttaaccgggtaccggggggtaccccggtaaccggggttaacccccggtttacggggttacccgtttacccccgggtcccgtttacccccgg

SEQ ID NO: 100396 - DNA, 795 bp, Homo sapiens
  misc_feature: GYAE6OF02JPVCK.24.45.E01.1.454.CMB.1.raw
  modified_base (594)..(594): a, c, t, g, unknown or other
  misc_feature (594)..(594): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagccgtgggcctcgagtgaagtctcgtgcgaaggtcttcgtggttactacttttaacaccgttataggtatctacgtgggtcgacgtacgacggtcccgtgggacgaaggtacgtggaggtacggaggtaggggtagtaggtatcggaaggtacgtagtttaagtaagggtaacgggtaaaactaaaccgtaaagttaacgttaggttaaacgtaaaggttaaaggtttccgggggaactacggtaacgttaccgaacgtacgttaacggaaccgaacgaacgtaaccgtaaccgtaaccgttacccggaaccgggacccctaaacgtaaccgtaaccctaaacggtaccgtaaggggtacggtaccgggtacggggacctacccggttanaaacccggtccgtacgggaccgtaaccggacccgggtcggttacgttaacgttcgtaaggccgaacggtaagtagtaaacttacgggtcccgtaccggttacggttaagggtacccgggtaccttcggtaaccggttcgggaacgggtacccggtaccggttaccgttccggttccggtacccgttacggcccttaaccgg

SEQ ID NO: 100397 - DNA, 658 bp, Homo sapiens
  misc_feature: GYAE6OF02GFDD2.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagccgtggggcctcagtgaaggtctcctgcaggcttcgtggttacttacttttaacaccttatggtatcaccgtgggtgcgacacggcccctgggacaggcttgagtggagtgggagtggactcgaggcgtaattagtagtacggaaacaacaaacgtatagaccacaaggtaaacgtttcggggacagacgtacacatacgaccacagaccacactaccgaccggacaacacggtccaactagacggacggcggtggggacgtccgtacgaccaccgtacgaaccgacgaccggccgttatacgttaccgtggtcgacggtaagaggtaaacttacgttccggtaccgtttcggtaacgggtttaaccgggtaccttacgggtaccccttagggtccggggtaacccgtacggggtaaccccggttcgggtaccttccccggttacgtaccccg

SEQ ID NO: 100398 - DNA, 781 bp, Homo sapiens
  misc_feature: GYAE6OF02H11Q5.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctgaggtgaagaagcctggggcctcagtgaggtctctgcaaggtcttcgttggttactacttttaacaccttatcgttatcacctgggtctcgacgacggccccgtgggcctaaaggtactttaggagtcggagttggggagtggtacgtcgaggtaccgtatttaagtaaggtacggaaactaacctaaaactgtacgacaacgagtaaaccgttttcggggactaagtaacgttacgaacctagtaacgaccgtaaccaaggtaacccacgtaactacccgaccggaccaaccgacgtaccctacgacgtcgggaacgtccggtaggggaaccgtcccgtacgaccgaaccgttacggaaaccggaccgtaaccgggtccgttaccgtttaaacgtttaccgtacgggtacggtacgggtaacgtaaacggtaacgttaacgtacccggttaccgtttaccgggtaacggtttaccgggggtacccgttaccgggtacccgttaccgggttacggggtaccccggtaacgggggttaacccccggttaccgggtttccggtttacccccgttccggtttacccccg

SEQ ID NO: 100399 - DNA, 831 bp, Homo sapiens
  misc_feature: GYAE6OF02FS0X0.24.45.E01.1.454.CMB.1.raw
  modified_base (367)..(367): a, c, t, g, unknown or other
  misc_feature (367)..(367): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgcccctctcccaggttcagctggagcagtctggagctgaggtgaagagcctggggcctcgagtgaaggtcctccgtgcgaaggcttctggttatactttaacacctatgtatcacgtggtgcgacacggtccctgggcgtaaggacttggagtggtagtgggatggatcgagtcgtaattacgtaggtaggaaacctaacgaaactancgacaagtaagtaacgtttcgggactaggacgtacaacgtataccgaacctacacgtacaacacgtaccccgaacggaccctaacgaccgtacctaaccgagttacggggacgtaccgggtcggggaaccgtcccggtaacgacccgttaacccggtacgggaacccggtaaccggaaccccgggggtttccgtaacgggttttaccgttaacccgtttaggggtacccggtaacgggtaaaccggtaaggttaaacccgttaaccgggtttaccccggtttaccgggttttacccggtaaacgggggggtttttaaaccggggtacccccggtttacggggtaaacccccggtttaacccggggggttccgggggttaaccccccggtaaaacggggggttttacccccccgggttaagggggttacccccccgttttaccgggtccccgtttaacccccggg

SEQ ID NO: 100400 - DNA, 737 bp, Homo sapiens
  misc_feature: GYAE6OF02JW9Y5.24.45.E01.1.454.CMB.1.raw
  modified_base (377)..(377): a, c, t, g, unknown or other
  misc_feature (377)..(377): n is a, c, g, or t
tcagactactatgtcacgaccggtgctcgatttagtgagtcagtaagggaaaggggacccaaaaaccacacccctccttgggagaatccctagatcacagctcctcaccatggactggaccgtggagcatccttttcttggtggcagcagcaaccggtgccctctcccaggttcacgcgtggagcagtctggagctgaggtgaagagccgtgggcctcgagtgaggtctcctgacaggtcttcgtggttattactttaacactatggtactcaccgtgggcgacgacgacggtccccgtgggacaacggtcttggagttagggagtgggtatgggatcgaggactagttaagtaggtaacggaaactacaaaacgtntcgaacctaagaacggtaaacggtttcggggacaggtgtaccaacgagtccgaaaccacaacggtacaacctacgtaccaacccggaccaacgtaccgaccctaacgtaggtcgggaacgtacgggtacggggaccgtccgtacggaacctaccggtaacgtaccgtaaccggtacgggtccgttaacggttacgtttaccggacggttacgacgggtaagacggttaaaccgtaacggttcccgtacggttacggtaacggggttaccgggaccttaccggccggtttaaccggggcggggttaacccgggaccgggttaacccggttccgggtccgttacccggtccgttaaccccgg

SEQ ID NO: 100401 - DNA, 793 bp, Homo sapiens
  misc_feature: GYAE6OF02INH4M.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctccgaggttcagcgtggagcagtctggagctgaggtgaagaacgccgtgggcctgagtggacgtcacgtgcgaacggtcttcgtggttattactttacgactagtgtatcgtacgtgggtacgtcgacgacggcccgtaggacgaacggtcgtgtacggtggtaggtggacgtggatacgagtcgtaagtttagtacggtaggaaaactaacgtaaactagtacgactaacgtaagttaaacgggttcggggaccaagtacgaccgtaacgaagtaacgaccgaaacgtacgaacctacgaaccgaccgaccggaccaaccgaaacgtccaacgtacggtaacgggccgtacgggtacgggacttacccgtagaaccgtaccgttacgggaacgtaccgggtacggtacccgtttagttaacgttaccgtaggtacggtaaccggtaacggttaacggaaacgtttaccggtttaccggtacccggtttaaaccgggttaaggggttaacccgggttacccggttaacgggttaaccccgttacgggggttacccgggggaaccggttttaacccgggaccccgggttttccgggttaccccgtaccccggtttcccgtttaacccgg

SEQ ID NO: 100402 - DNA, 634 bp, Homo sapiens
  misc_feature: GYAE6OF02FV3J3.24.45.E01.1.454.CMB.1.raw
  modified_base (416)..(416): a, c, t, g, unknown or other
  misc_feature (416)..(416): n is a, c, g, or t
tcagactactatgtcacgaccggtgctcgatttagtgagtcagtaagggaaagggcacagcatggacatgagggtccccgctcagctcctggggctcctgctactctggctccgaggtgccagatgtgacatccagatcgacccagtcctccatcctccctgtctgcattctggtaggagacagacgtcaccatcctacgttggttgggacaagtgacgacctattacgcagtcttcgtttggagttgctatcaattacaaaccgaggaaacctcccctaacctcctgactctatctcgtcgtactaattacacgtaggtcgggtaccatccgaggttcaggtcgactaagtgactgaggacagtagtcactcaccacatcagcacgtctacgactaacctagtaacgtacgttanaaccgttaacttataccttcgtacaaacgtagttaacgttaccgtaccgttccccgtactacccggttacgggacgggtaacggtaaccgtaagggtacggtaacgtactaaccgaacgtaacggtaaccttgggtaacggtcctacgggaacctaccgtacgtttccgttacgttccctttacgtacccttcccggttacccaccgttaattaccgg

SEQ ID NO: 100403 - DNA, 572 bp, Homo sapiens
  misc_feature: GYAE6OF02FWYT7.24.45.E01.1.454.CMB.1.raw
  modified_base (232)..(232): a, c, t, g, unknown or other
  misc_feature (232)..(232): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
tcagactactatgtcacgaccggtgctcgatttagtgagtcagtaagggaaagggcacagcatggacatgagggtccccgctcagctcctggggctcctgctactctggctccgaggtgccagatgtgacatccagatgacccagtctccatcctccctgtctgcatctgtaggagacagagtcaccatcacttgtgggcaagtgagacattagcagctctttggagttggnatcaattcaaaccagggaaacgccccctaacctctcgatctaatactgcgtccaatttacacagtcggggtccagtccaggttcacggttgcaagtggatctggggactagtagttcactctacactatacaagctacggtctaggacaaaccctgaaacgtactttgacctaacttaaccttaattcgtacaactagtacgttacgacgtttccccgtctacgtttccggagggacgtaccgtaagtcgggtaagactacacgaacgtactgngtaccgngaccacctaagttccgttgttaccctttcacttacccgtttccccacgtactttaaccg

SEQ ID NO: 100404 - DNA, 737 bp, Homo sapiens
  misc_feature: GYAE6OF02IPY6H.24.45.E01.1.454.CMB.1.raw
  modified_base (268)..(268): a, c, t, g, unknown or other
  misc_feature (268)..(268): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtcgtggagctgaggtagaagagccgtggggcctcgagtgacggtctccgtgcaggtctctgttatactttacacttagtgtntcaccgtggtcgcgacgacggccccgtgggacgaacggtcgtcgaggttaggagtagggtagtggtacgtcgagtacgtagtttaagtaaggtaacggaaaacctaactaaactagtacgacaacgtaaagtaacggtttcgggacacggtactacaacgtatacgaacccacgacgtaaccacgtaacgtacccgaccggaccctaacgaacgtacccttaacgagtacgggacgggtaccggtacggggtacctccgtaacggtaacccgtaccgtaccggaaccggaacccgtacgggtacccggtttagttaccgtttacgtacgggacggtacgaagggtaataacgacgttacccggtacgttacggtaacgggttacggacccgttacggtcccggttaacgggtccgggtacccggaaccgggttacccggttcggtacccggttccgtcccgttacccgg

SEQ ID NO: 100405 - DNA, 662 bp, Homo sapiens
  misc_feature: GYAE6OF02I8LUA.24.45.E01.1.454.CMB.1.raw
  modified_base (369)..(369): a, c, t, g, unknown or other
  misc_feature (369)..(369): n is a, c, g, or t
  modified_base (481)..(481): a, c, t, g, unknown or other
  misc_feature (481)..(481): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtggggcctcgagtggaaggttctcctgcgaaggtccttcgtaggttattaccttttaacacctatggtatcaccgttgggtgcgacgacggccccgtgggacgaaggacgttgaggtggtagtgggatggatcgagcgattagagtagaaacacaaactntagacactaaagaaacgtttcggggactaaggaagtccaacagtacgacacacgacacactaccgaccgaccaacgacctacctacgacgtcggacgtccggtacggggtancccgtagaacccacccgtacgaccgaacccggcggtaccgttagtacgtttccgtgacggtacgagtaaagtacgtaactccggtacgtacgttacggggttacggtaccctacggtaccctacgggtaccgggaccggtaccggtacccggttcggtcccgttccggtacccttacccgg

SEQ ID NO: 100406 - DNA, 749 bp, Homo sapiens
  misc_feature: GYAE6OF02JQNL3.24.45.E01.1.454.CMB.1.raw
  modified_base (469)..(469): a, c, t, g, unknown or other
  misc_feature (469)..(469): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcgagtctggagctgaggtgaagaacgcgtggggcctcgaggtgaacggtctccgtgcaaggcttcgtgttatactttaacacctagtggtactctaccgtgggtgcgacgaccggtcccgtgggacaaggtactttggaggtggagtgggatgggatcgagcgtattagtacggtaggaaaactactaaactgtacgacaaacgtaagtaaacggtttcggggactaagggtaagtaccgactaagtacgaaccaagacgaaccacgaactacccgaacgaccganacgtacctacgtactagggacgacggtacggggaacaccggtagaaccgaccgtacggaaccgtaaccgggaccgggtaaccgttacgtacggttaccgttacggttacggaacgtaacggtaaacgtaacgtttaaacgggcccgtttaccggttaacggttaacgggttaaccgggtaaccgttaccgggtaaccggttaacccggggtaacgggaaccccgggttaacggggaccccgttacggggttaccccgttacccggttacccgttacccgg

SEQ ID NO: 100407 - DNA, 616 bp, Homo sapiens
  misc_feature: GYAE6OF02FMJFQ.24.45.E01.1.454.CMB.1.raw
  modified_base (220)..(220): a, c, t, g, unknown or other
  misc_feature (220)..(220): n is a, c, g, or t
  modified_base (418)..(418): a, c, t, g, unknown or other
  misc_feature (418)..(418): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (516)..(516): a, c, t, g, unknown or other
  misc_feature (516)..(516): n is a, c, g, or t
tcagactactatgtcacgaccggtgctcgatttagtgagtcagtaagggaaagggggacccaaaaaaccacacccctccttgggagaatcccctagatcacagctcctcaccatggactggacctggagcattccttttcttggtggcagcagcaaccggtgccctctcccaggttcagctggagcagtctggagctgaggtgaagaagcctggggcctnagtgaaggtctcctgcaaggcttctggttatacttttaacacctatggtatctacctggtgcgacaggccccctggctaaggacttggtagtgggtaatgggtatggataccgtagcgatttagaagtggaaaactacaaacgtaatgacaactagtaaagtttacggggctaggagtacaacgatcgacacagacanactcaacgaccaccagtacctacgatgggancgtaggggacncctggaacctaccgtgacgacgtaccggcgtagtattaccgtgtcgacgagagtanaacgtcgtacccgttcgtaagggtttaaccgggccttacggtccctagggttaccggggaccgacgggaaccccgttggtacccgttcgtaccgttcccg

SEQ ID NO: 100408 - DNA, 869 bp, Homo sapiens
  misc_feature: GYAE6OF02IHJBB.24.45.E01.1.454.CMB.1.raw
  modified_base (200)..(200): a, c, t, g, unknown or other
  misc_feature (200)..(200): n is a, c, g, or t
  modified_base (831)..(831): a, c, t, g, unknown or other
  misc_feature (831)..(831): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttgggtgcagcagacaaccggtcgccctctccccgtaggttccaggcgtggagtcaggtcgnggacgcgtggaggtagaagacgtccggtggggcctagaggtcggtacggtcctcgtggacgtaggtcctttaggtcggttaactttaaccttttaaccacgttagttacgtacttccgtaacggttgggtacgaccggtacgtacccgggtacccgtagggtacgaaacggttcgttacggagggttacgggacggtaggggtacgttaggaacgtcggtacggtagtaaggtttaagtaaccgggtaacgtaaaacgtaaccgtaaacgtcggtaacgaaaccgtaaacgtaacgggttaaaccggggtttaaccgggataaaccggaacttaacccggtaagtaaaccggtaccctaaacccgaacgaaccggtaaccggtaacctaccgttaaccccgggaaccgtaacccgtaaaccggtaccgtaaacccgtaccgtaacgggtaacggtaccggtccggggtaacggggtacctaccgggtaccctaacccgggtaccgtaaccggtacccggtaacccggtaccggtacggttaaccgtaccgggttacgtcggaacggtcgaagtacgtaagtacccgttcggacgttacgggtaccggtcggaccttcggtacgttaccggnggtaccgtacggtacctccggttacgccctacgtcccg

SEQ ID NO: 100409 - DNA, 830 bp, Homo sapiens
  misc_feature: GYAE6OF02GLRWF.24.45.E01.1.454.CMB.1.raw
  modified_base (138)..(138): a, c, t, g, unknown or other
  misc_feature (138)..(138): n is a, c, g, or t
tcagactactatgtcacgaccggtgctcgatttagtgagtcagtaagggaaaggggacccaaaaaaccacacccctccttgggagaatcccctagatcacagctcctcaccatggactggacctggagcatccttttnttggtggcagcagcaaccggtgccctctcccaggttcagctggagcagtcgtggagctgaggtagaagagccgtggggcctgaggtagaacggtcctccgtgacgtaaggtctttccgtaggttacttaaccgtttttaaacaaccttagttaggtaacttcccgtaccggttggggtcgaccggaaccgtaccggggtcccccggtagggaccgtaagggtaccgtttaggaggtagggtaacgttgggggattagggactccgaagtacggtaatttaaggtaggtaacggaaactaactaaacgtagacgtacgaacgtaacgttaaacgggtttcgggaactaacggtactaccaaacggttacacggaaacctacgaacaacctacgaacgtacccgaaccggaccacgtaacgaccctacgtagtacgggacgtacgggtcgggaacgtcccgtaacggacccgtacgtaccgggaaacctaccgggtacccggttacgttaacgttacgtttacggtcgggtaacgttacggaaaggtaagttaaccgttacggcccgtttaacggttacgggttaaccggttaacggggtacccttaccgggtacccggttacccgggacggggtacccggttaaccgggtacccggtttaccgggtcccgttaccccgttacccgttaaccgg

SEQ ID NO: 100410 - DNA, 731 bp, Homo sapiens
  misc_feature: GYAE6OF02JXZH2.24.45.E01.1.454.CMB.1.raw
  modified_base (102)..(102): a, c, t, g, unknown or other
  misc_feature (102)..(102): n is a, c, g, or t
  modified_base (145)..(145): a, c, t, g, unknown or other
  misc_feature (145)..(145): n is a, c, g, or t
  modified_base (147)..(147): a, c, t, g, unknown or other
  misc_feature (147)..(147): n is a, c, g, or t
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (529)..(529): a, c, t, g, unknown or other
  misc_feature (529)..(529): n is a, c, g, or t
tcagactactatgtcacgaccggtgctcgatttagtgagtcagtaagggaaaggggacccaaaaaccgacacccctccttgggagaatcccctagatcacanctcctcaccatggactggacctggagcatccttttctggtgcngnagcaccggtnccctctcccaggttcngtctggagctagtctggagctggaggtagaacgaacgccggttgggcctcgagtaggtaacggcttccgtgtacgaagtctttccgttaggttaattaacgttttaaccaccgttagnggttaacncgtaccgttgggtgaccgaaccgaccgtcccggtaggacgaacggttcctaggtaggtaggaggtcggaggttaccgagtcgtagacggtaagttaagtcggtaaaggaacctaaacgaacgtacgtaggaaccaaggtaagttaaacggtttcggggactaagggaaccttacggaaaccacgtacgtaaaccctacgtaacgacaccacgtaaccgaccggtaccacnccgtaacccaagttacgaacgggttacgacggtaccgggaactcgaccgtacacggtacaccggccgaaccgtcgtagtaccgtacgtagtacgtacgaagtaacagtacgttcgacgttaccggttaggtaccgttaccgtacggtaccggtaacgtaccgggacggtccggtaccgtccgggttacctcgttaccgtccg

SEQ ID NO: 100411 - DNA, 765 bp, Homo sapiens
  misc_feature: GYAE6OF02HRQGW.24.45.E01.1.454.CMB.1.raw
  modified_base (182)..(182): a, c, t, g, unknown or other
  misc_feature (182)..(182): n is a, c, g, or t
  modified_base (272)..(272): a, c, t, g, unknown or other
  misc_feature (272)..(272): n is a, c, g, or t
tcagactactatgtcacgaccggtgctcgatttagtgagtcagtaagggaaaggacacagcatggacatggagggtccccgctcagctcctggggctcctgctactctggctccgaggtgccagatgtgacatccagatgacccagtctccatccctcctgtctgcatctgtaggagacagngtcaccatctacgttgtgggcaagtgagacctattagcagtcttcgtttgagttgctatactaattaccgaaaaccgaggggtaaaaccnccccccttaaactccgtagtactacgtaactacgtcgtaccgttacctaaacttttacgaaccgttacggttaccggggtccctaagtcccggtaaggttaccgtagggtacgactaagtggaacgttccggaggtaacgtagttacgttaccaacgtttcctacgaacgtctaaccgtacggtacctacggttctaacgacccgtaaaacggttcggtaaaaccgtttacgttttcggaaaaccttttaaaccgttaacgtttagttaacgtacccgtaaacgtacgttaacgttacccgttaacccgggtttccccgtaagttaaccccggtagggggaccggttaacggggacccgttaaagggttccggaaacttaccgtacgtaacgtaaccgtacggtcggtacggtcctaacggtccgtaaacctcgttcccgttaacgtttcccttaatccccgtttaacccggtccctaccttagttaacccgg

SEQ ID NO: 100412 - DNA, 715 bp, Homo sapiens
  misc_feature: GYAE6OF02FV7TI.24.45.E01.1.454.CMB.1.raw
  modified_base (486)..(486): a, c, t, g, unknown or other
  misc_feature (486)..(486): n is a, c, g, or t
tcagactactatgtcacgaccggtgctcgatttagtgagtcagtaagggaaaggggacccaaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctctgcaaggcttctggttatacttttaacacctatgtatcactggtgcgacacggccctgggacaaggacttacggaggtaggagtgggatgggagtcgaggacgtaattagtaaggtaggaaaactaacaaaacgttaatacgacaacgtaagaaacgtttcgggactaggagtacaaccgaagtacgaaccaaccgagaccaacgacgtaccaaccggaccaacgaccgtacctaaacacgtagggaacgtaccgnggggtaaccgcccgaacgtaccgtacgaaccggtacgaccggtaccgtagtaacgttacgtggtacgacgggtagaacgtaacgtaaacgttaccggtaccgttacggtaacgggttaacggggtaaccccggttagaccccggttaaccgggtacccggggacccggttaaccggggaaccccggttacgggttcccgtacccggttaccggttacccgttaccccgg

SEQ ID NO: 100413 - DNA, 743 bp, Homo sapiens
  misc_feature: GYAE6OF02JNB5E.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtcgtggagctgaggtgaagaagccgtggggcctcgaggtgaaggtctccgtgcaaggcttcgtggttaattacgttttaacaccttagttggtactctaccgttggggtcgtacgacgtacggccccgtagggaccaagggtacttggaggtgggacgtgggatcggtatcggaggcgtaattaggtagacggtaaacaacgtaaatagtagactaacgtaaggttaaacggtttcgggacaaggtacgtacaacgtagtacgaaccgacgtaaacgaaccgtaactaccgtacccgaaccgggtacccaacgtaaccgtacccgtaacgaacggtacggggaccgtaccgggtacggggaccggtacctaaccggaccgtaccgtaacggaacccggtaacgacccgggttaccgttacggtaactttaccggtagtcggaacgtaggtaaactacgttaacgtcccggtacggttcgtaacggggtcggtacctcggtacccgtacggtcgggaccgtaccgggtacccttcgggttaccgtcccgtgttccccg

SEQ ID NO: 100414 - DNA, 837 bp, Homo sapiens
  misc_feature: GYAE6OF02IJOPU.24.45.E01.1.454.CMB.1.raw
  modified_base (594)..(594): a, c, t, g, unknown or other
  misc_feature (594)..(594): n is a, c, g, or t
tcagactactatgtcacgaccggtgctcgatttagtgagtcagtaagggaaagggggacccaaaaaccacacccctccttgggagaatcccctagatcacagctcctcaccatggactggacctggagcattccttttcttggtggcagcagcaaccggtgccctctcccgagttcagctggagcagtctggagctgaggtagaagagccgtgggcctcgaggtggtaacggtcctccgtgaccgtaggtctttacgttacggtttaacttaccttttaaccacttaagtggttaactcctaaccggtgggtaccgacggaccgaccgggtccccgtagggaacgtaacgggtacgtttaggacggttaggtaaggtggggaacgtgggtacttcgaagggtccgttaattttaaggaagggttaaccgaaaactaaacgttaaacgtagtaccggtaacaacgtaaaggttaaacgggtttacggggaacctaacggtaacggtacctaacctagtaaccggaacccaacggaaccgaaccacgtaaccttcccgaaccggaccctaaccgaaccgtaccgtaactaaccggngggtacgtacggggttaccgggacttccggaacgtacccggtaacccttacgggaaccaccgggtacccggttaccgttaacggttcctttaaccgggtggtacgacgtaaggaacgtaacttacgtaccgggttaccctttacgggtaacgggttaccgggaccttacggtacccggttaagggtcccgggaccggttaaaccgggttccccgtcggttacccttcccgggacccttcccgg

SEQ ID NO: 100415 - DNA, 781 bp, Homo sapiens
  misc_feature: GYAE6OF02JT296.24.45.E01.1.454.CMB.1.raw
  modified_base (214)..(214): a, c, t, g, unknown or other
  misc_feature (214)..(214): n is a, c, g, or t
  modified_base (488)..(488): a, c, t, g, unknown or other
  misc_feature (488)..(488): n is a, c, g, or t
  modified_base (514)..(514): a, c, t, g, unknown or other
  misc_feature (514)..(514): n is a, c, g, or t
tcagactactatgtcacgaccggtgctcgatttagtgagtcagtaagggaaaggggacccaaaaaccacacccctccttgggagaactcccctagatcacagctcctcaccatggactggacctggagcacttccttttcgttggtcggcagcacggccgaaccggtcgccctcgtcccgtaaggttcacgtcgtggagccgtagtcgtggacncgtggaggtgaagaggcgtgggcctgagtaggacgtctcgtgctaaggtcttcgttagttactacgttttacaccgtgtcgttactacgtacggttggcgtacgacggtaccggtcccgtgggtcgtaacggtcgttagggtacgtggtagttagggacgtaggtacgtacgacggtacgtaagtagttaggtaacgtaaaacacgttaacgagttacaacgtagtaaacgggttagtaccggataaggaccgtactaagacgtaactaccganaaccgtcgaacgtcctaaccggaacncctaacgcgtaccgtagtcgaggaccgtcggacgtcgtaccggtacaccggaaccgcgtaaaccggacccggtacgttacggttaccgttaggtaccgtaacggtcgaacgtacgaaacggtttacgtaacccgggtcggttacccgtaacgggtttcggaaaccgggtttacggacccgttaacccgggtaccggtaacccggttaaccgggtaacccggttccccggtacggtttacccgttaccccggggttaccccttacggg

SEQ ID NO: 100416 - DNA, 753 bp, Homo sapiens
  misc_feature: GYAE6OF02HHEMB.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagcattccttttcttggtggcagcagcaaccggtgccctctcccaggttcagctggagcagtctggagctggaggtgaacgagccgtggggcctgagtgaacggtctactgcaaggtcttcgttaggttacttaacttttaacaccgttagtaggtactctaccgttgggtcgcgacgacggccccgtgggacaggtacttggagtgggagtggggatcggatcgaggtgaatttagtaggtaaggaaaacaacaaatagtgaccaacgtaggtaaacggtttcgggactaaggtacgtacacctatacgaaccaacgtaacggacctaacaccgtaccgaaccggtccaaacgtacgtaccctaacgacgtacgggacggtacgggtacggggaacggtccgtacgaaccgtacccggtaacgggaccgaaccgggtacggacccggttaaggttaccgtttacggttacggtcggtaacggtaggtaagtaccggttaacgttacccgggtacgtttaaccgtaacggggttaccgggtaccggtcggttaacccgtcggtaaccggggttacccggaccggggtaaccgttcccgggttacccttacccgggtcccttaacccgg

SEQ ID NO: 100417 - DNA, 591 bp, Homo sapiens
  misc_feature: GYAE6OF02FIS68.24.45.E01.1.454.CMB.1.raw
  modified_base (217)..(217): a, c, t, g, unknown or other
  misc_feature (217)..(217): n is a, c, g, or t
  modified_base (320)..(320): a, c, t, g, unknown or other
  misc_feature (320)..(320): n is a, c, g, or t
  modified_base (466)..(466): a, c, t, g, unknown or other
  misc_feature (466)..(466): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagccgtgggcctnagtgaaggtcctcgtgcaggtcttctggttatactttacactatgtatcacgtggtgcgacacggcccgtggacaaggtcttgagtggagtgggtatggtatnaggctattagtagtaggaaacactaaactagtcgacacgtaagtaacggttcgggacaaggacgtaccaccgatacgacctaacacgaaccacactaccgaccggaccacgacgtaccctagacgtcggacgtacggtggggaccnccgtagaccctacggtacgacgaccgtacggtccgttagttactacggtgcgagatacgatacgtccgtctagtgggttaccgcttacgccgtagcgggacacggtacctggccctcgtctaccg

SEQ ID NO: 100418 - DNA, 818 bp, Homo sapiens
  misc_feature: GYAE6OF02H3880.24.45.E01.1.454.CMB.1.raw
tcagactactatgtcacgaccggtgctcgatttagtgagtcagtaagggaaaggggacccaaaaaccacaccccctccttgggagaatcccctagatcacagctcctcaccatggactggacctggagcattccttttcttggtggcagcagcaaccggtcgccctctcccaggttcagctggagcagtctggagcgtgaggtagtaaggaacgccgtggggcctgaggtgtaacgttctccgtgactaggtcttacgttaggttacttaacttttaaacctaccgtagttaggttactaccgtaccgttacgggtcgtaccggaccgtaccgggcccgtacggacgtaacggtacgttaggaggtaggacggtaggtagtaggagtacgacgagtagttagtagtaacggaaacgtaacgtaaacgtagtagactaacgaagtaaggtttcgggaactagtacgtaaccgacgtaacgtaacgaaccgaccgtaagaccgtaaccgtaacgtaccccgaaccggacccgtaaccgtaaccgtaaccctacggtacgacggtaacggtaccggggtaacgggaccgtaccggtaaccgtaaccggtaacccgtacgtaacccgggaacccggttaccgggttccgttaacggtttacgtaccggttacgggtacgaacggttaggtaaacgtaacgtttaaccgtccgttaccgggttacggttaacgggttacggtaccggtaccggttaacggttcccggtaacgggtaccggtaaccgggttaccgtaccggttccgtttccgtacccgttcccg

SEQ ID NO: 100419 - DNA, 919 bp, Homo sapiens
  misc_feature: GYAE6OF02H96P4.24.45.E01.1.454.CMB.1.raw
  modified_base (183)..(183): a, c, t, g, unknown or other
  misc_feature (183)..(183): n is a, c, g, or t
tcagactactatgtcacgaccggtgctcgatttagtgagtcagtaagggaaagggacccaaaaaccacacccctccttgggagaatcccctagatcacagctcctcaccatggactggacctggagcatccttttcttggtggcagcagcaaccggtgccctctcccaggttcagcgtcgganctagtctggagctggaggtgaaagacggccgttgggggcccttacgaggttacgggtaaacggttccgttacccgttaggaccgtaaacgggttccgtttttaccgttaacggggttttaacctttttaaaccgttttttaaacccgtaaccgttttaaccggttttaggggtttaaaccctttcccggtaaaccccgggttttagggggggttccggaacccgggttaaccgggtaaccccgggggtccccccggtttaacggggggaccgttaaaacggggttaccggttttagggggtaacgggttaggggtaacggttacgggggtaattacggggtaactcggtaaggtaccgttaaaggtttaacgttaagggtaaacggaaaacctaacgtaaacgtagtacgaaccgaaacgtaacggttaacgggttacggggactacgtaacggtaccaactcgtaacgaacctaacggaacgtaccaacgtaccgtaccgaccggacctaacgccgtaacctagtaggtaccgggagtcgggtacgggaccgtaccgttacgaacccggtagttaccgggaaccgtaaccggccgggtttaccgttaggtaccttacggtagtacggacgtacggaagtacctagtccgtacgttacggtacggtccggtaccttcggaccggttacgacgggtacgaaccggttcccgttcggtccgtttacccgtcgtacccg

SEQ ID NO: 100420 - DNA, 802 bp, Homo sapiens
  misc_feature: GYAE6OF02INOYT.24.45.E01.1.454.CMB.1.raw
  modified_base (162)..(162): a, c, t, g, unknown or other
  misc_feature (162)..(162): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagctattccttttcttgggtggcagcagcaaccggtnccctctcccgaggttcagctggagcagtcgtggagcgtggaggtgaagacgccgtggggcctcgaggttcgaacggtctccgtgacgaggtcttcgtcgttaactttaccttttaacgaccttagtggtactcctacgttgggtcgcgtacgacggtcccgtagggacaacggtcttggacggtggtacgtaggggtacgtacgggtactggacgtacgtagttagtacggtaacggaaaccaacgtaaactagtacgtaacaacggtaacgtaaggtttcggggaactaggtaacggtacctaacgtacgtaccaacgaacgacaaccgtataaccgtaccgaccgtaacccaacggtaccgtaccctaacggtacggtacgggacgtaccgggttcggggaacctccgtaaaccggttaccgaccggtaaccgggtaccgtaacccggtaccggggtccggtttaacgttaccggttaaccgtcggaaccgggtagaaacggaccgttaaagttcgtaccccggggtttattaaccgggttaggtaaaccggggttccaaaccggtcgttaacccgggtacgggtccccggttaaccgggtcccggtaacgtttccccggtttaccggtcccttacgg

SEQ ID NO: 100421 - DNA, 812 bp, Homo sapiens
  misc_feature: GYAE6OF02GRZAS.24.45.E01.1.454.CMB.1.raw
  modified_base (193)..(193): a, c, t, g, unknown or other
  misc_feature (193)..(193): n is a, c, g, or t
tcagactactatgtcacgaccggtgctcgatttagtgagtcagtaagggaaaggggacccaaaaaccacacccctccttgggagaatcccctagatcacagcgtcctcaccatggactggacctggagcatccttttcttggtggcagcagcaaccggtgccctctcccaggttcagctggagcagtctgganctgaggtgaagagccgtgggcctcagtgaaggttctcctgcgaaggcttcgtggttactttacttttaacaccttagtggttatacgtacgtgggtcgaccgacgtaccggtcccgtgggaccgtaaggtacgttaggtacggtagggtagtagggtagtggtagtacgaacggtacgttaagtttaagtaggtaacggaaaacctaaccgtaaacgtactcgactaacgtaaggttaaacggttaccgggactacggtaacgtacgaaccgtacgtaccgaaccctaacgtaacgtaacctaaccgtaaccgtaacccgacccggacccaaccggtaccgtaccgtaaccgacgtaacgggaccggtcgggtacggggtaccgacccggtacgaacccgtaccggtaccggaaccgtacccgggtaaccgggttaccggttacgttacggttacgttacggtacggtacgtaacggtaacgttaacgttaccggtccgttaccgttaccggtacggggttaaccggtacccggttacggtacccgttaccgggtaccgggtaacccggtaaccggggtacccgttaccgggttcccgtttccccgttcccgttacccg

SEQ ID NO: 100422 - DNA, 792 bp, Homo sapiens
  misc_feature: GYAE6OF02FZ37H.24.45.E01.1.454.CMB.1.raw
  modified_base (138)..(138): a, c, t, g, unknown or other
  misc_feature (138)..(138): n is a, c, g, or t
  modified_base (157)..(157): a, c, t, g, unknown or other
  misc_feature (157)..(157): n is a, c, g, or t
  modified_base (243)..(243): a, c, t, g, unknown or other
  misc_feature (243)..(243): n is a, c, g, or t
  modified_base (734)..(734): a, c, t, g, unknown or other
  misc_feature (734)..(734): n is a, c, g, or t
tcagactactatgtcacgaccggtgctcgatttagtgagtcagtaagggaaagggggacccaaaaaccacacccctccttgggagaatccctagatcacagctcctcaccatggactggacctggagcattccttttntggtgcagcagcaacggtnccctctcccaggttcagctggagcagtcgtggagcgtggtagggtagaaggtacgccggtagggccttacgagtggaggttcctcngcgaagtccttgtggttattacgttttaaccacgtattcggtactccgtacggtggtcgacgacgaacgggtccccgtagggaccgtaaacggtacgttagtagggtacggtagtacgggtagtcggtagtacgaaggtacgtaagttacggtaaacgggtaaacggaaaaccctaaaccgtaaaagtttaccgtacggtaaccgtaaacggtaaacggtttaaacggttccgggggtaaacaacgggttacgttaaccccacggttaacctaccggaaacccgtaaccgtaaacggacccgtaaacgtaaccggtacccccgtacccgggaaccctaaccggtaacctaacccggtaacgtacggtaacgggtacggtcgggtacggggtaccgaaccgtacggaaccgtccgggaacgaccggtacgggtacgttaccgttaggtacgttacgtcgacggtacgtagaagtactacgtcgtcgtaacgnggttaccggatacgtcgtcggtacgacggtaccggttacgcggtcgtaccgtcgtacc

SEQ ID NO: 100423 - DNA, 807 bp, Homo sapiens
  misc_feature: GYAE6OF02HB69V.24.45.E01.1.454.CMB.1.raw
tcagactactatgtcacgaccggtgctcgatttagtgagtcagtaagggaaaggggacccaaaaaaccacacccctccttgggagaatcccctagatccacagctcctcaccatggactggacctggagcatccttttcttggtggcagcagcaaccggtgccctctcccaggttcagcgtggagcgagtcgtggagtcgtggaggtagaaggaaggccggtggggcctacgagtggaacggtcctcccgtggacgaaggtcgttcgttaggttacttaaccgttttaaccaccgttagttcggtactccgtaccgttggggtcgtacgaccgtacggacccccggtgggacgtaaggtacgttggaggtaggaggtacggggagtaggtactacggaacggtacggtaattaacgtaacggtaacggaaaacgtaacctaaagtacgtacgaaccgtaacggtaaacggtaaacggtttccggggactaacggacgtaccacgtaacgtaccgaaaccgacgaacgtaccgaactacgacccgaccggtaccaacgaccgtacccgtaacgaggtacggacggtcggacgggtaccgtaccgacggaacccgaccgtacgaccggaacccggtacggacggttacgttacgtcgttacggacggtacgaacgggtactaacggtacgttaccggttaccgttacgggtaccggtttaccggaccggttaccgtaccggttacgggcccgggttaacccggtaccgggttaccggttcccggttacccgttcccgtacccgttccgg

SEQ ID NO: 100424 - DNA, 924 bp, Homo sapiens
  misc_feature: GYAE6OF02I4XEE.24.45.E01.1.454.CMB.1.raw
tcagactactatgtcacgaccggtgctcgatttagtgagtcagtaagggaaaggggacccaaaaaccacacccctccttgggagaatccctagatcacagctcctcaccatggactggacctggagcatccttttcttggtggcagcagcaaccggtgaccctctcccaggttcagctggagcaggtctggagctggaggtgacgtaacgccgtagggcctcgagtggaacgtctccgtgactacggctttacgtagttacttaaccttttaaccgaaccttagttacgtactaccgtaccggttgggtacgtaccggtacgaccgggtaccccggtggaacgtaacgggttaacctgggtaacggttggaacggttaggggagttcgggtaatacccggtacggtaccggttaacgtttaaacgtaaggtaaccggaaaaccgtaactaaaaccgttagtacggacctaacggtaaagtttaaaccggttacggggtaactaaacgggtaccggtaaccgtaaccgtagtaaccggtaaacccaacggtaaccggaactaacccggaccgttaccccggaaccgtaacccggacgtaaacccgtccggttaaaccgttaagggtacgggttaacccggacgggttaccggggaccgtaccgttaacccgggtaaaccctcccgggtaaaccgtaaccggtaccccggtaaacggggtccggttttaaggtaaccgtttccgtaaggggttaaccgtaccgaacggttaaaataccctttaacgggtcccggtaacccggtttacggtaacgggggtttaacccggtcccggttaacccgggttaacgttaccccggggtacggggtaaccccttacgggggaaccttttccccgggaccctttccggggttaccctaccccgg

SEQ ID NO: 100425 - DNA, 930 bp, Homo sapiens
  misc_feature: GYAE6OF02J1IS6.24.45.E01.1.454.CMB.1.raw
  modified_base (398)..(398): a, c, t, g, unknown or other
  misc_feature (398)..(398): n is a, c, g, or t
tcagactactatgtcacgaccggtgctcgatttagtgagtcagtaagggaaaggggacccaaaaccacaccctccttgggagaatccctagatcacagctcctcaccatggactggacctggagcattccttttcttggtggcagcagcaaccggtcgtccctctcccaggtttccagtcgtggacgctagtcgtggagtctggacggttagaagtaacgtccggtcggggtaccttccgaggtcggtaagtccgttaccgtcggacgtaacgtcttacgtcggttaactttaacctttaacgtacgttagttcggttaactccgtaccggttcgggtacgtccggtacgtaccggtccgtagggaccgtaaggtcggttagacggttacggtaacgngggtacgttaaggcgtacgtacggacgtttagttaacggtaacgggtttaaccggaaacctaaacgttaaacgtacgttacggaaccgttaaccggtaaagggttaaccggttttaacggggccgtaaacggtaccggttaaacccgttacccggaaacttccgggtaaaacccgttaacccggaacgttaacccgttaaccggtaacccgggttaacccgttaacccggtaaccccggaaacgttaaaccccggaacccgggttaaccgttaaaccggggttacggggtaaaccgggttccggggtacgggtaacccgggttacccgtaccgggttaaaccggaccgttaccggggacgtacccgggtaccgtttacggtaacggttacgttacccggtagggacccgttacggagtaccaacggttaccgtaccgttacggtgttaacgggtccgtaacctcgggtaacttacccgggggtagaccgttacccgggaccgtttcggtacgtttccccggccgtaacccgg

SEQ ID NO: 100426 - DNA, 753 bp, Homo sapiens
  misc_feature: GYAE6OF02HCEQU.24.45.E01.1.454.CMB.1.raw
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagactactatgtcacgaccggtgctcgatttagtgagtcagtaagggaaaggggacccaaaaaaccacacccctccttgggagaactcccctagatcacagcctcctcaccagtggactggacctggagcattccttttcttgggtggcagcagccaaccggtgccctctccaggttccagcgtggagctagtctgggagctaggaggtagaagtacgccgtgggcctacgaggtagaagttcctccgtagacgaaggtctttacgtagtttacttaactttaaccacttagtggtctacggtccgttggggtacgacggacgaccggtccccggtagggacctaagggtactggagttgggagtggggntaggtctcggagtctaagttanaggtaacgaaacaagtaaacgtgtanaccgaagtaaggttacggtacgggacagtacaccgacagtaccgaacctaggacaccctaagtccaacccgaccggtacccaagtacccgacctaacgtacggtaacgaccggtggggtaccggccgttccctacggaaccttaccgggaaccgaccggtacgggtaaccggtccgttaagtaccgtttcgacggtcgacgtaaagataacggtaccgtcgggtaccgttagggtaaccgggttacccggtcctacggtacccgttcggggtaaccgggtaccccgaccggggttacccgttccggtacccgggtttccctacccgttccggg

SEQ ID NO: 100427 - DNA, 705 bp, Homo sapiens
  misc_feature: GYAE6OF02JH9HH.24.45.E01.1.454.CMB.1.raw
  modified_base (127)..(127): a, c, t, g, unknown or other
  misc_feature (127)..(127): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (385)..(385): a, c, t, g, unknown or other
  misc_feature (385)..(385): n is a, c, g, or t
tcagactactatgtcacgaccggtgctcgatttagtgagtcagtaagggaaaggggacccaaaaaccacacccctccttgggagaatcccctagatcacagctcctcaccatggactggacctggancatccttttcttggtggcagcagcaaccggtgccctctcccaggttcagctggagcagtctggagctgaggtgaagagcctgggctcagtgaggtctctgcaggtcttcgtggttatactttacnctagtgtatcacgtggngcgacgacgcccgtggacaggtacgtgagtggagtcggatgggactgaggtacgatttagtaaggtaggaaacctaactaaagtatacgacaacgtaagtaaacggtttcgggganaacggtacgttaccaaccgtagttaccaaaccgtacgacggaacctaaccgaccgttaacccggaaccggtaccctaaaccggaccgttaaccctaacgtacggttaacggaaccggtaccgggttacgggaccgtacgtaccgaacctacgtacggaacccgtacggaccggtaccggttacgttacgttcgtaggtcggaacgaggtaacgtaacgtacgttaccggtacgttccggtacgggttaaccggtactaccggtaccggtacggtccgggacccggtacggtaaccggtcgtcccgttaccgccgtaaccg

SEQ ID NO: 100428 - DNA, 751 bp, Homo sapiens
  misc_feature: GYAE6OF02HOTE6.24.45.E01.1.454.CMB.1.raw
  modified_base (418)..(418): a, c, t, g, unknown or other
  misc_feature (418)..(418): n is a, c, g, or t
tcagactactatgtcacgaccggtgctcgatttagtgagtcagtaagggaaagggacccaaaaaccacacccctccttgggagaatcccctagatcacagctcctcaccatggactggacctggagcattccttttcttggtggcagcagcaaccggtgccctctcccgtaggttcagtctggagcgagtcgtaggagcgtggaggtagaaagaacgccgtggggcctgagtagaaggtctcctcgactaaggtcttacgttaggttaacttacttttaaccaaccttattgttactcgtaccgtgggtcgacgacgacggccccgtgggacgaaggtcgttaggagtaggagtgggtacgtggagtcgtacgacgtagttaagtagtaacgaaaccgaacgtaaactaagtacgtanaaacgtaacggtaaacggtttcggggaacgtaggtaacgtacgtaaccgtataaccgaacaaccgaacggaaccaaccgtaccgtaccgaccggaccaacgacgaccctaagaacgtacgggtacgacggttcgggacttccgacgacctaccgagaccgaccgccggtacgttagttaccgtacgtggacgacgtaaggaacgtaataccgttaccgtccgtttaaggtaaccggttacgggaaccctccgggtaccgttaaccggtcggggtaacccgttaaccggggaaccccgtttccgggtaaccccggttacgttccccgttaccgg

SEQ ID NO: 100429 - DNA, 821 bp, Homo sapiens
  misc_feature: GYAE6OF02GT1LG.24.45.E01.1.454.CMB.1.raw
  modified_base (129)..(129): a, c, t, g, unknown or other
  misc_feature (129)..(129): n is a, c, g, or t
tcagactactatgtcacgaccggtgctcgatttagtgagtcagtaagggaaagggggacccaaaaaaccacacccctccttgggagaatcccctagatcacagctcctcaccatggactggacctggancatccttttcgtggtggcagcagcaaccggtgccctctcccgaggttcagctggagcagtctggagctggaggtgaacgaagcgttggggcctagaggtcgaacggtctccgtgacgaaggtccttagtaggttactacttttaacacgttagtcggtactccgacgttgggcgaccgtaacgcggaccccgtagggacaaacgggtcttggaggtaggacggtgggaacgttggacttacggaaggtacgttaagttacgtaaggtaacggaaaactaaccgtaaacgtagtacgaacgtaactaaagggttaacgttccggggaatacggtaactccgaaacgtgtaacgaccgaacgacggtaacaccgtaccgtacccggacgtaccgaacgaccggttaccaacggttacgttacggggaagttccgggtaacggggtacttacccgggtacaaaccggtttaccgacgggaaacccgttacccgggaacgggtaccccgtttaaggttaaccgtttacgggtggtaaccggtacgaaacggttacgtaaaccgtacgttaccggttcggttaaccggtttaggggtaaccggacccggtttacgtaacccggttacgggtacccggggaaccttaaccgggggttaccctaccggggtttacccgttacccgtacgtttaaccccg

SEQ ID NO: 100430 - DNA, 864 bp, Homo sapiens
  misc_feature: GYAE6OF02IR9A2.24.45.E01.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (324)..(324): a, c, t, g, unknown or other
  misc_feature (324)..(324): n is a, c, g, or t
tcagactactatgtcacgaccggtgctcgatttagtgagtcagtaagggaaagggggacccaaaaaaccacacccctccttgggagaactcccctagatcacagctcctcaccagtggacgtggaccgtggagcattccttttcttggtggcagcagcaaccggtgccctctcccaggttcagctggagcngtctgganctggaggtgaagaagccgtgggcctcgagtgaacggtctacctggcaagtcgtttgttaggttacttaacttttaacctacttagtaggttatcctacgtacggtggacgacgaaggtccccggngggacgaaacggtacgtgaacggtggaagttcggggagtacgggtacgtacgtacggacgttaagtttaaggtacggttaaacggaaaacctaaaccgtaaaacgtaagttaccgacgaaaccgttaaagtaaaccggggtttacgggaaccgtaagggtaccgtaaacgtaccgtaaaccgttaacggtaacccgaacggaaaccgtaaccggacaaccggtacccccgaaacggaccccgttaacgaacggtacccttaacggtagggtaaccggtacgggcgggttaccggggaaccggttaaccccgaacgttaccccgtacggaaccggtacccggaccggggttaccttacggttaactttaccgggacgttacggaacggagtaaaccggaagttaacccggtacggttacccgtttagggaaccgggtttacggggaccctccgggttacgtacccccggggtagggaaccccgggtacggggttaacccggttcccggttcggtaccccgttcccgtaccccgttaccggg

SEQ ID NO: 100431 - DNA, 724 bp, Homo sapiens
  misc_feature: GYAE6OF02JR3OF.24.45.E01.1.454.CMB.1.raw
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (426)..(426): a, c, t, g, unknown or other
  misc_feature (426)..(426): n is a, c, g, or t
tcagactactatgtcacgaccggtgctcgatttagtgagtcagtaagggaaaggggacccaaaaaccacaccctccttgggagaatcccctagatcacagctcctcaccatggactggacctaggagccattccttttcgttggtggcagcagacaaccgggtgccctctcccaggttcacgtcgtaggagctagtccgtggagcgtagaggacgaagaggtccgtgggcctacagtgacgttcncgtacgacgtacgtcttctggttactaacgtttanactgtgctacgacgttggntgacgtcgcccgtggaccacggtagcggtagtggaggtcggattcggacgtcgagacgttactaaggttacgaaggaaacctaacgtaacgttaagccgactacggtaaacggttaaggttacccgnggtaacggttaacacgttaaaccgacgttccggtaaacaggaacttaaccaacccgtagtacccggaacgtaccaaccgtaccgaaccgtacgtacgtaacgggtaacctacgggtaacgggttcgtaccgtaacggtaacccgtccggtacgaaacccgcgttaccgggtacgtttaccgtacgttaacggcgttacggacgttaagtcgaacgtaccgttccgtagtcgtaacggtaacgtcgtaccgcggtacggtacggaccgttccggaccgttcgaccttccgtacctaccg

SEQ ID NO: 100432 - DNA, 786 bp, Homo sapiens
  misc_feature: GYAE6OF02GIXU1.24.45.E01.1.454.CMB.1.raw
  modified_base (231)..(231): a, c, t, g, unknown or other
  misc_feature (231)..(231): n is a, c, g, or t
  modified_base (292)..(292): a, c, t, g, unknown or other
  misc_feature (292)..(292): n is a, c, g, or t
  modified_base (406)..(406): a, c, t, g, unknown or other
  misc_feature (406)..(406): n is a, c, g, or t
  modified_base (712)..(712): a, c, t, g, unknown or other
  misc_feature (712)..(712): n is a, c, g, or t
  modified_base (735)..(735): a, c, t, g, unknown or other
  misc_feature (735)..(735): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcattccttttcttggtggctagcagcaaccggtgccctctcccaggttcagcgtggagcagtctggagctgaggtgaagagccgtgggctcgagtgagtctccngcgtaagtctcgtagttataacgttttaacaccgttatggtactccgtaaccgtggggtcncgacgacggtccccgtagggacaacgggtacttggaaggtggaggtagggagtgggtactacgaaggccggtaatttagtaacgtaggaaaaccgaactaaaaacgttcgtaanacccgaaagttaaacggtaaacggttttacggggagtaaccggtagtaacccgaaacccgtaacttaacgggtaaacccctaacggaaccttaaaccgacccgtaaacgtttaccccccgaaaccggtaccccggaaaactcccggttacccccgtaaagtaaacccgttggggtaaccggcggttacgggggaacccttccggtaacgacccgtaacgacggtaacgcccggtaaccggtacccgtagggttaaccttacggtaggttcggaacgttagacggttaactacgtccgtaacgggtntaacggggtaccggtccgttacncccgtagggtcggaccggtacgtaccccgttggtcccttacgtctacccgg

SEQ ID NO: 100433 - DNA, 880 bp, Homo sapiens
  misc_feature: GYAE6OF02GP83U.24.45.E01.1.454.CMB.1.raw
  modified_base (192)..(192): a, c, t, g, unknown or other
  misc_feature (192)..(192): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctgganctgaggtgaagaagccgtaggggcctcgaggtgaacggttctccgtggacgtaaggtccttacgttaggtttaactttaacccgtttttaaaccaacccgttagtttacgggttaacttaccgaacccggtttgggggtacgtaccggaacgaacccggggtccccccgttagggggaacccctaaaggggtaacccgtttgggaacgggttaggggtaacggttacgggggggtaacttaggggggtaaacttaccgggaaccgggtacggttaaaacgtttttaacgtaagggggttaaaaccggggtaaaaaccttaaaccggttaaaaaaccgtttacgttaacgggaaccctaaacggtaaaacggttaaaacgggttttcccggggggaactaacgggtaacggttaccaaaccgtagttaaccgaacccgtaacgaaccgaccgtaaactaccgacccgaaccgacccgtaacgaccggtaccctaagtaggtacggacggtcggtacgggacgtaccgttacgaaccgaccgttacggaaccgtacgtccgggtacgtactttacgtacggtcgtaggacggaagtacgtacgtaagtccgtacggttaggtacggtaacgggtctcggtaccgtacgggtcggtacgaccggtcccgtcggtccttccggtctacccgg

SEQ ID NO: 100434 - DNA, 669 bp, Homo sapiens
  misc_feature: GYAE6OF02G7ZKC.24.45.E01.1.454.CMB.1.raw
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (315)..(315): a, c, t, g, unknown or other
  misc_feature (315)..(315): n is a, c, g, or t
tcagactactatgtcacgaccggtgctcgatttagtgagtcagtaagggaaaggggacccaaaaaccacaccccctccttgggagaatcccctagatcacagcctcctcacatggactggacctggagcattcctttctggtagcagcagcaaccggtgaccctcctcccaggttcagcttggacgcagtcgtggagcgtgaggtgaagagccgtgggcctgagtggaagttcncgtgcgagtcttcgtagttattaccttacnctagttgtactcacggtggtcgacgacgtacggtcccgtggtacaacggtntagtaggtacggtggtcggtagtaggtactgacggtcgtaagttacgtaaggtacggaaactaactaacgtactcgacgtaagaagttacggttcgagtaggactacgacctagtccaacgtaagtacgactacgacgttcccgaacggacgtactaccgtacctagaccgtacggaggtacggtcggacgtaccgtacgacgtacccgttaggaactaccggcgtaccgtacgttagtaacgtgaacgtgagtacgactacggtccgttacgtacgtaagggttacgtacctacgggtcgtacggtacgggacctacgggaccgttaccggttacgaccgtttccggtacccg

SEQ ID NO: 100435 - DNA, 662 bp, Homo sapiens
  misc_feature: GYAE6OF02JDFPN.24.45.E01.1.454.CMB.1.raw
  modified_base (284)..(284): a, c, t, g, unknown or other
  misc_feature (284)..(284): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagagccgtgggcctcgagtggaaggtctcctgcaaggtcttcgtggttaattacttttaacacctagtgtatcctactgggtncgacacggccccgtgggacaaggtcttaggagttggagtagggctggatcgagcgtatttagtaaggtaggaaaccacaaatagtgaccaacgtaagtaaacggtttcgggacaaggtacgtaccgaacctagtaccgaaccgtaacacgtaaccactaaccgtacccgaacccgggaccaacgtaaccgacccgttaacacgtacgggaacgtccgggtaggggaccgtacccgtaggacccgtaccgtaacgaccggacgtaccgggtccgttagttactacgtgcgacgagatacgtacgtcggacttcggaggtccgggtctcggtccgtacggtacgggccgtaacggccgttacggccttaccgtctacccg

SEQ ID NO: 100436 - DNA, 545 bp, Homo sapiens
  misc_feature: GYAE6OF02GJ54N.24.45.E01.1.454.CMB.1.raw
  modified_base (392)..(393): a, c, t, g, unknown or other
  misc_feature (392)..(393): n is a, c, g, or t
  modified_base (410)..(410): a, c, t, g, unknown or other
  misc_feature (410)..(410): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacgaaactatgacacagaaactttcggggacagagtcaccatgacacagacacnnccacgccacacgcctanactggacgcgtggggacgtcgtagacaccgtgaccgacgacggccgtagtacttactgtgcgagagatagcgcgttagaggttcgggactgtacctacgtggggaccagggtaaccctggtcctccgtctacccg

SEQ ID NO: 100437 - DNA, 858 bp, Homo sapiens
  misc_feature: GYAE6OF02HQRTL.24.45.E01.1.454.CMB.1.raw
tcagactactatgtcacgaccggtgctcgatttagtgagtcagtaagggaaaggggacccaaaaaccacacccctccttgggagaatcccctagatcacagctcctcaccatggactggacctggagctattccttttcttgggtcggcagcgagctaaccgggtcgtccctctacccgtaggttccaggtccgttggacgcacggttcgtaggagtccgttaggaagggttagaaaggtaaccggtcccggttgggggccccttaccggaaggttaggtaaaccgggtttcccgtacccgttaggaccggtaaggttccctttccgtttaaggtttaaaccttttaaaccctttttacggaaccttgttaacgggttaccttaccggtaccgttggggtaccggaccggtacggtaaccgggtccccggtagggaccgtaaggtaccggttgagggtacgtaggtacggggacttaggggactcgtacggtaccgttaagtttacgtaagggtaacgaaacgtaactaacgttacgacgtaacaccgttaaggtaaacggtttcgggaactaaggactaaccgacttagtaccgaaccgacaacgtaactccgactccggaccctacccgacgtaccgtaccgtacgtacgtacggacggtacggtacgggaccggacccgaaccgttacgtacggtaccgacggtaccggtacgttcgttacgttaccgtcggtacgacgtaacggtaacgtaacgtaaccgtacgttcggttacgagggtttaccggacgttaccgtccgtacgggttaccgacggtaccggtacgttccggttccgtcgtttacccacgtcccg

SEQ ID NO: 100438 - DNA, 723 bp, Homo sapiens
  misc_feature: GYAE6OF02G2ZUA.24.45.E01.1.454.CMB.1.raw
  modified_base (573)..(573): a, c, t, g, unknown or other
  misc_feature (573)..(573): n is a, c, g, or t
tcagactactatgtcacgaccggtgctcgatttagtgagtcagtaagggaaaggggacccaaaaaccacacccctccttgggagaatccctagatcacagctcctcaccatggactggactggagcatcctttcttggtgcagcagcaaccggtgccctctcccgaggttccagctggagcaggtctcggagcctggaggtcgaagaacgcctggggctcgagtgaaggtctcctgcaaggctcgtgttatacttacactagtggtactctccgtggtcgcgtacgacggtccctgggacacggtcgtggaggtacggatggggactgggactccgaggtcgtagttataggtaacgtaaacgacgtaaacgtatcggacctaacgtaaggtaaacggtttccgggactagtaacgtcgtaccagtacgtacacggacgaccaacgtaccgtacgacccgtcaacgaccggtccacggtagtacgggacacgggtacggggtaccacccggaccgtacgacgggtaaccgaccgtaaccgggtcgttaacgtaaccgttgtaccgggacgtanaccggtaagtaccggttaacctcggacccgtttaggtacgggttaccggggtaacccttagggtcccgttaaccggggagggttaccccgtaaacccgggttacccggttaccggtcccgggttttacccgacgttttacccggacccgg

SEQ ID NO: 100439 - DNA, 677 bp, Homo sapiens
  misc_feature: GYAE6OF02FQZYH.24.45.E01.1.454.CMB.1.raw
  modified_base (101)..(101): a, c, t, g, unknown or other
  misc_feature (101)..(101): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
  modified_base (432)..(432): a, c, t, g, unknown or other
  misc_feature (432)..(432): n is a, c, g, or t
tcagactactatgtcacgaccggtgctcgatttagtgagtcagtaagggaaaggggacccgaaaaaaccacacccctccttgggagaatcccctagatcanagctcctcaccatggactggacctggagcattccttttcttggtggcagcagcaaccggtgccctctcccaggttcagctggancagtctgganctgaggtgaagaagcctggggacctcagtgaaggtcctactgacgaaggtcttctggttacttaacgttttaaccncttatggtactcctaccgtgggtcgcgacacggtcccctgggacaaggtactggcgtaggaggtcgggagtgggtattacgaggtacgtaagtttacgtaaggtaacgtaaaactacgtaaaacttagaccgtacaaacaaggttaaacgtttccgggganaacggtacgtccaactagaccgtaaccaacaagaaccaacgctacccgaccggccaacgacgtacccataggtcgaggttcggacggttcggcctacgactacctggaacccggtacgcccgggttagtacttaacgttctggagccgaggactaactacgtcggtacctaggtaggttaacccggcttaaccggccgtacggtcgggaacccgacgggttaccgtccgccgttcccgtctcccg

SEQ ID NO: 100440 - DNA, 728 bp, Homo sapiens
  misc_feature: GYAE6OF02IM23S.24.45.E01.1.454.CMB.1.raw
  modified_base (191)..(191): a, c, t, g, unknown or other
  misc_feature (191)..(191): n is a, c, g, or t
  modified_base (456)..(456): a, c, t, g, unknown or other
  misc_feature (456)..(456): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttctggtggcagcagcaaccggtgccctctcccaggttcagcgtggagcagtctggngctggaggtggaagaacgccgtcggggcctcgagtggaaggtccgtcctgacgaaggtcttcgtaggtttaacttaccttttaaccaccttagttaggttactccgtaccgttgggttcgaccgacgtacgggcccccgtggacgaacgggtacgttggagtgggagtagggtagtaggatcgaggtcgtaatttaacgtaggtaacggaaaacctaactaaaacgtgtacgacgaacgtaaacgttaaacggtttccggggaanaacggtacgtaccgactaagtaccgaacaacgaccaacgaccgactacccgacggaccacgactaccgtacagtacgggactcggtacgggacaccgtagaccgtaccgcggaaccgaccgtaacgggtccgttaacgtacgttccgtgtacggagaacggaagtaacgtccgtacgtaccgtttagggacgggttaccggaccgttcggaccgttacgggtaccggcgttaaccggggtccgttacggttcccgttcccgttacgtacccg

SEQ ID NO: 100441 - DNA, 657 bp, Homo sapiens
  misc_feature: GYAE6OF02GHI8T.24.45.E01.1.454.CMB.1.raw
  modified_base (165)..(165): a, c, t, g, unknown or other
  misc_feature (165)..(165): n is a, c, g, or t
tcagactactatgtcacgaccggtgctcgatttagtgagtcagtaagggaaaggggacccaaaaaccacacccctccttgggagaatcccctagatcacagctcctcaccatggactggacctggagcatccttttcttggtggcagcagcaaccggtgccctcncccaggttcagctggagcagtctggagctgaggtgaagagccgtgggcctcagtgaaggtcctcctgcaaggcttcgtaggttacttacttttaacacctatggtactcgtaccgtgggtacgcgactaacggccccctagggacaaggtactttggaacggtggaagtgggatgggatacgagacgtattagtagtacggaaaactaacaaacttatagacaagtaagtaaagtttccgggactaggtagtcaactatcgacaacaggtaccactactaccgaaccgtccaacgactacacagtacggacgcgggtagggacgtccgtacgacaccgtagacggtaccgccgggacgttacgtacgttacgtacgtcgacgaagtacgtagtaacgcgttaccgtacgtacgggtacgggtacctccggtaccgtcccggtacgggaccggaaccggtaacccgtcggttacccttaccgtccgttacccg

SEQ ID NO: 100442 - DNA, 415 bp, Homo sapiens
  misc_feature: GYAE6OF01D51ZU.12.25.C03.1.454.CMB.1.raw
  modified_base (409)..(415): a, c, t, g, unknown or other
  misc_feature (409)..(415): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactacgtggggcctgggaactctggtcaccgtctcctcagcctccaccaagggcccatccggtcttccccctggccgccctgcctccaggacgccacctccgagagcacagccggccctggggctgcctggtcaaggctacttcctacgtcgtatctgagcgggctggcaaggcgcatagnnnnnnn

SEQ ID NO: 100443 - DNA, 141 bp, Homo sapiens
  misc_feature: GYAE6OF01BZR36.12.25.C03.1.454.CMB.1.raw
  modified_base (141)..(141): a, c, t, g, unknown or other
  misc_feature (141)..(141): n is a, c, g, or t
tcagatacgacgtacacgaccggtgctcgatttagtagtgtagatttgggtttgggggaagaggaagactgacggccctgggctgcctggtcaaggactacttcctacgtcgtatctgagcgggctggcaaggcgcatagn

SEQ ID NO: 100444 - DNA, 403 bp, Homo sapiens
  misc_feature: GYAE6OF01CR3II.12.25.C03.1.454.CMB.1.raw
  modified_base (401)..(403): a, c, t, g, unknown or other
  misc_feature (401)..(403): n is a, c, g, or t
tcagatacgacgtacacgaccggtgctcgatttagtagtgtagatttgggtttgggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtctccccctggcgccctgctccaggagcacctccgagagcacagcggccctggggctgcctggtcaaggactacttcctacgtcgtatctgagcgggctggcaaggcgcatagnnn

SEQ ID NO: 100445 - DNA, 520 bp, Homo sapiens
  misc_feature: GYAE6OF01ADH31.12.25.C03.1.454.CMB.1.raw
  modified_base (512)..(512): a, c, t, g, unknown or other
  misc_feature (512)..(512): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccgagggcagactcaccatgaccacagacacatcagcgaacacagtcaacatggagttgcggagcctgcgatctgacgacgcggaccgtatacgttactgtgcgagagtacgtgcgctcgtcttgactcgtggggcctgggaacctgtgtcncgtctccg

SEQ ID NO: 100446 - DNA, 564 bp, Homo sapiens
  misc_feature: GYAE6OF01BVSTC.12.25.C03.1.454.CMB.1.raw
  modified_base (388)..(388): a, c, t, g, unknown or other
  misc_feature (388)..(388): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggagtggggtgatcgaacgtacagacgtggtgcacagactatgcacgaggggctccgagggcagactcaccatcgaccanacgacacatacagcgaacacagtacaacagtggagtggcgagcctgcgatctgaccgacggcgaccgtatagttacgtgtgacggagacggtacgtacgcggtcgttacgttcctttaggacttccgggtcggggtccgttacgggtaaccttcgtaggtcctaccgtcttacccg

SEQ ID NO: 100447 - DNA, 522 bp, Homo sapiens
  misc_feature: GYAE6OF01COD2R.12.25.C03.1.454.CMB.1.raw
  modified_base (514)..(514): a, c, t, g, unknown or other
  misc_feature (514)..(514): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccgagggcagactcaccatgaccacagacacatcagcgaacacagtcaacatggagttgcggagcctgcgatctgacgacgcggcctatattacgtgtgcgagagtacgtagcggctcgtcctttgactacgtggggcctgggaactcgtggtcncgtctccg

SEQ ID NO: 100448 - DNA, 600 bp, Homo sapiens
  misc_feature: GYAE6OF01EMT0U.12.25.C03.1.454.CMB.1.raw
  modified_base (216)..(216): a, c, t, g, unknown or other
  misc_feature (216)..(216): n is a, c, g, or t
  modified_base (396)..(396): a, c, t, g, unknown or other
  misc_feature (396)..(396): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagccttcctttttcttggtggcagccgcaacaggtgcccactcccaggttcagctggtgcagtctggggctgagatgaagaagtttccgnggggcctcagtaaaggtctcctgcgaggcttcgtggttacacctttctcaggtatactattgccgtgggtgcgacaggcccctggacaagggcttgagtggagtggggtgatcgaacgtacagacgtggtggcacgagactatgcacgaggggctccgagggcagactcaccatgaccanagacacatcagacgaaacacagtacaaacagtaggagttcgacgggaacgtccgtgcgatcgtaggaccgacggcgggtaccgttaatagtttaccgtggtcgacggaagtaggtaacggtaggccgggtcttccggttcctttaggaacgttcggtcgggggtccttacggggtaacttcggttaggtcctccggttctcccg

SEQ ID NO: 100449 - DNA, 569 bp, Homo sapiens
  misc_feature: GYAE6OF01EH2G4.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgagggggctccgagggcaagactcaccatcgaccacagaacacatcagcgaacacagtacaacatggagttgcggagcctgcgatctgacgacgcggccgtatacttactgtgcgtagtaggttttagtagtattactttagttggttaggtggttggttaccttggtcgtttacgttttggttaccggtacccccggttggggcccgtaaccgggg

SEQ ID NO: 100450 - DNA, 405 bp, Homo sapiens
  misc_feature: GYAE6OF01DCYMT.12.25.C03.1.454.CMB.1.raw
  modified_base (401)..(405): a, c, t, g, unknown or other
  misc_feature (401)..(405): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggcgccctgctccaggagcacctccgagagcacagcggccctgggctgcctggtcaaggactactcctacgtcgtatctgagcgggctggcaaggcgcatagnnnnn

SEQ ID NO: 100451 - DNA, 421 bp, Homo sapiens
  misc_feature: GYAE6OF01BNO9R.12.25.C03.1.454.CMB.1.raw
  modified_base (415)..(421): a, c, t, g, unknown or other
  misc_feature (415)..(421): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtccttccccctggccgccctgctccaggacgccacctccgagagccacacgccggccctggggcctgcctgggtcaaggactacttcctacgtcgtattctgacggcgggctggcaaggcgcatagnnnnnnn

SEQ ID NO: 100452 - DNA, 408 bp, Homo sapiens
  misc_feature: GYAE6OF01AW8VJ.12.25.C03.1.454.CMB.1.raw
  modified_base (402)..(408): a, c, t, g, unknown or other
  misc_feature (402)..(408): n is a, c, g, or t
tcagatacgacgtacacgaccggtgctcgatttagtagtgtagatttgggtttgggggaagaggaagactgacggtcctgccacagactatgcacaggggctccagggcagactcaccatgaccacagacaacatcagcgaacacagtcaacatggagttgcggagcctgcgatctgacgacgcggcagtatattactgtgcgagagtacgtagcggctcgtcctttgactactggggcctgggaactctggtcaccgtctcctcagcctccaccaaggcccatcggtcttccccctggcgccctgctcccaggagcacctccgagagcacagcggccctggctgcctggtcaaggactacttcctacgtcgtatctgacgcgggctggcaaggcgcatagnnnnnnn

SEQ ID NO: 100453 - DNA, 648 bp, Homo sapiens
  misc_feature: GYAE6OF01EMSML.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgaggggctccgagggcagactcaccatgaccacgagacacactacagacgaaaccacgaacgtaccaaactaacgtagggtaagtttcgggaccgggtaacggtcccgttcggaccggtactttccgtacgggaaccgtacgggcccgggtaccgttaagttacgtttaacgttgtacggacgtaagggtacgtaaccggtacggccggtcgttcccggttaccgttttaggaccgttacggtcgggggtaccgttacggggaaccttcgtagggttcccgtccgtccttacccg

SEQ ID NO: 100454 - DNA, 525 bp, Homo sapiens
  misc_feature: GYAE6OF01B2U64.12.25.C03.1.454.CMB.1.raw
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacacggcccctggacaagggcttgagtggagtggggtggatcaacgtacagactggtgcacagactatgcacgaggggctcgagggcagactcaccatgaccacagacacatcagacgaacacagtcaacagtggagttgcggagcctgcgatctgaccgacggcggcgtatacgttactgtgcgagagtacgtagcggctcgtccttgactcgcgggtcnggtactcgtagtcnccgtctccg

SEQ ID NO: 100455 - DNA, 541 bp, Homo sapiens
  misc_feature: GYAE6OF01BH7H6.12.25.C03.1.454.CMB.1.raw
  modified_base (512)..(512): a, c, t, g, unknown or other
  misc_feature (512)..(512): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgaggtggagtggggtggatcaacgtacagacgtggtggcacgagactatgcacgaggggctcgagggcagactcacatcgaccacagacacatacagacgaaacacagtacaaacagtggtagttggcggagcctgacgatcgtgaccggacgcggtaccgtattagttacgtgtagcgtagaggtacgagcgcttcgtcttgactcgngggctagggtactcgtagcaccgtctccg

SEQ ID NO: 100456 - DNA, 607 bp, Homo sapiens
  misc_feature: GYAE6OF01DEOSE.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggtcttctggttacacctttctcaggtatactattgcctgggtgcgacacggccctggacgagggcttgagtggagtggggtggatcgaacgtacgagacgtggtcggcacgagactatggcacgaggggctcgagggcagactacaccatcgaccacgagacacactacgagaccgaacacgaacgtacaaactagtaggagttggacgtatccgtggacgatcgtacgaccgacggaccgtaccggttattacttacgtggtcgacggaggtaaggtacgtcggaccggtcgttccggttctttggacgttaccggtcgggggtccttaggggtaccttcggtacggtcccgtaccgtcccgttccccg

SEQ ID NO: 100457 - DNA, 576 bp, Homo sapiens
  misc_feature: GYAE6OF01D65OJ.12.25.C03.1.454.CMB.1.raw
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggagtggggtggatcaacgtacagacgtggtggcacagactatgcacgaggggctccgagggcagactcaaccatcgaccacagacacatcagcgaacacagtaccaaacagtggagttggcggagcctgcgatcngacgcgcggaccgtatatactgngacgagagtacgtaggccggtcttccggttcctttaggaccgttacggtcggggtcccgttacggggtaaccttccggttcgggttacccgtacccgtccgttaccccg

SEQ ID NO: 100458 - DNA, 525 bp, Homo sapiens
  misc_feature: GYAE6OF01DGPYA.12.25.C03.1.454.CMB.1.raw
  modified_base (332)..(332): a, c, t, g, unknown or other
  misc_feature (332)..(332): n is a, c, g, or t
  modified_base (413)..(413): a, c, t, g, unknown or other
  misc_feature (413)..(413): n is a, c, g, or t
  modified_base (438)..(439): a, c, t, g, unknown or other
  misc_feature (438)..(439): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (461)..(462): a, c, t, g, unknown or other
  misc_feature (461)..(462): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (522)..(522): a, c, t, g, unknown or other
  misc_feature (522)..(522): n is a, c, g, or t
tcagatacgacgtacacgaccggtgctcgattttagtagtgtagatttgggtttggggggaagaggtaagactgacggtccttgccacagactatgcacaggggctccgagggcagacgtcaccatcgaccacgacgacacatcagcgaacacagtcaacatggagttgcggagccttgcgatctggacgacgcggccgtagtagttactgtgcgagagtacgtagcggctcgtcctttgactacgtgggacctgggaactctggtcaccgtctcctcagcctccaccaagggcccatcggtcttccccctggccgccctgcctccgagganccacctccgagacgcacagcggccgtgggctcgcctggtcaaggacttacttccgtacgtcgtaatcgtcgacggcgggcnggccaagggtccgacgacgttaggnngacgtgacgtacgcancgcncnncncncgcgcgcgcncgctctcgcgcncncncacgcncncgcgcgcgcgcgacgcgcgcgngcg

SEQ ID NO: 100459 - DNA, 606 bp, Homo sapiens
  misc_feature: GYAE6OF01AUWGQ.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgaggtggagtggggtggatcaacgtacagactggtggcacagactatgcacaggggctccgagggcagactcacatcgacccacacgacacatcgagacgaacacagtacaactagtagggagttcggacgggacgcctggcgactcgtagaccgacggcggtaccgtatagttacgtgtcgcgtagtaggtacgtacggccggtacgttccggttcccgttttggaacccgttacgggttcggggggtcccttacgggggtaacctttccggtcgggttaccctacccggttccttccccg

SEQ ID NO: 100460 - DNA, 617 bp, Homo sapiens
  misc_feature: GYAE6OF01AD08H.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacagggcttgagtggatggggtgatcaacgtacagacgtggtggcacagactatgcacgaggggctccgagggcagactcacatcgaccacagacacatacagacgaacacagtacaacagtggagttggcgacgccgtgcgtatcgtgacgacggtcggaccgttatacgttacgtggttggaccggtagtacggttacggtaggtccgggtccgttccggtttcccgttttaggacccgtttaccgggttcggggggtaccccgttacgggggtaaacccttccggttaccgggtacccgtaacccggtttccgttaccccg

SEQ ID NO: 100461 - DNA, 406 bp, Homo sapiens
  misc_feature: GYAE6OF01ELKQW.12.25.C03.1.454.CMB.1.raw
  modified_base (401)..(406): a, c, t, g, unknown or other
  misc_feature (401)..(406): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcacgtctcctcagcctccaccaagggcccatcggtcttccccctggcgccctgctccaggagcacctccgagagcacagcggccctgggctgcctggtcaaggactacttcctacgtcgtatctgagcgggctggcaaggcgcatagnnnnnn

SEQ ID NO: 100462 - DNA, 515 bp, Homo sapiens
  misc_feature: GYAE6OF01ANFL9.12.25.C03.1.454.CMB.1.raw
  modified_base (493)..(493): a, c, t, g, unknown or other
  misc_feature (493)..(493): n is a, c, g, or t
  modified_base (509)..(509): a, c, t, g, unknown or other
  misc_feature (509)..(509): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgaggggctccgagggcagactcaccatgaccacagacacatcagcgaacacagtcaaacatggaagttgcggagcctgcgatcgtgaccgacgcggacctatattacgtgtgcgagagtacgagcgctcgtcttgactcgngggctgggactctgcncgtctc

SEQ ID NO: 100463 - DNA, 636 bp, Homo sapiens
  misc_feature: GYAE6OF01B6031.12.25.C03.1.454.CMB.1.raw
  modified_base (259)..(259): a, c, t, g, unknown or other
  misc_feature (259)..(259): n is a, c, g, or t
  modified_base (527)..(527): a, c, t, g, unknown or other
  misc_feature (527)..(527): n is a, c, g, or t
tcagatacgacgtacacgaccggtgctcgatttagtagtgtagatttgggtttgggacccaaaaaccacacccctccttgggagaatcccctagatcacagctcctcaccatggactgggcctggagccttcctttttcttggtggcagccgcaacaggtgcccactcccaggttcagctggtgcagtctggggctgagatgaagagccgtggggcctcagtaaaggtctctgcgaggcttcgtggttactacctttcnctaggtatactattgccgtggtgcgacgacggccctggacgaaggcttagaggtggagtgggggtgatacgaacgtacagacgtggtcggacacgacgaactagtcgacgaacggacgggggctaccggagggtacaagacctacgacctaagtcgaacccaacgaacgaacacgatacacgaacgaacacgtacgtacaaacacgtaggtagttcggacgggagccgtgcgagtcgaggaccgacggcgtaccgttatacgttacgngtgacgagtacggtacggtacgccggtcgttccggtttccgttagaccgttcgggtccgggtaccggttacgggtaccgttccggtggttcccgtcccggttcctcccg

SEQ ID NO: 100464 - DNA, 547 bp, Homo sapiens
  misc_feature: GYAE6OF01CPOAV.12.25.C03.1.454.CMB.1.raw
  modified_base (161)..(161): a, c, t, g, unknown or other
  misc_feature (161)..(161): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtncccactcccaggttcagctggtgcagtctggggctgagatgaagaagccgtggggcctcagtaaaggtctcctgcgaggtcttctggttactacctttctcaggtatactagttcgcgtgggtgcgacgacggccctggacgaagggtcttggagtggagtggggtggatacaacgtacagacgtggtggcacagactatgacacgaggggctacgagggcagactcaccatcgaccanagacacatcagacgaacacatacaaangtaggagtgacggngcctgcganctgacgcgcgcgtaatacttagtgcgagagagtacgagcgtctcgttcgttagacgttcggtcgggtctaggtaacttcgtggtcctccgtcgtccg

SEQ ID NO: 100465 - DNA, 653 bp, Homo sapiens
  misc_feature: GYAE6OF01B8J56.12.25.C03.1.454.CMB.1.raw
  modified_base (279)..(279): a, c, t, g, unknown or other
  misc_feature (279)..(279): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattcgctgggtncgacaggcccctggacaagggcttgagtggagtggggtggatcaacgtacaggactggtggcacaggactagtgcacgagggggctccgagggcagactcaccatcgaccacgagacacatcagcgaacacgacgtacaaactagtagggttgttggccgggaagtcccgtgacgtactcgtacggaaccggacgccggggtaccgttattaacgtttaccgttggtggaccggaggtaacggttaccggtaaggccgggtaccgttcccggtttacccgtttaggtaaccgtttaccggggtcgggggtaccccgttacggggggtaaacctttcgggttaccgggttacctacccccggttccttaccccgg

SEQ ID NO: 100466 - DNA, 407 bp, Homo sapiens
  misc_feature: GYAE6OF01B2FRI.12.25.C03.1.454.CMB.1.raw
  modified_base (403)..(407): a, c, t, g, unknown or other
  misc_feature (403)..(407): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtctccccctggcgccctgctccaggcgcacctcgagacgcacagccggccctgggctgcctggtcaaggctacttcctacgtcgtatctgacgcgggctggcaaggcgacatagnnnnn

SEQ ID NO: 100467 - DNA, 665 bp, Homo sapiens
  misc_feature: GYAE6OF01CYD29.12.25.C03.1.454.CMB.1.raw
  modified_base (346)..(346): a, c, t, g, unknown or other
  misc_feature (346)..(346): n is a, c, g, or t
  modified_base (392)..(392): a, c, t, g, unknown or other
  misc_feature (392)..(392): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttggagtggagtgggggtggatcgaacgtacagactggtggcanagactatgcacgaggggctccgagggcagactcaccatacgaccanacgacacatcaagaccaacacgaagtacaaactatagggtagttggcgggaagtcccgtaggacgtaattccgtaggaaccggaccgggaccggtacccgttaattaacgtttaccgttgggtacggaccggtaggaacggttaaccgggtacggccgggttaccgttcccggtttaccgttttaccggaaccgtttaccgggtccggggggtaccctttacgggggtaacccttcggttacgggttcccctaccccggttccttacccccgg

SEQ ID NO: 100468 - DNA, 675 bp, Homo sapiens
  misc_feature: GYAE6OF01EX88B.12.25.C03.1.454.CMB.1.raw
  modified_base (263)..(263): a, c, t, g, unknown or other
  misc_feature (263)..(263): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagccgtgggcctcagtaaaggtctcctgcgaggcttcgtggttacctaccttttcncgaggttatactattgccgtgggtgcgacgaggcccctggacgaagggtcttggaggtggagtggggtggatcgaaacggtacagtacgtgggtcggacacagactatgccgacgagggggcctaccggagggacacgactccacagtacgaaccaacacgaccaactactacgaagaccgaaaccaactaacgtaacaaacgtaggtacgggtaggttacggacgggtacgtcccgtagaccggtagtccgtaacgggaccgggacggcccgggtaaccgttaagttacgttacgtgtacggtcgtaagtacgggtacgtccggcggtaccgttccggttccgttacgacggttccgggtacgggacccgtacggtaccgttcgtacgggtcccttaccggtcccgtaccc

SEQ ID NO: 100469 - DNA, 478 bp, Homo sapiens
  misc_feature: GYAE6OF01C8UTP.12.25.C03.1.454.CMB.1.raw
  modified_base (458)..(478): a, c, t, g, unknown or other
  misc_feature (458)..(478): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtctttgactactggggcctgggaactctggtcaccgtctcctcagccctccaccaacgggcccatcggtccttccccctggccgccctgcctccgaggacgccaccgtccgagacgccacgacggccggcccgtggggcctcggccgttgggtaccgaaacgggtaccttaccgttcccgtacgtcgttattccgtggacgggcggggtctacgggacaacgggccgtcaagttgcnnnnnnnnnnnnnnnnnnnnn

SEQ ID NO: 100470 - DNA, 605 bp, Homo sapiens
  misc_feature: GYAE6OF01BSX5F.12.25.C03.1.454.CMB.1.raw
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctctgcgaggcttctggttacacctttctcaggtatactattgcctgggtgcgacaggcccctggacaagggcttgagtggatggggtgatcaacgtacagactggtggcacagactatgcacgaggggctcgagggcagactcaccatcgaccacgagacaacatcaagcgaaacncagtcaacatggagttgcggagccgngacagtcgtacggacgacggccggtacttaagtacgttactggtacgacggagtacggttaacggtcggaccggtaccggttccgtttccgtttaggtaccggttcgggttaccggggtaccggttacggggtaaccttcggttaccgggtacccttacccgggttcctacccgg

SEQ ID NO: 100471 - DNA, 426 bp, Homo sapiens
  misc_feature: GYAE6OF01A4A0K.12.25.C03.1.454.CMB.1.raw
  modified_base (408)..(408): a, c, t, g, unknown or other
  misc_feature (408)..(408): n is a, c, g, or t
  modified_base (414)..(426): a, c, t, g, unknown or other
  misc_feature (414)..(426): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactgggggcctgggaactctggtcaccgtctcctcagcctccaccaacgggccccatccggtccttcccccctgggccgccctgcctcccgaggcgcacctccgagacgcacagcggccctggggctgcctggtcaaggactactcctacgtcgtatctgagcggctggacaggcgnagtagnnnnnnnnnnnnn

SEQ ID NO: 100472 - DNA, 565 bp, Homo sapiens
  misc_feature: GYAE6OF01A6TQF.12.25.C03.1.454.CMB.1.raw
  modified_base (551)..(551): a, c, t, g, unknown or other
  misc_feature (551)..(551): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgaggtggatgggggtgatcaacgtacagacgtggtggcacgagactatgcacgaggggctccgagggcagactcacatcgaccacagacacatcagccgaacacgagtaccaaactagtgggaagttggacgggacgcccgtggaccgatcgtacggaccgacggccggtaccgttatacgttaccgtgtacgcggagacgtagtcgcgtcttcgtctttgacgttcggtcgggccgtaggacttcgnggcctccgtctccg

SEQ ID NO: 100473 - DNA, 529 bp, Homo sapiens
  misc_feature: GYAE6OF01E3AB4.12.25.C03.1.454.CMB.1.raw
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgaggggctccgagggcagactcacatcgaccacagacacatcagcgaacacagtacaacataggagttcggcggagcctgcgatcgtagacgacgcggccgtatacttatcgtgcgagagtcgagcggtctcggtccttgactcgtgggtccngggtacctgtggtcnccgtctccg

SEQ ID NO: 100474 - DNA, 462 bp, Homo sapiens
  misc_feature: GYAE6OF01A4Y6J.12.25.C03.1.454.CMB.1.raw
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (436)..(436): a, c, t, g, unknown or other
  misc_feature (436)..(436): n is a, c, g, or t
  modified_base (438)..(462): a, c, t, g, unknown or other
  misc_feature (438)..(462): n is a, c, g, or t
tcagatacgacgtacacgaccggtgctcgatttagtagtgtagatttgggtttgggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgacctactggggcctgggaactcgtggtccaccgtctcctcacgcctccacaaggcccatcgtcctccccnggcncctgctccaggcgcacctccgagacgcactagccggcccgtggggcctgccgttcgggtacaaacggtaccttacgtttcccgaacgttcgtatcgtagacgggtcgggacgtgggacaagggccgatacgtagntnnnnnnnnnnnnnnnnnnnnnnnnn

SEQ ID NO: 100475 - DNA, 746 bp, Homo sapiens
  misc_feature: GYAE6OF01DX5RV.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagccttccttttcttggtggcagccgcaacaggtgcccactcccaggttcagctggtgcagtcgtgggctgagatgaagagccgtgggcctacgaggtaacggtctctgcgaggtcttcgtggttacctacctttctacgtaggttatacttattcgccgttggtcgacgtacgaccggtcccgtaggaacgaaggtcttggaggtggaggtggggtagtacgtacgtaacgtacgagtacgtgggtacgacgaacgaagtacgtagtacggacgaacggacggggacctaccggagggactaacggacctaccgaaccgtaacgtaccgaaccaacgaacgaaccaccgtaacgaccgaacgaaccggaaacaacgtaaccgtaacaaacggtaaggttacggggtaagttacgggacgggtaccgtccgcgtacgtacgttccgtacggaccgaccgggtaccgttaacgttaacgttacgttacgtaggtacgtacggtaagtaccggttaacggtcggtaccgtccgtttaccgtttccgttacggtaccggttcgggtaccgggtaccggttacggtacttccggttacggtacccgttccggtcccttacccgg

SEQ ID NO: 100476 - DNA, 473 bp, Homo sapiens
  misc_feature: GYAE6OF01BSVCS.12.25.C03.1.454.CMB.1.raw
  modified_base (461)..(473): a, c, t, g, unknown or other
  misc_feature (461)..(473): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcgctcgtctttgactacgtgggcctggactcgtggtccaccgtctcctcacgcctccaccgaacgggccccagtccggtcccttccccccgtgggccgtccccgtgcctccgaggtacgccaccctccggagacgccacgacggcccggccccgtggggcctcggccgtgggtaccaaacggtaccttaccttcccgtacggttccgttaactcgtggacggcgggctgggacaagggccacagtgnnnnnnnnnnnnn

SEQ ID NO: 100477 - DNA, 512 bp, Homo sapiens
  misc_feature: GYAE6OF01DMESJ.12.25.C03.1.454.CMB.1.raw
  modified_base (469)..(469): a, c, t, g, unknown or other
  misc_feature (469)..(469): n is a, c, g, or t
  modified_base (472)..(512): a, c, t, g, unknown or other
  misc_feature (472)..(512): n is a, c, g, or t
tcagatacgacgtacacgaccggtgctcgatttagtagtgtagatttgggtttggggggaagaggaagactgacggtcctgccacagactatgcacaggggctccgagggcagactcaccatgaccacagacacatcagcgaacacagtcaacatggagttgcggagcctgcgatctgacgacgcggcgtatattactgtgcgagagtacgtagcggctcgtctttgactacgcgggcctgggactctggtcaccgtctcctcacgccctaccaaccgaacggtccctacgtccggttccttccccccgtggccctaccccttcctaccgaaagaccgcctacccgtcggtcggggccacgacggccggcccgtgggctcggccgtaggtaccgaagggtaccttacgtttccgtacgttaccgttaatcgtaggcggcgggtcgtagggaccgaaggctacgagtagntgnnnnnnnnnnnnnnnnnnnnnnnnnnnnnnnnnnnnnnnnn

SEQ ID NO: 100478 - DNA, 693 bp, Homo sapiens
  misc_feature: GYAE6OF01CPS20.12.25.C03.1.454.CMB.1.raw
tcagatacgacgtacacgaccggtgctcgatttagtagtgtagatttgggtttggggacccaaaaaaccacacccctccttgggagaatcccttagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactatcgcctgggtgcgacgacggccccgtggacaaggggtcttggaggtggagtgggggtagatacgaacgtacgagacgtggtcggcaacgagtaactagtcgacgaacggacggggtcctaccggagggcacgacgtccactagtaccgaccaacgacgacaacactacgaacgaacgaaccactacgtaccaaacagttagggaggttcggacgggactccgtaggcgtactcggtacgaccgggacggtccggacgttagttaacgttcgtggttaggaccggtagtacggttaccggtaggtcccggtacgtttcccggtttccgttttacggaacccggtttaccggggttaccggggccgtttaccgggggtaaaccttccgggtttaccggtaccccgtacccggttccctaccccgg

SEQ ID NO: 100479 - DNA, 589 bp, Homo sapiens
  misc_feature: GYAE6OF01D983K.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagccttcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacacggcccctggacaagggcttgagtggagtggggtgatcaacgtcagagtggtggcacagactatgcacgagggctccgagggcagactcaccatgaccacagacacgatcgacgacgaacacgagtacaacagtagggagttcggcgggacgtcccgtgacgtactcgtacggaccgacgggccggtccgttaattacgtttacgtggtggacgaggtaggtaccggtaggccggtcgttcggttcctttcgacttacgggtcgggtcctagggtactcgttcggtccaccggttcctacccg

SEQ ID NO: 100480 - DNA, 438 bp, Homo sapiens
  misc_feature: GYAE6OF01DX7VQ.12.25.C03.1.454.CMB.1.raw
  modified_base (324)..(324): a, c, t, g, unknown or other
  misc_feature (324)..(324): n is a, c, g, or t
  modified_base (418)..(418): a, c, t, g, unknown or other
  misc_feature (418)..(418): n is a, c, g, or t
  modified_base (424)..(438): a, c, t, g, unknown or other
  misc_feature (424)..(438): n is a, c, g, or t
tcagatacgacgtacacgaccggtgctcgatttagtagtgtagatttgggtttggggggaagagggaagactgacggtcctgccacagactatgcacaggggctccagggcagactcacccatgaccacagacacatcagcgaacacagtcaacatggagttgcggagcctgcgatctgacgacgcggccgtatattactgtgcgagagtacgtagcggctcgtcctttgactacgtgggcctgggaactctggtcaccgtctcctcagcctccacgaagggcccagtcggtccttccccctggccgccctgcctccgaggacnccacctcgagacgcacacggccggcccgtgggctcgccgtggtacaaggtacttacttccgtacgtcgtatctagaggcgggctggacaaggcncatagnnnnnnnnnnnnnnn

SEQ ID NO: 100481 - DNA, 623 bp, Homo sapiens
  misc_feature: GYAE6OF01DTAF2.12.25.C03.1.454.CMB.1.raw
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagagccgtggggcctcagtaaaggtctcctgcgaggcttctggttacacctttctctaggtatactattgcgtggtncgacacggccctggacaggcttgagtggagtggggtgatcgaacgtacagacgtgggtgcanagactatgcacgagggctacgaggcagactcacatcgaccacacgacacactcagaccgaacacacgtacaaactagtagggtagttcggacgggtagccccgtgaccgtatcgtacggaccggtacggaccggtaccgtattacgtttacgtggttcggacgtaggtacggttacggtacggtccggtcgttaccggttccgtttaggtaaccgttcgggtaccgggtccggttacgggtaacccgttcgttaccgggtacctacccggttccgtacccg

SEQ ID NO: 100482 - DNA, 734 bp, Homo sapiens
  misc_feature: GYAE6OF01CZA55.12.25.C03.1.454.CMB.1.raw
  modified_base (339)..(339): a, c, t, g, unknown or other
  misc_feature (339)..(339): n is a, c, g, or t
tcagatacgacgtacacgaccggtgctcgatttagtagtgtagatttgggtttgggacccaaaaaccacacccctccttgggagaatcccctagatcacagctcctcaccatggactgggcctggagccttcctttttcttggtggcagccgcaacaggtgcccactcccaggttcagctggtgcagtcgtggggctgagatagaagagccgtggggcctcgaagtaaggtctccgtgcgagggtctttcgttaggttacctaccttttcgtcgaggttatacttagttcgccgttgggtcgcgaacgcggacccgtggaaccgtaagggtctagaggnggtagtgggggtagatacgaacgtacgacggtacgtgggtacgacctacgaacggtacttaagtcggaaccgacggacgggggtacctaccgggaggggaccaacggtaccacctaccgaagaccgaaacccgaaccgaagaaccgttaacacgtacgaacgacgtaaaccgaactaacggaacaacgtaaggtacggtaagttcggacggaactcggtaccggcgtaacgtcgtaacgggacccgtaacggggccgttaaccttagttaaacgttccgtaggtcggaacgtaggtaacggttacggacggtccgtacgtaccgtttcgttaacgccggttacggtcgggggtacttacgggtacctacgttacggacccgttccgtccctaccg

SEQ ID NO: 100483 - DNA, 658 bp, Homo sapiens
  misc_feature: GYAE6OF01EA0SP.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttactaccttttctcaggtatactattgccgtgggtgcgacacggcccctggacaagggcttgaggtggagtgggggtggatcgaacgtacagacgtgggtggacacagactagtgcacggagggctaccgagggcagacctacacctagtacgaccacgacgacacatcagacaacacacgtacaacgtagtaggtagttcggacgggacgtcccgtgaccgtatcgtacggacggacggccggtaccgttaattacgttacgtggtacgacggaggtaacggtacggtaacgggccggtacgtttccccggttttacgtttaccggtaacgttaccggggtcggggggtacccgttacgggggtaacctttcccgggttacgggtacccgttcccgttcccgttaccccg

SEQ ID NO: 100484 - DNA, 713 bp, Homo sapiens
  misc_feature: GYAE6OF01EF7O8.12.25.C03.1.454.CMB.1.raw
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttactacctttctcaggtatactatgcctgggtgcgacgaggcccctggacaaggtcttgagtggagtggggtgatcgaacgtacagctggtggcacagactatcgcacggaggggctaccgaggggacagaccncaccagtacgacccanaacgacaactataccgaacggacgtaaaccaacgaacggttacccaaaacgtagttacgggtaaaggttcgggaccgggaacgttcccgtggaaccgtacgttcgttaacggaaccggaccggcccgggtaccgtttaactttaagttaccgttgggttacggaccggttaagggaacggtttaccgggtaacgggtcccggtaccgtttccggtttacccgttttagggaacccgtttacggggtcccggggtaacccgttacggggtaaccgttacgggttcccggttaacccggccccgttccgttacccccg

SEQ ID NO: 100485 - DNA, 676 bp, Homo sapiens
  misc_feature: GYAE6OF01D147M.12.25.C03.1.454.CMB.1.raw
  modified_base (359)..(359): a, c, t, g, unknown or other
  misc_feature (359)..(359): n is a, c, g, or t
tcagatacgacgtacacgaccggtgctcgattttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaggtctcctgcgaggtcttcgtggttactacctttctcaggtatactattcgccgtgggtcgacgacgacggccccgtggacgaaggcttagaggtggagtggggtggatacgaacgtacagacgtggtgcganagactagtgcacgaggggctaccgagggcgacgactacgaccagtacgaaccacaagaaccacactacacgacgaaccaacgacgtaaccaaagtacgtaggtaacggttcggaccgggacgtccgtcggacgtaccgtcgacggaacccggacggccgggtaaccgttacgttaacgtttacgtacggtacggacggtaggtacggttaaccgggtcggtaccggtcctttaccggttccgtttaggtaccggttcgggtccgggtcccggtacgggtaccgttcgttaccgggttacccgtaccgtccgtccccg

SEQ ID NO: 100486 - DNA, 587 bp, Homo sapiens
  misc_feature: GYAE6OF01ACLE8.12.25.C03.1.454.CMB.1.raw
  modified_base (350)..(350): a, c, t, g, unknown or other
  misc_feature (350)..(350): n is a, c, g, or t
  modified_base (499)..(499): a, c, t, g, unknown or other
  misc_feature (499)..(499): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (551)..(558): a, c, t, g, unknown or other
  misc_feature (551)..(558): n is a, c, g, or t
  modified_base (560)..(587): a, c, t, g, unknown or other
  misc_feature (560)..(587): n is a, c, g, or t
tcagatacgacgtacacgaccggtgctcgatttagtagtgtagatttggggtttgggggggaagaggaagactgacggtcctgccacagactatacacgaggggctccagggcagactcaccatgaccacagacacatcagcgaaacacagtcaaacatggagttggcggagcctgcgtatctgaccggacgcgggaccgtatactttacgtggtggacgaggagttacggtaggccgggtcttccggtttcctttcgacttacggcgggggtcctgggaacttcgtcggtcctaccgtcctcctcgacgtccctaccacgaacggccctacgtccgtcccttcccccgngcccgtcccgtcgtcctaccgaggaccgccctaacccgtccggagtacgacgaccgacggccgggtccccgtagggccgtaccgtccgggtacggaacgtaaccgggttaacctttcccttacccgtacggttcgtaactcgtacgggngggtccggcgttacgggaaccggtacggccgtaagtagcgtantnacgnctnnnnnnnngnnnnnnnnnnnnnnnnnnnnnnnnnnnn

SEQ ID NO: 100487 - DNA, 676 bp, Homo sapiens
  misc_feature: GYAE6OF01CZ2LC.12.25.C03.1.454.CMB.1.raw
tcagatacgacgtacacgaccggtgctcgatttagtagtgtagatttgggtttggggacccaaaaaccacacccctccttgggagaatccctagatcacagctcctcaccatggactgggcctggagcctccttttcttggtggcagccgcacaggtgcccactcccaggttcagctggtgcagtctggggctgagatgaagaagcctggggcctcagtaaaggtctcctgcgaggcttctggttacctacctttctcgtaggtatactattgtcctgggtgcgacgacggcccctaggacgaagggtcttagagtggagtggggtggatcgaacgtacgagaacgtggtggactacgagactagtcgacacggacggcgtccgagggcacgaccgtcaccgactacgacctacgacgacacactgacgactaacactacgaacaacgtatgggtagtcggacggacgccgtgcgatcgtacgaaccggacgtaccggtaccgtaagtttaccgttaacgttggttacggacgtagggtaacggttaaacggtacggccgggtacttcccgggtttacggtttacggtaaacggtttcccgggtacgggggtacccggttacccgggtaaccggtttccggagggttacccccgtccggttccccgttaaccccgg

SEQ ID NO: 100488 - DNA, 769 bp, Homo sapiens
  misc_feature: GYAE6OF01DTYIY.12.25.C03.1.454.CMB.1.raw
  modified_base (390)..(390): a, c, t, g, unknown or other
  misc_feature (390)..(390): n is a, c, g, or t
  modified_base (426)..(426): a, c, t, g, unknown or other
  misc_feature (426)..(426): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcccttcctttttcgttggtggcacgccgacaacaggtcgcccactcccaggttcagctggtgcagtcgtgggctgagatgaagagccgtgggcctcgagtaacgtctctgcgagtcttcgtagttacctacctttctcgtagtacttactagttcgtccgtgggtcgacgtacgacggtccccgtaggacgtaaggtcgtaggaggtggtaggtggggtagtactacgtaacgacgtaggtcgtggtgacacgtagtactanagactagtagtaacgtcgaagacagtactacactanacgaccacacgacacactaccgacgtacacaacgaccgtactacgtacggtagggacgtacggtaacgggacggtaccggtacgtaaggtacgtaaccgttaccgaacgggtaacccgaacgggttacccgggtaacgttcggttttaaacgttcgtaggtacgggtaccggttttaagggtttaacgttttaggtagttaaccgttttaaggtttcggttaaggggtttccgggtttaacggttacccgggttttaccggtttaacggttttccggtttttacccggggttttacccggtttacccccgggtacccggggttacccggggtaaccccggggg

SEQ ID NO: 100489 - DNA, 749 bp, Homo sapiens
  misc_feature: GYAE6OF01AGZ69.12.25.C03.1.454.CMB.1.raw
tcagatacgacgtacacgaccggtgctcgatttagtagtgtagatttgggtttggggacccaaaaaccacaccccctccttgggagaatcccctagatcacagctcctcaccatggactgggcctggagcccttcctttttcttggtggcagccgcaacaggtgcccactcccaggttcagctggtgcagtcgtggggctgagatgaagagccgtgggcctcgagtaaggtctcctgcgtaggtcttcgtggttacctacctttcgtacgaggtactacttagttcgccgtgggtcgccgacgaccggccccgtaggacgaagggtcttggaggtgggtaggttgggggtaggactaccgaaccggtaacgaggacggttgggtcggacacgaacgtactacgtcgaccgacgggacggggcctaccggacgggacgacgtacctaccaccgtacgtaccgaacccaacgacgaaccaactacgtaccgaacgaaccgaaaccacgtaacgaacctaacgaggttacgggtacggttacggaccggtcgtacccgtgaacgtacgttaccggtaggacccggtaccggtccggttacttaacgtttacgttacgtgggtacgtacggtacggtaggttacccggtagggtcccggttcgtttacccgtttcgttacggtaccgttccggggtcgggtacccggttacgggtacccttcggtacccggtccctcccggttcccgtacccg

SEQ ID NO: 100490 - DNA, 580 bp, Homo sapiens
  misc_feature: GYAE6OF01AC5U7.12.25.C03.1.454.CMB.1.raw
  modified_base (543)..(580): a, c, t, g, unknown or other
  misc_feature (543)..(580): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatgggagttggcggagcctgcgatctgacgcgcggccgtatattactgtgcgagagtacgtagcggctcgtctttgactacgtgggcctgggactctggtcaccgtctcctcacgccctaccaaccgtaacggggcccctagtccgggttccccttccccccgtcggggaccccgtcccccgtttgccccttacccgaacggggtaccgacccgtaccccgttcccggaagacggacccgaaccgcgggcccggtcccgtgggggtccctcggcccgttaggggtaccgaaacgggttacccttaccgtttcccgttaacggttccgttaactccggttagggaacgggtccggggtccgtgggtacccgaagggtccgagtaacgtaggnnnnnnnnnnnnnnnnnnnnnnnnnnnnnnnnnnnnnn

SEQ ID NO: 100491 - DNA, 726 bp, Homo sapiens
  misc_feature: GYAE6OF01DOOSE.12.25.C03.1.454.CMB.1.raw
  modified_base (393)..(393): a, c, t, g, unknown or other
  misc_feature (393)..(393): n is a, c, g, or t
  modified_base (530)..(530): a, c, t, g, unknown or other
  misc_feature (530)..(530): n is a, c, g, or t
tcagatacgacgtacacgaccggtgctcgatttagtagtgtagatttgggtttgggggacccaaaaaaccacacccctccttgggagaatcccctagatcacagctcctcaccatggactgggcctggagccttccttttcttggtggcagccgcaacaggtcgcccactcccaggttcagctggtgcagtcgtgggctgagatgaagaagccgtgggcctacgaggtaaaggtcctaccgtgcgagggtcttcgtacggttactacctttctacgtaggtatactagttcgcgttgggtagccgacgtaccggcccgtagacgaaggtcttggaggtggaggtggggtagtactacgtacgtaacgagtacgtggcgacaagacgactacgngacgacggtagggtccgtacggacggaccgaagtaccgaccgaacgtacgtacgaaccctagaacggacacgtactacgaacggaccgaaaactccgtaaagaccgtaaagtacgtaggtacgtacggaccgggacncccggtacgtattccgggacgaccgggtacccgtacggttaccgttaagttaccggtttccggtgttaaccgggccgtaagggtacgttacggacggtccggtacctttacggttcggttaccgtacgttaccgggtccggggtaccgtacccgggtcgtccgggtaccctaacccgtccttccgtctaaccccgg

SEQ ID NO: 100492 - DNA, 510 bp, Homo sapiens
  misc_feature: GYAE6OF01CL984.12.25.C03.1.454.CMB.1.raw
  modified_base (198)..(198): a, c, t, g, unknown or other
  misc_feature (198)..(198): n is a, c, g, or t
  modified_base (329)..(329): a, c, t, g, unknown or other
  misc_feature (329)..(329): n is a, c, g, or t
  modified_base (493)..(510): a, c, t, g, unknown or other
  misc_feature (493)..(510): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacagtggagttgcggagcctgcgatctgacgacgcgccgtatattacngtgcgagagtacgtagcggctcgtcctttgactgtgggcctgggactcgtggtcaccgtctctccacgtcctacccaccgaacggcctacgtccggttccctcccccgtggccgcccttgcctccgaggcnccctacccgccgaagcgccaaccgtcggcccgggtcccgtcggggtacctcgggtcctcggggttaccgaaacggttaaccctttcccgtttaccgttaacggttccgttaactccggttggaccgggtccggggtactcggaacgtaacgggccgacagtagnnnnnnnnnnnnnnnnnn

SEQ ID NO: 100493 - DNA, 756 bp, Homo sapiens
  misc_feature: GYAE6OF01COVNY.12.25.C03.1.454.CMB.1.raw
  modified_base (690)..(690): a, c, t, g, unknown or other
  misc_feature (690)..(690): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagccttcctttttcttggtggcagccgcaacaggtgcccactcccaggttcagctggtgcagtcgtgggctgagatagaagaagccgtgggcctacgagtaaaggtctcgtgcgaggtcttcgtcggttactacctttctacgaggttatacttattgcgtgggtgcgacgcggtcccgtaggaacgaagggtcttaggaggtggaggtggggtaggactacgaacgtacgaagtcggttaggcgacaacgaggtactagtcgaccgaggacggggtcacggaacgggctaacgactaccgactacgacgaaccaagaacgtacaactaagcgaaacgtaccgaaactaacgagaactaacgtggacgggtaaggtccgggagacggttaccgcgtaacgtacggttacgaacggacccgggtacgggtaacccggtaacgtttaacgtttaacgtttcgggaacttaggggaaccggtaggtaacccgggtttaaccgggcgttaaccccgggtttcctttaaccgggtttacccgttttacgggaccggtttaacccgggngggggtaaccccttaagggaccggttttccggtaccgtaccccggtccgttttacccgaccccggg

SEQ ID NO: 100494 - DNA, 636 bp, Homo sapiens
  misc_feature: GYAE6OF01A9YWV.12.25.C03.1.454.CMB.1.raw
  modified_base (359)..(359): a, c, t, g, unknown or other
  misc_feature (359)..(359): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttaccacctttctcaggtatactattgcctgggtgcgacacggcccctggacaagggcttgagtggagtggggtgatcgaacgtacagacgtggtggcacagactatgacacgnggggctcgagggcacgactcaccatcgaccacagacacactcgacgacgaaacacgtacgtacaaacgtagtaggtacgttcgggaccggtacggtcccgtggacccgtagtccgtacggaacccggtacgggccggtaccgttaagttacttacgtaggttcgacggtaggtttaggtttagtagtactttagtttagttggttaggttgggttcggtaccttgtaccgttttacggttttcggtaccccgaccggttcggggcccgtaaccgggg

SEQ ID NO: 100495 - DNA, 684 bp, Homo sapiens
  misc_feature: GYAE6OF01BV95E.12.25.C03.1.454.CMB.1.raw
tcagatacgacgtacacgaccggtgctcgatttagtagtgtagatttgggtttgggggacccaaaaaccacacccctccttgggagaatcccctagatcacagctcctcaccatggactgggcctggagcctccttttcttggtggcagccgacaacaggtgcccactcccgaggttcagctggtgcagtacgtggggctgagatgaagagccgtgggcctacgagtaaacggtctccgtgcgaggcttcgtggttacacctttctcgaggtactactagttggtccgtgggtcgccgacgaccggtaccctaggaacacgggtcttaggacggttgggacggtgggggtaggactacgtaacggtacgaggtacgtgggtacggacacgagactagcgacgacggacggggctaccggagggacacgacctacgaacctagtaccgacctacgacgacacgatacgacgaccgaacacgaacgacccgaagtacggtggtacggttcggaccggaacgtcgtagacgtcgtacgtacggaccgtacggccggtacctatacgttaccgtgtacgacggtacgtagtaccgggtacgccggtaccgttaccgttcggtttcgaccggttacggtccggggtaccgtcggtaacccgttcgtaccggtccgtacccgtcgtaccg

SEQ ID NO: 100496 - DNA, 680 bp, Homo sapiens
  misc_feature: GYAE6OF01CHVMM.12.25.C03.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
  modified_base (594)..(594): a, c, t, g, unknown or other
  misc_feature (594)..(594): n is a, c, g, or t
  modified_base (607)..(607): a, c, t, g, unknown or other
  misc_feature (607)..(607): n is a, c, g, or t
  modified_base (610)..(610): a, c, t, g, unknown or other
  misc_feature (610)..(610): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
  modified_base (635)..(635): a, c, t, g, unknown or other
  misc_feature (635)..(635): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
tcagatacgacgtacacgaccggtgctcgatttagtagtgtagatttgggtttggggggaagaggaagactgacggtcctgccacagactatgcacaggggctccgaggcagactcaccatgaccacagacacatcatcgaacacagtcaacatggagttgcgagcctgcgatctgacgacgcggtcgtatattacngtgcgagagtacgtagcggctcgtccttgactacgtgggctaggactcgtgcaccgtctcctcacgcctccaaccgacggcccagttccggttccttcccccgnggccctccccgtgtacctccggaaggaccgtcccgtaccgtccgggaacgaccgtaccgacgtaaccgggtcccgggtccccggttacggggtcccgtcgggttaccccggttacggggttaaacccggtaaaaccgggtacccgttttacccgttaaccccgtttaaccgggttccggtttaaactttcccgggttaacgggtaccggggtacccgggggtacggttaaccggggaccggtaaacccggggtaccgtacgtaaacggttacggtcacgtacgagtcgtacgntacgtcgactcgntcngcgagcgagtgngnngacgcgcacncgtcgtcgtcgtancncgtcgtacgacgtacacgagtgtcgcgtg

SEQ ID NO: 100497 - DNA, 709 bp, Homo sapiens
  misc_feature: GYAE6OF01E4YO1.12.25.C03.1.454.CMB.1.raw
  modified_base (257)..(257): a, c, t, g, unknown or other
  misc_feature (257)..(257): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagccttccttttcttggtggcagccgcaacaggtgcccactcccaggttcagctggtgcagtctggggctgagatgaagagccgtgggcctcagtaagtctcctgcgaggcttcgtggttacaccttttcncaggtatactattgccgtgggtcgcgacacggcccctggacaagggcttgaggtggagtggggagatcgaacgtacagacgtggtcggacacagactagtgaccgacgacggggtcctaccggagggctaacgaccgtaccaccgaactacggaacccaacgaacaccactactacgacgaccgaaaccacgacgtaccaaactagtaggtaggtttcggacgggtacgtccgtaggacgtacgtcgtacgggaccgaccgggtccgggttaaccttagtttacgttaacggttcggtacggaccggtaagggtaaccggttacggaacgggttccggtacccgtttccgggttttccgttacggtaaccggtttccggttaccgggggtacccggttacggggttaacccgttcggttaccgggtacccttccccgttcccgttaccccgg

SEQ ID NO: 100498 - DNA, 524 bp, Homo sapiens
  misc_feature: GYAE6OF01A2HBO.12.25.C03.1.454.CMB.1.raw
  modified_base (487)..(487): a, c, t, g, unknown or other
  misc_feature (487)..(487): n is a, c, g, or t
  modified_base (490)..(524): a, c, t, g, unknown or other
  misc_feature (490)..(524): n is a, c, g, or t
tcagatacgacgtacacgaccggtgctcgatttagtagtgtagatttgggtttgggggggaagaggaagactgacggtcctgccacagactatgcacaggggctccagggcagactcaccatgaccacagacacatcagcgaacacagtcaacatggagttgcgggagcctgcgatctgacgacgcggccgtatattactgtgcgagagtacgtgcggctcgtcctttgactacgtggggcctagggaactcgtggtcaccgtctcctcacgtccctccaccgaacgggccctatccgggtcccttccccccgtcgggcccgtccccgtggcctacccgagggaccgcctacccgtccggagacgccacgacggccggcccgttggggcctcggcccgtggtaccaagggtccctttaccgttccgtacgtcgttaatcggtacggacggccgggtcgtcggtaccgaacgggtcgacagtaggcancgnnnnnnnnnnnnnnnnnnnnnnnnnnnnnnnnnnn

SEQ ID NO: 100499 - DNA, 801 bp, Homo sapiens
  misc_feature: GYAE6OF01DEWN9.12.25.C03.1.454.CMB.1.raw
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtcgtggggctgagatagaagaacgccgtggggcctcgaagtaaaggtcctccgtgcgacggtcttcgtggttacctacctttctacgaggtatactagttcgccgtgggtcgacgaccgacggtcccctagggaaccgaaggggtcttggaggtgggaggttgggggtagtacgtaccgtaacgtacgacggacggtggtgggaccaacgtaagtaacgtatcggacgtaacggacggggtcctaccggaggaccacgtacctacaaccgtagtaccgacccaacgaacgtacaacgacttacgaacgtaaccgaaccaacgtaccgtaacaacgtagtagggtacgttcggacggtacgtccggtacgtacgtaccttacgtaccggaaccgggtacccggtaccggttaccgttaaagttttaccgttacgttacgggtacggtaacggtacgggtacggttaaccgggtacggtacccgggtttccgtttcccggtttaccgggtttacgggttaacccggtttacggggttacccggggtacccggttaacggggttacccgtttaccgggttaccggtttaccccggtaccgtttccccgttccccgg

SEQ ID NO: 100500 - DNA, 871 bp, Homo sapiens
  misc_feature: GYAE6OF01B4AQP.12.25.C03.1.454.CMB.1.raw
  modified_base (218)..(218): a, c, t, g, unknown or other
  misc_feature (218)..(218): n is a, c, g, or t
tcagatacgacgtacacgaccggtgctcgatttagtagtgtagatttgggttggggggaagaggaagactgacggtcctgccacagactatggcacaggggcgtcccaggcagactcacgatcgaccacagacacagtcacgcgaacacaagtcgaacatggacgttgcggagccctgccgtacttcctacgacggacgcggccgtattattactggngcgagagtacgtagcggcttcgttccgttacggactacgtggggcctggggtaacttcgtgggtacgtaccggttctcccttacgacgtccctaccgaacccgaaagggaccccaaggttacccgggttccccttaccccccgtagggtccccgtacccgttacggtacccgttaccggaaggggtaacgtacccgtaaccccggtttaacccggggaaaggttaaaccgggttaacccgaaaaccgggttaccccggggaccccgggttacccccgttaggggggtaaccctttccgggtaaccccggttaggggggttaacccggtaaaaacggggttaccccttttaacccggtttccccggttaaacggggttacccggtttaaaactttccgggtacggtaaaccgggtccccggggtaccgttaaccggaacccggtaacggggaccgtaaccggtaacgtacggtaccagtacgaccgtgtacgacgttctacgtttacaacttacgtacgtacgtacgtaaccagtaattacgaacgtttgtacgttaccgggacgttccgtaacggaccggtaagtaccgggaggtacgtaacctaacggacgtaaacgttccggtacgtaccgggtactaccggtacgtatcg

SEQ ID NO: 100501 - DNA, 716 bp, Homo sapiens
  misc_feature: GYAE6OF01AT5KD.12.25.C03.1.454.CMB.1.raw
tcagatacgacgtacacgaccggtgctcgatttagtagtgtagatttgggtttggggacccaaaaaccacacccctccttgggagaatccctagatcacagctcctcaccatggactgggcctggagccttccttttcttggtggcagccgcaacaggtgcccactcccaggttcagctggtgcagtcgtggggctgagatgaagagccgtggggcctcgagtaaaggtctccgtgcgaggcttcgtgttaccacctttctcaggtatactattgccgtgggtgccgacgacggcccgtggacaaggggtcttaggagttggaggtggggtggatacgaacgtacagcgtggtcgcagagactagtgacacgacggggtctaccggagggtcaacggtacctaccacagtacgaacccagaacgactacacgtacagacgaacacgtacgacaaacgagtaggacgttggaccggacggtccgtaggacggtacgttaccggtaggaacccggacgggtcccgggtaaccgtttaacgttaacgttttacggttacggttacgggacggtaacggtaacggttaacgggtacgggtccggttaccgtttccggtttccgttaacggtaccgttacggggttaccgggggttacccgttacgggggttaaccgttccgggttaccgggtacccgttaccccggttcccgttaccccg

SEQ ID NO: 100502 - DNA, 901 bp, Homo sapiens
  misc_feature: GYAE6OF01DNSMZ.12.25.C03.1.454.CMB.1.raw
  modified_base (323)..(323): a, c, t, g, unknown or other
  misc_feature (323)..(323): n is a, c, g, or t
  modified_base (464)..(464): a, c, t, g, unknown or other
  misc_feature (464)..(464): n is a, c, g, or t
tcagatacgacgtacacgaccggtgctcgatttagtagtgtagatttgggtttggggaacccaaaaaccacacccctccttgggagaactccctagatcacagcctcctcaccatggacgtcgggccgtgggacgtccctttccgttttttcgttggggtcggccgacgccggaccgaaacgtacgggtccgaccccctacctccccggtaagggttccaggtccgttggggtcgacgtacggtcggttcggggctgaaggtagaacggaaacggaccggtccggtacgggccttaacggtaaaggttaacggtccctaccgnggtacgtacggttcctttccgttacggttacccttacccgtttacgtccgttaaggttaccttagttcgttccggtccgggtagggtaccgacccggaccggccccggtccggtaaggtaaccggtagggtcgttacgggngggttagggtggggtacggggagtaccgtaaccggtaacgtacggtacggtcggtacgggacgaaccgtcggtaacgtacgtacgtacggaccgggacgggtaccgggttaccgacggggtacggtaacgaacccgttaaccgaccgtaaccgttaaggaccccgaaaaccccggttaggaacccaacccgttaaccggcgttaaacccggaccggaaaaccgttaccgaaccgtaaccgtaaccgtaacggtaaggttaccgggtacgggttaccggaaccggtccgtacggtccgaacgtaacggttcgaacggccgggacgtacgtacgttctacggtacgtcgacgtacggtagtaccgggtgtcggtcgtccgtacggtttcggtatcgggtcggtacgcggtcgtaccgtcgtaccgcccttgtccctacg

SEQ ID NO: 100503 - DNA, 779 bp, Homo sapiens
  misc_feature: GYAE6OF01BU5OQ.12.25.C03.1.454.CMB.1.raw
  modified_base (607)..(607): a, c, t, g, unknown or other
  misc_feature (607)..(607): n is a, c, g, or t
tcagatacgacgtacacgaccggtgctcgatttagtagtgtagatttgggtttggggacccaaaaaccacacccctccttgggagaatcccctagatcacagctccgtcaccatggacctgggcctggagcctccttttcttggtggcaggcccgcaaccaggtcgccccactcccgaggttcagctggtgcagtcgtggggctagagatgaagagccgtgggcctcgagtaaggtctcctgcgaggcttcgtcggttacctacctttctcaggttatactagttcgtccgtgggtgacgacgtacggtcccccgtagggacgaagggtcgttaggacggtgggtacggttggggggtagtacgttacctaaacggtaccgagtacggttgggtcggactaacgtacgtagttagtacgaccgtaccggaggggtcccaccggacgggtacaaccggtacctaccctaaccgtacggtaccgaacccgtaccgaacgaaccctaacgtacgtaaccgtaacggaacccggaaaccaaaccgtaacgtaaccaaaacccggagttaacgggtacgttaccgggacggtaccgaccgtacggaaccgtntaccggaacggaccgggaccgggcccggttaacgttacttacgtttacgcggtacgacgtacgtaacggtacggtcgtaccggttcccgttcgttaccggttagtacccggttcgggtaccgggtccggttacgggtaccttcgggtaccttaccggtcccgtaccgtcccg

SEQ ID NO: 100504 - DNA, 810 bp, Homo sapiens
  misc_feature: GYAE6OF01BSEJY.12.25.C03.1.454.CMB.1.raw
tcagatacgacgtacacgaccggtgctcgatttagtagtgtagatttgggtttgggacccaaaaaccacacccctccttgggagaatcccctagatcacagctcctcaccatggactgggcctggagccttcctttttcttggtggcagccgcaacgaggtcgcccactcccaggttcagcgtggtgcagtcgtggggctgagagtaggaaagaacgccgtggggcctacgtaaggtaaacggtcctccgtggacggtacggtcctttcgttacggttacccttaccttttccgtacgtaaggttaacttaacgttacgttcgtccgttgggtacgaccggaacgtacccgggtccccgtaggaaacggtaacggggtccgttaggaggttcgggtaagggttgggggtacggtaacgtaccgtaaacggtacgaacggtacggtcggggtacgacgtaacgtaggtaccgttagtacgaaccgtacggacggggtcctaccgggaacgggacaacgtacctaccgaaaccgtagtaacgaacccgaagaaacgtaccaacgttacgaacgtaaccggaaccgtaaaccaccgtaacgtaccgtaaagtcggtaggtaacggtcggacgtacgtccgtagacggtctacggtaccgaccggtacggaccggtaccgttaagttcgttaacgtggtacgaccggtaggtaaccgttcggaccggtcggtcccgttacgttaccgtttcggaccggtcgggttccgggtaccgttgggtaacctccggttagtacccgtgttcccgtacccg

SEQ ID NO: 100505 - DNA, 793 bp, Homo sapiens
  misc_feature: GYAE6OF01APEL9.12.25.C03.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
tcagatacgacgtacacgaccggtgctcgattttagtagtgtagatttgggtttggggacccaaaaaccacacccctccttgggagaatccctagatcacagctcctcaccatggactgggcctggacgcctttccttttttcgttgggtggcacggccggacaacgaggtcgcccactcccgaggttcagcttggtnacgtagtcgtgggctagagatagaagacgcgtcgggcctagaaggtaagtctcgtaggcgacggttcttcgttggttacctaccgtttntacgagttactacgtagttcggccgttgggcgaccgacgtaccggtcccgtaggaacgtacgggttcgtaggaggttggaacgggttggggtactacgtacgtaacgtacgacggttacggtgggtacggactacgaacggtacgtacggaccgtacgaacgggtcggggtacctcgggacgggacgtaacgtccgtaccgtaactaacggtacccgaaaccaacggtaagaaaccctaactaaccgaacgaaccgaaccgaaccgtaacgtaacgtacgtaagtaacggtaagggttacggtacggacggtacggtacgtcggtaaaaaacgtcgtacggtacggaccggacggtaccggttaacgttacgttacgttaccggttgtacgggtaacgtacggttaacggtacggtacggtccggttccgttccggtttacgttcggtacggtccggttcggtaccggttacgtaccggttcgtacgtccgttaccgtccctccgg

SEQ ID NO: 100506 - DNA, 834 bp, Homo sapiens
  misc_feature: GYAE6OF01AGNNL.12.25.C03.1.454.CMB.1.raw
tcagatacgacgtacacgaccggtgctcgatttagtagtgtagatttgggtttggggacccaaaaaaccacacccctccttgggagaatcccctagatcacagctcctcaccatggactgggcctggagccttcctttttcttggtggcagccgcaacaggtgcccactcccaggttcagctggtgcagtctggggctgagatgaagagccgtgggcctgagtaaggtctcgtgcgaggtcttcgtaggttacctcctttcgtacgtaggttattacttagttcgccgtgggtcgcgacgaccggtccccgtgaccgtaggtcttaggaggtggtagtggggtggactacgaacgtacacggtacgtgggtcggacaacgagtacgtatcggaccgtacgggtaccggggtccctaccgggagggtaccgaaccggtacctacccgaaccgtaacggtaccgaaaccccgtaaagaacggaaccctaacgtaacgtaaccgacgaaccgtaaacacgtacgtaacaaacgtcggtagtcggttacggacgtacgtcccgtagaccgtacttacggacggtaccggaccgttccgggtaaccttaacggtttacctttacgggtaacggtccggtaaaaccggtgggttaaaccccgtacgggggttacccggttaccggttacccccgggtttacccggtttaaccggttttccgggtaaaccccggttcggggggtttaccccgggggttaaacctttaaccccggggggtttacccgtttaccgggttaccccggtaaccccgtttaccccggttaccccggtttacccccg

SEQ ID NO: 100507 - DNA, 744 bp, Homo sapiens
  misc_feature: GYAE6OF01B2JBR.12.25.C03.1.454.CMB.1.raw
  modified_base (84)..(84): a, c, t, g, unknown or other
  misc_feature (84)..(84): n is a, c, g, or t
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (182)..(182): a, c, t, g, unknown or other
  misc_feature (182)..(182): n is a, c, g, or t
  modified_base (212)..(212): a, c, t, g, unknown or other
  misc_feature (212)..(212): n is a, c, g, or t
  modified_base (653)..(653): a, c, t, g, unknown or other
  misc_feature (653)..(653): n is a, c, g, or t
  modified_base (673)..(673): a, c, t, g, unknown or other
  misc_feature (673)..(673): n is a, c, g, or t
  modified_base (695)..(695): a, c, t, g, unknown or other
  misc_feature (695)..(695): n is a, c, g, or t
  modified_base (737)..(737): a, c, t, g, unknown or other
  misc_feature (737)..(737): n is a, c, g, or t
tcagatacgacgtacacgaccggtgctcgatttagtagtgtagatttgggtttgggggaagaggaagactgacggtcctgccanagactatgcacgagggctccaggcagactcaccatgaccanagacacntcagcgaacagagtacaactagtggagttgcggagccgtagcgtatccgngaccgacgccggtacgttattacgttacgnggttacgacggtaggaacggttacgtacggcgggtaccttccggttccgtttacggaccgttacgggtcgggtccttacggggtaacttcggtacggttacctacccgttcctaccgttcgaccgtcccgtaacccgaaccggtaaccggtacccgttacggttcccggttccccgttaccccgtcggtaccccgtcccgtcgtcccgtacggaaccggtccgtaacccgtacccgtaccggtaacgaccgtacccgaaccggtccggtcccggtacccggttcggtccgtaccggttaccggttaacggtaaccgtaaccggtacctttaccgtttacccgtacggttacgtaacgttcggtaccggtacggtccgggtacgtacggtacgaacggtccgagtacgcgtcgtgacgtacgcgtacgacgtagtacgtacngtacgcgagcgtctcgacgntacgacgtacgaccgtgttacncgtactcgacgtctcgcggtacgagcgtacgcgtagaactcngtgtacg

SEQ ID NO: 100508 - DNA, 1048 bp, Homo sapiens
  misc_feature: GYAE6OF01AZUIY.12.25.C03.1.454.CMB.1.raw
  modified_base (271)..(271): a, c, t, g, unknown or other
  misc_feature (271)..(271): n is a, c, g, or t
tcagatacgacgtacacgaccggtgctcgatttagtagtgtagatttgggtttggggacccaaaaccacacccctccttgggagaatcccctagatcacagctcctcaccatggactgggcctggagccttacctttttcttggtgggctagccgacaaccgaggtcgcccaacctccctaggttacgacgcttgggtcgcgtaacgtcgtagggggtacttcggagatggaaagacgccgtagggggcctacgtaaggtaacggtcctcncggacggtaggtaccttcgtacggtttaacctacctttactcgaaggtttactacgttattcggtaccgtagggaccgtacgtaccggcggaccccggttaggaaccggtaaggggtccttttacgggaaggttcgggtaacgggtcgggggttacgaaggttaaccctaacggtaaccggtagtacgggttacgggacccggtaacacggtaaacggtaccttacggtacggtacccgtaaaggggtacccggggttacccgaccgaacgggggtaaccttaaacccgggttaacgtacccccgtaaacccggttaggaacccccggttaaacccggaacccgggtaaacaaaccccggttaaccccgaagttttaacccgaacggttaaacccgaaaccggttaaaccgtaacggggtaaacaacccggtaaaaggttacggttacgggttaaaccgtacgggggtaacccgttaccgttacggtaaccgggttaacccgttccggtaaaccggtacccgggtaccgggttacccccgggttaaaccgttaacccggtttaaaccgttacccgggttaaagggttcccggtaaacgggttaacccgggtaacggttaaccgggttaccgggtacccgggtttaccggttaacccggttttaccggttaacggtttaccccgggttaacgggtaccccggggtacgttaaacccgggttccggttaccggtttaacccgggttaccccttaacccggggttcccttaacccccggg

SEQ ID NO: 100509 - DNA, 829 bp, Homo sapiens
  misc_feature: GYAE6OF01EE8DV.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcccttcctttttcgttgggtggcagcccgcaaacgaggtcgccccactccccgaggtttcagcgtggtgcaggtcgtggggctgagataggaagacgccgtgggcctacgtaaggtaaggtcctccgtggcggacgtctttcgtacggttacctacctttctacgtaggttattactagttcgtaccgttgggtgccgacgaccggtccccgtaggaacgaagggtctaggtacggtggtaggttggggggtagtaccgtacgtaaaccggtacgaacggtcggtagggtcggactacgacgtaacgttagcggacgaccgggacggggcctaccgggaaggggaccaacggtacctacccgaaccgtaacgtacgaaacccacgaacgtaaccaccgtaacaccgaacgtaccggaaaccacgtaactaaaccgaatacggtacgggtagttacggacgggtaacgtccgtacgacgtaccgtaacggtacggaccggtaccggtaccggtaccgtttaagttacggtttaagtcggtacgaacgggtacgtaaccggggttaacggtacggtccgggttaaccgttttccgggttacccgtttagggtacccggtttacccgggggtcgggttaaccccgggttaacggttacccggttacgggttaccggttacccgttccccggttcccgtaccccg

SEQ ID NO: 100510 - DNA, 903 bp, Homo sapiens
  misc_feature: GYAE6OF01AYEQ2.12.25.C03.1.454.CMB.1.raw
  modified_base (457)..(457): a, c, t, g, unknown or other
  misc_feature (457)..(457): n is a, c, g, or t
tcagatacgacgtacacgaccggtgctcgatttagtagtgtagatttgggtttgggacccaaaaaaccacacccctccttgggagaatcccctagatcacagctcctcaccatggactgggcctggagcattccttttcttggtgacagtagcaacgaggtgtccactcccgaggtgcatctggagcgagtcgtggagtctggaggtgaaggcggccgtacgggcctacgaaagttaaaaactctccgtagtacgtaacgttccttcgttacggttaccgactaccgtaccgtacccgtaccgtaagttacggtacgtacgtacggtcgttcggcttacgggaccgtaccggacccggtaccccggtagggaaccggttacggttaccgtttagggtaggttgggttacgtcggttacgtaagtcgggtacttaccgaacgttctttaaccgtttanaaggttacggaactacgtaaactaaaggttacggaacgggaacgtaacggttacccgtaacggacggacgtacgacgtaccgaacaccgttaccgaaccgtcggtaacgaaccgtaactaaccgtaacgaaaaccgaaactacgtaacgttacccgtaacgtaacgggtacgtacggggccgggtccgtacgggtaccgtacgtaccgggtaaaccgtaccggtaccccggtttacctacgttttaacggtacgtttaccgggtaattaaccccggggtttaaattttaaagtttttttaaaacccggttttgtttttaacgggttttcgttttaccggggggttagtttttcgggtttaggggttttacgtttaaccgtttaacggtttttaggttacggtttaacggtttaacccggggtttaacggggttaacccccgggggg

SEQ ID NO: 100511 - DNA, 745 bp, Homo sapiens
  misc_feature: GYAE6OF01A0QIW.12.25.C03.1.454.CMB.1.raw
  modified_base (660)..(660): a, c, t, g, unknown or other
  misc_feature (660)..(660): n is a, c, g, or t
  modified_base (668)..(668): a, c, t, g, unknown or other
  misc_feature (668)..(668): n is a, c, g, or t
  modified_base (674)..(674): a, c, t, g, unknown or other
  misc_feature (674)..(674): n is a, c, g, or t
  modified_base (683)..(683): a, c, t, g, unknown or other
  misc_feature (683)..(683): n is a, c, g, or t
  modified_base (690)..(690): a, c, t, g, unknown or other
  misc_feature (690)..(690): n is a, c, g, or t
  modified_base (693)..(694): a, c, t, g, unknown or other
  misc_feature (693)..(694): n is a, c, g, or t
  modified_base (715)..(715): a, c, t, g, unknown or other
  misc_feature (715)..(715): n is a, c, g, or t
  modified_base (719)..(719): a, c, t, g, unknown or other
  misc_feature (719)..(719): n is a, c, g, or t
  modified_base (736)..(736): a, c, t, g, unknown or other
  misc_feature (736)..(736): n is a, c, g, or t
tcagatacgacgtacacgaccggtgctcgatttagtagtgtagatttgggtttgggggaagaggaagactgacggtcctgccacagactatgcacgaggggctccaggacagacgtcaccgatcgaccacagacacatccacgagcacagcctacagtggagctggagagcctgagtatcgtagacgacgacggtccgttgttactacgtgtacggtacggtaaggttaggttttagtacgtaactttacgttttagttggtacggttcgggtacggttaccttggtacctttttacggttttcgggtacccgtaacccggtcgggaccgaaccgggtaccgtcgtcctacccgttcttcctacgacgttcccctaccgaaccgaaccgggtacctacggttacccggtcccctttaccccgcggtaccctaccccgtacctaacggaacgtaccgtaccgttccgggttacgggacgggaccgaacggtaccgggcccgggttcccgttacgggtacgtccggtacccgtacggggttaaccaccggggtttaaccctttacgggtaccgtcggttaccgtcccgggtttacgtcggttacggggaccggttccggggtacgttacggggaaccgaacggtaccgtattaagggcggtntacgactnagcgcncgagagagngagtctntannatctacgacgcgagtactacncgcncacacgtacatagtcgngtacgtacg

SEQ ID NO: 100512 - DNA, 415 bp, Homo sapiens
  misc_feature: GYAE6OF02FG8GR.12.25.C03.1.454.CMB.1.raw
  modified_base (406)..(415): a, c, t, g, unknown or other
  misc_feature (406)..(415): n is a, c, g, or t
tcagatacgacgtacacgaccggtgctcgatttagtagtgtagatttgggtttgggcacatgccaaggagacagccctcacgaagttattatgcaagctggtaccagcagaagccaggtcaggcccctgtccttgtcatctttgatgaaataaccggccttcagggtcccagaccgattctctggctccagctcaggaaacacagcttccttgaccatcactggggctcaggcggaagatgaggctgactatactgcaactcccgggacagcagtggtaaacatttcaatgtgttattcggcgagggaccaagctgaccgtcctcggtcagcccaaggctgccccctggtcactctgttcccacctcctctacgtcgtatctgagcgggctggcaaggcgcatagnnnnnnnnnn

SEQ ID NO: 100513 - DNA, 515 bp, Homo sapiens
  misc_feature: GYAE6OF02INCUH.12.25.C03.1.454.CMB.1.raw
  modified_base (462)..(462): a, c, t, g, unknown or other
  misc_feature (462)..(462): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccgagggcagactcaccatgaccacagacacatcagcgaaacacaagtcaaacatggagttgcggagcctgacatgcgacgacgcggactatacttactgtgngagagtagagcgctcgtcttagctgcggtcgtaggactgngtcnccgtctccg

SEQ ID NO: 100514 - DNA, 408 bp, Homo sapiens
  misc_feature: GYAE6OF02GK1AQ.12.25.C03.1.454.CMB.1.raw
  modified_base (402)..(408): a, c, t, g, unknown or other
  misc_feature (402)..(408): n is a, c, g, or t
tcagatacgacgtacacgaccggtgctcgatttagtagtgtagatttgggtttgggggaagaggaagactgacggtcctgccacagactatgcacaggggctccagggcagactcacccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggcaccctcctccaagagcacctctgggggcacagcggccctgggctgcctggtcaaggactacttcctacgtcgtatctgagcgggctggcaaggcgcatagnnnnnnn

SEQ ID NO: 100515 - DNA, 409 bp, Homo sapiens
  misc_feature: GYAE6OF02H0ZRH.12.25.C03.1.454.CMB.1.raw
  modified_base (401)..(409): a, c, t, g, unknown or other
  misc_feature (401)..(409): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggcgccctgctccaggagcacctccgagagcacagcggcctgggctgcctggtcaaggactacttcctacgtcgtatctgagcgggctggcaaggcgcatagnnnnnnnnn

SEQ ID NO: 100516 - DNA, 410 bp, Homo sapiens
  misc_feature: GYAE6OF02H0QAI.12.25.C03.1.454.CMB.1.raw
  modified_base (404)..(410): a, c, t, g, unknown or other
  misc_feature (404)..(410): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaaggccccatcggtcttcccctggcgccctgcctccaggagcaccctccgagacgcacagcggccctgggctgcctggtcaaggactacttcctacgtcgtatctgagcgggctggcaaggcgcatagnnnnnnn

SEQ ID NO: 100517 - DNA, 406 bp, Homo sapiens
  misc_feature: GYAE6OF02GSERM.12.25.C03.1.454.CMB.1.raw
  modified_base (402)..(406): a, c, t, g, unknown or other
  misc_feature (402)..(406): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttcccctggcgccctgctccaggagcacctccgagacgcacagcggccctgggctgcctggtcaaggactacttcctacgtcgtatctgagcgggctggcaaggcgcatagnnnnn

SEQ ID NO: 100518 - DNA, 406 bp, Homo sapiens
  misc_feature: GYAE6OF02I2CYW.12.25.C03.1.454.CMB.1.raw
  modified_base (314)..(314): a, c, t, g, unknown or other
  misc_feature (314)..(314): n is a, c, g, or t
  modified_base (401)..(406): a, c, t, g, unknown or other
  misc_feature (401)..(406): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttcccctggcgccctgctccaggngcacctccgagagcacagccggcctgggctgcctggtcaaggactacttcctacgtcgtatctgagcgggctggcaaggcgcatagnnnnnn

SEQ ID NO: 100519 - DNA, 517 bp, Homo sapiens
  misc_feature: GYAE6OF02FYUWA.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagcagcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatgggggtgatcaacgtacagactggtggcacagactatgcacgagggctccgagggcagactcaccatcgaccacagacacatcagcgaacacagtcaacatggagttgcggagcctgcgatctgacgacgcggccgtatattactgtgcgagagtacgagcggctcgtccttgactacgtgggcctgggacctcgtggtcaccgtc

SEQ ID NO: 100520 - DNA, 557 bp, Homo sapiens
  misc_feature: GYAE6OF02G8GKS.12.25.C03.1.454.CMB.1.raw
  modified_base (219)..(219): a, c, t, g, unknown or other
  misc_feature (219)..(219): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagatacgacgtacacgaccggtgctcgatttagtagtgtagatttgggtttggggacccaaaaaccgacacccctccttgggagaatcccctagatcacagctcctcaccatggactgggcctggagcctcctttttcttggtggcagccgcaacaggtgcccactcccaggttcagctggtgcagtctggggctgagatgaagagcctggggcctnagtaaaggtctcctgcgaggcttctggttacacctttcncaggtatactattgcctgggtncgacnggcccctggacaagggcttgagtggatggggtggatcaacgtacagacgtggtggcacagactatgcacgagggggtctccgagggcaggactcacatcgaccacagacacatacagacgaacacagtcaacatggagttggcgagcctgacgatcgtgacgacgtcggtaccgtatacttacgtgtgcgagtacgtacgtagcggtcgtacgtccgtttagaccgtaggtcgggcctagggtaacctcgttcggtccgtaccgtcttaccg

SEQ ID NO: 100521 - DNA, 615 bp, Homo sapiens
  misc_feature: GYAE6OF02G2ZW0.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttggagtggagtggggtggatcgaacgtacagactggtggcacagactatgcagaggggctccgagggcagactcacatgaccatagacacatcagacaacacacgtacaacagtggagttgcggagtccgtgacgagtcgtaggaccggtaccgcgggacccgttattacttacgtggttacggcgtaagaacgggttacgtacggtccgggtccgttcccggtttccttttacggactttaccgggttcgggggtaccgttacgggggtaaccttccggttacgggttacccgtacccggttccgttacccg

SEQ ID NO: 100522 - DNA, 553 bp, Homo sapiens
  misc_feature: GYAE6OF02H3DUM.12.25.C03.1.454.CMB.1.raw
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctggtgcgacaggcccctggacaagggcttgagtggatggggtggatcgaacgtacagactggtggcacagactatgcacaggggctccgagggcagactcacatgacacagacacatcagcgaacacagtacaaacagtggtgttggcggagcctgcgatcgtgaaccgacggcggaccgtatattactgttcgacgagagttacgagcggcttcggttccttttggacttacggtcgggtaccctggggaacctcgttggtacctaccggtctcccg

SEQ ID NO: 100523 - DNA, 528 bp, Homo sapiens
  misc_feature: GYAE6OF02IY8Z1.12.25.C03.1.454.CMB.1.raw
  modified_base (168)..(168): a, c, t, g, unknown or other
  misc_feature (168)..(168): n is a, c, g, or t
  modified_base (392)..(392): a, c, t, g, unknown or other
  misc_feature (392)..(392): n is a, c, g, or t
  modified_base (514)..(514): a, c, t, g, unknown or other
  misc_feature (514)..(514): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggggggggggtncccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgaggggctccgagggcagactcacatgaccanagacacatcagcgaacacagtcaacagtggagttgcggagcctgcgatctgacgacgcggccgtatacttactgtgcgagagtacgtagcggctcgtccttgactacgtgggctgggactgnggtcaccgtctccg

SEQ ID NO: 100524 - DNA, 533 bp, Homo sapiens
  misc_feature: GYAE6OF02F6BAT.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgaggggctccgagggcaggactcaccatcgaccacagacacatcagacgaacacagtcaacataggagttggcggtagcctgcgatcgtgacggacgcggccgtatattacgtgtgcgagagtacgtagcgctcggtcttgacgtacgtgggcctgggactcgtggtcctaccgtctcccg

SEQ ID NO: 100525 - DNA, 515 bp, Homo sapiens
  misc_feature: GYAE6OF02JR5OP.12.25.C03.1.454.CMB.1.raw
  modified_base (201)..(201): a, c, t, g, unknown or other
  misc_feature (201)..(201): n is a, c, g, or t
  modified_base (271)..(271): a, c, t, g, unknown or other
  misc_feature (271)..(271): n is a, c, g, or t
  modified_base (486)..(486): a, c, t, g, unknown or other
  misc_feature (486)..(486): n is a, c, g, or t
  modified_base (490)..(515): a, c, t, g, unknown or other
  misc_feature (490)..(515): n is a, c, g, or t
tcagatacgacgtacacgaccggtgctcgatttagtagtgtagatttgggtttggggggaaggaggaaggactgacggtcctgccacagactatgcacaggggctccagggcagactcaccatgaccacagacacatcagcgaacacagtcaacatggagttgcggagcctgcgatctggacgacgcggccgtatattacnggtgcgagagtacgtaggcggctcgtcctttgaccttcgtggggcctgggaactctggcaccgtctcctnacgcctccaccgaacgggccccagtccggtccttcccccgtaggccgtccccgtgtacctcccgaagggccgccctacccgtccggagacgccgtaccgacggccggccccgttcggggcttccggcccgtggggtccaaaacggtcgttaacctttccgacggtcgtaaatccgtagacggcgggtcgtcggaccgaaggccgacgatagcagntcgnnnnnnnnnnnnnnnnnnnnnnnnnn

SEQ ID NO: 100526 - DNA, 521 bp, Homo sapiens
  misc_feature: GYAE6OF02GAKO8.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagcagcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacagggctccgagggcagactcacatgaccacagacacatcagcgaacacagtcaacatggagttgcggagcctgcgatctgacgacgcggccgtatattactgtcgcgagagtacgtagcggctcgtcctttgacttacgtggggcctgggaacctcgtggtccaccgtc

SEQ ID NO: 100527 - DNA, 424 bp, Homo sapiens
  misc_feature: GYAE6OF02I435D.12.25.C03.1.454.CMB.1.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
  modified_base (413)..(424): a, c, t, g, unknown or other
  misc_feature (413)..(424): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactntggtcaccgtctcctcagcctccaccaagggcccatcggtcttcccctggccnccctgctccaggacgcacctccgagacgcacagccggccctgggctgcctggtcaaggctacttcctacgtcgtatctgacgcgggtctgggaccaagggccgacagtagnnnnnnnnnnnn

SEQ ID NO: 100528 - DNA, 408 bp, Homo sapiens
  misc_feature: GYAE6OF02FSTOW.12.25.C03.1.454.CMB.1.raw
  modified_base (401)..(408): a, c, t, g, unknown or other
  misc_feature (401)..(408): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggcgccctgctccaggagcacctccgagagcacagcggccctgggctgcctggtcaaggctacttccacgtcgtatctgacgcgggctggcaaggcgcatagnnnnnnnn

SEQ ID NO: 100529 - DNA, 824 bp, Homo sapiens
  misc_feature: GYAE6OF02J3O6B.12.25.C03.1.454.CMB.1.raw
  modified_base (714)..(714): a, c, t, g, unknown or other
  misc_feature (714)..(714): n is a, c, g, or t
  modified_base (802)..(802): a, c, t, g, unknown or other
  misc_feature (802)..(802): n is a, c, g, or t
tcagatacgacgtacacgaccggtgctcgatttagtagtgtagatttgggtttggggacccaaaaaccaccacccctccttgggagaactcccctagatcacagctcctcaccatggacgtcgggcctggacgtccctttcctttttcgttgggtcggccacggcccgacaacgcggtccgcccacctcccgaggttcagtcgtgggtcgactaggtcggtcggggtctagaagtagtaggaaacggaccggtccgggtaccggggtacctaacggtaaacggttaaccggttcctaccggtcggtaccgggtacggttcctttaccggttaccggttacccttaccgttacgtacggttaacggttacttaccgttcggtccggtcgggttcggaccgaccggtaccggcccggtaccggtaggtaaccgggtggttcggttagggtacgggtagggtaggttacgggacgtactaacggtaacggtaggtacgtcgggtacggtacgactaacggtactaacggtcgaccggtacgggaccgggtccggaccgacggacggacctaccggacctaccgaacgaccgaccgaaccacgacgaccacgtacgaccgacgaacaacgtaactaggacctaggtacgtcggtaccgcgtacgccgttacgacgtacgccggtacgaccgtaccggacggttactattaccgtacgngacgtacgcgtacgtcggtctccgggtccttacgggttacctccgggtacgcgggtccggtacggcttaccgtccggtaccggttccnccccggttacctccggaaccgg

SEQ ID NO: 100530 - DNA, 408 bp, Homo sapiens
  misc_feature: GYAE6OF02GYRX0.12.25.C03.1.454.CMB.1.raw
  modified_base (399)..(408): a, c, t, g, unknown or other
  misc_feature (399)..(408): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaaggcccatcggtcttccccctggccgccctgctccaggagcacctccgagagcacagccggcctgggctgcctggtcaaggctacttcctacgtctatctgagcggctggcaaggcgcatagnnnnnnnnnn

SEQ ID NO: 100531 - DNA, 672 bp, Homo sapiens
  misc_feature: GYAE6OF02J2WT2.12.25.C03.1.454.CMB.1.raw
  modified_base (288)..(288): a, c, t, g, unknown or other
  misc_feature (288)..(288): n is a, c, g, or t
  modified_base (601)..(601): a, c, t, g, unknown or other
  misc_feature (601)..(601): n is a, c, g, or t
tcagatacgacgtacacgaccggtgctcgatttagtagtgtagatttgggtttggggtacccgaaaaaccaacacccctccttgggagaatccctagatcacagctcctcaccatggactgggcctggagcctccttttcttggtggcagccgcaacaggtgcccactcccaggttcagctggtgcagtcgtggggctgagatgaagagccgtggggcctcagtaaaggtctccgtgcggaggctttcgtggttacaccgtttctcaggtatactattcgcctgggtncgacgtacggcccctggacgaagggtcttggagtgggtatgggggtgacgtcgaacgtacgaggacgtggtaggccagacgactatcgacacggagggggcctaccggacggggctacggtaactccgaaccgacgtacgaacccgacgaacggaaccctacgactaccgaacgtaccgaaaccgtaacgaccggttaacaaaccgttaaggtacggggtaaagttcggacgggaacgtcccgttagggaccgtatcgtacggaacggccgggccgtaccgtatacgttacgtgttcggacgagtagtacggngtcggtacctttcggtccgtttcacgtaccggttcgggctacgggactcggttgaccgtccggtctacccg

SEQ ID NO: 100532 - DNA, 484 bp, Homo sapiens
  misc_feature: GYAE6OF02GD90H.12.25.C03.1.454.CMB.1.raw
  modified_base (464)..(484): a, c, t, g, unknown or other
  misc_feature (464)..(484): n is a, c, g, or t
tcagatacgacgtacacgaccggtgctcgatttagtagtgtagatttgggtttggggggaagaggaagactgacggtcctgccacagactatgcacaggggctccagggcatactcaccatgaccacagacacatcagcgaacacagtcaacatggagttgcggagcctgcgatctgacgacgcggccgtatattactgtgcgagagtacgtagcggctcgtcctttgactacgtggggcctgggaactctggtcaccgtctccctcagcctccaccgaacgggccccatccggtccttcccccgtggccgccctgcctccgagggacgccaccctccggagacgccaacgaggccggccccgtggggcctgcccgttggtccaaagggtaccttaccgttcctaacggttctacgttccgtaggcggccggggtcgtcgggacgaaacgggccgacacgtagnnnnnnnnnnnnnnnnnnnnn

SEQ ID NO: 100533 - DNA, 591 bp, Homo sapiens
  misc_feature: GYAE6OF02G2BYQ.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtgatcaacgtacagactggtggcacgagactatgcacgaggggctcgagggcagactcacatcgaccacagacacatcagacgaacacagtacaacagtaggagttgcggagccgtgacgatcgtacggaccgaccggaccggtaccgttaatacgttacgtggtcgacggaagtacggtacggtacggccggtccgttccggttccgtttacggaccgttacggtcggggtccgttacgggtaccttcggtcggtaccgtacccgttcctacccg

SEQ ID NO: 100534 - DNA, 437 bp, Homo sapiens
  misc_feature: GYAE6OF02G38NN.12.25.C03.1.454.CMB.1.raw
  modified_base (418)..(437): a, c, t, g, unknown or other
  misc_feature (418)..(437): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttccccctggccgccctgcctccgaggacgccaccctccgagacgcacagccggccctgggcctgcctgggtcaagggtctacttcctacgtcgtatcgtgacgcgggctgggcaaggcgacagtagnnnnnnnnnnnnnnnnnnnn

SEQ ID NO: 100535 - DNA, 570 bp, Homo sapiens
  misc_feature: GYAE6OF02I0VW7.12.25.C03.1.454.CMB.1.raw
  modified_base (379)..(379): a, c, t, g, unknown or other
  misc_feature (379)..(379): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtgatcaacgtacagactggtggcacagactatgcacgaggggctccgagggcagactcaccancgacacagacacatcagacgaacacagtacaacataggagttggcggagcctgcgatctacggacgacgccggccgtatattacgtgtcgcgaggtagtacgtaggcggtcttccggttccgtttcgaaccgtacgttcggggtccgttacgggtaccgttccggtacggtcccgtacccggtcctacccg

SEQ ID NO: 100536 - DNA, 409 bp, Homo sapiens
  misc_feature: GYAE6OF02JDYB8.12.25.C03.1.454.CMB.1.raw
  modified_base (314)..(314): a, c, t, g, unknown or other
  misc_feature (314)..(314): n is a, c, g, or t
  modified_base (401)..(409): a, c, t, g, unknown or other
  misc_feature (401)..(409): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggactctggtcaccgtctcctcagcctccaccaagggcccatcggtcttccccctggcgccctgctccaggngcacctccgagagcacagcggccctggactgcctggtcaaggctacttcctacgtcgtatctgagcgggctggcaaggcgcagtagnnnnnnnnn

SEQ ID NO: 100537 - DNA, 537 bp, Homo sapiens
  misc_feature: GYAE6OF02F86U2.12.25.C03.1.454.CMB.1.raw
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacagggggctccgagggcagactcacatgaccacagacacatcagcgaacacgagacaacagtggagttgcggagtcctgcgatctggacgacgcggaccgtatacttacgtgtgcgagagtacgagcgcgtcgtcttgactacgtcgggccgtagggtacctccgtggtcctaccgtctacccg

SEQ ID NO: 100538 - DNA, 531 bp, Homo sapiens
  misc_feature: GYAE6OF02GZ15X.12.25.C03.1.454.CMB.1.raw
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
  modified_base (524)..(524): a, c, t, g, unknown or other
  misc_feature (524)..(524): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacgaggggctccgagggcagactcacatgaccacagacacatcagacgaacacagtacaacagtggagttggcggagcctgcgatcncgacggacgcggacgtatattactgtgngagagtacgtagcgtctcgtctatttcgactacgtggggccttgggacctcgtggtcnccgttcc

SEQ ID NO: 100539 - DNA, 550 bp, Homo sapiens
  misc_feature: GYAE6OF02FP7L2.12.25.C03.1.454.CMB.1.raw
  modified_base (475)..(475): a, c, t, g, unknown or other
  misc_feature (475)..(475): n is a, c, g, or t
tcagatacgacgtacacgaccggtgctcgatttagtagtgtagatttgggtttggggacccgaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggagtggggtggatcgaacgtacagactgggtggcgacagactagtgcacgaggggctccgagggcagactcacatcgaccacagacacatcgacgacgaacacagtacaaacagtaggacgttgacggagcctgcgatcagaccgacgcgaccgtatacgttacgngtcgacgagacgtacgtcgtcgcctcggttcttgactcggtcgggcctgggaccttcgtggtcctaccgtctccg

SEQ ID NO: 100540 - DNA, 412 bp, Homo sapiens
  misc_feature: GYAE6OF02IKHXP.12.25.C03.1.454.CMB.1.raw
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
  modified_base (398)..(412): a, c, t, g, unknown or other
  misc_feature (398)..(412): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggactctggtcaccgtctcctcagcctccaccaaggcccatcggtctcccctgcgccctgctccaggngcacctcgagagcacagcggccctgggctcgccgtggtcaaggactacttcctacgtcgtatctgagcggctgggcaaggcgnatagnnnnnnnnnnnnnnn

SEQ ID NO: 100541 - DNA, 633 bp, Homo sapiens
  misc_feature: GYAE6OF02G9Y3J.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttggagtggatgggggtggatcaacgtacagactgggtggcacagactatgcacgaggggctccgaggggcagactcaccatcgaccacagacacatcagacgaacacgacgtacaacagtaggagttggcggacgtccgtggcgattcgtacgacgaccggccgggtaccgttaagttacgtttaacgttgtacggacggtaaggtaacggtacggtacgggtccgggtccttccgggtttcctttacggtaaccgttaccgggttcgggggtacccgttacgggggttaaccttccggttacgggtacccgtaccggttccttacccccg

SEQ ID NO: 100542 - DNA, 448 bp, Homo sapiens
  misc_feature: GYAE6OF02I3D2E.12.25.C03.1.454.CMB.1.raw
  modified_base (414)..(414): a, c, t, g, unknown or other
  misc_feature (414)..(414): n is a, c, g, or t
  modified_base (416)..(448): a, c, t, g, unknown or other
  misc_feature (416)..(448): n is a, c, g, or t
tcagatacgacgtacacgaccggtgctcgatttagtagtgtagatttgggtttggggggaaggaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctgtcctttgactactggggcctgggaactctggtcaccggtctccctcagccctcaaccaagggccccatcggtccttcccctggaccgccctgcctcccaggtacgcacctccgagagcacgagcggccctgggctgcctggcaaggactacttctacgcgtatctgagcgggctggcaaggcgtcataggcancnnnnnnnnnnnnnnnnnnnnnnnnnnnnnnnnn

SEQ ID NO: 100543 - DNA, 605 bp, Homo sapiens
  misc_feature: GYAE6OF02GP0BA.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacacggcccctggacaagggcttgagtggagtggggtggatcaacgtacagacgtggtggcacagactatgcacgaggggctcgagggcagactcacatcgaccacagacacatcagacgaacacagtacaacagtaggagttcgacggacgccgtagcgatcgtacgaccggacggccggtaccgttatacgtttacgtgtcggacggagtaacggttacgtacggtccggtaccgttccggttccgtttacgtaaccgttcggtcggggtacccgttagggtaaccgtccggttacggtacccgtaccggttccttacccg

SEQ ID NO: 100544 - DNA, 538 bp, Homo sapiens
  misc_feature: GYAE6OF02GQEG5.12.25.C03.1.454.CMB.1.raw
  modified_base (418)..(418): a, c, t, g, unknown or other
  misc_feature (418)..(418): n is a, c, g, or t
  modified_base (468)..(468): a, c, t, g, unknown or other
  misc_feature (468)..(468): n is a, c, g, or t
  modified_base (504)..(504): a, c, t, g, unknown or other
  misc_feature (504)..(504): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctgggggcctcagtaaaggtctcctgcgaggcttctggttacacctttctcaggtatactattgcctgggtgcgacacggcccctggacaagggcttgagtggatggggtggatcaacgtacagactgggtgcacagactatgcacgaggggctccgagggcagactcaccatgaccaacagacacatcagcgaacacagtacaaacntggagttgcggagcctgcgatcgtgaccgacggcggcgttatacttatgngcgagtagtacgtagcggtctcgttcttgactacgngggtccgtaggacttcgtggcctaccgtcctccg

SEQ ID NO: 100545 - DNA, 703 bp, Homo sapiens
  misc_feature: GYAE6OF02FF3CJ.12.25.C03.1.454.CMB.1.raw
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (500)..(500): a, c, t, g, unknown or other
  misc_feature (500)..(500): n is a, c, g, or t
  modified_base (592)..(592): a, c, t, g, unknown or other
  misc_feature (592)..(592): n is a, c, g, or t
tcagatacgacgtacacgaccggtgctcgatttagtagtgtagatttgggtttggggacccgaaaaaccacacccctccttgggagaatcccctagatcacagctcctcaccatggactgggcctggagcctccttttcttggtggcagccgcaacaggtgcccactcccaggttccaggctggtgcagtctggggctgagagtgaagaagccgtggggcctnagtaaacggtctcctagcgaggcttacgtggttacctaccgttcncaggtatacctattgccgtgggtcgcgtacgacggtccccnggaccgaagggcttagagttggagtggggtgatcgaacgtcagtacgtggtggacacgagtaactgtcgactacggacggggtcctaccggacggggtcacggtaccctacgaacccgagtaccggaacctaaccgacgtacccaacgttagaccgtaacggacgaaaccgactaaccggtcctaaaacgngttacggggtaacgttcgaccgggtacgtccgtaggaccgttactcgtaccggaacccgtaccgtccggacgtttaacgtagtttaaccggnggttaccgaccgaaggtcggtttaccgacgtcgaccttcggttacgttacacccggttaagtcccgggtacgtacggtaacctcggttacgacccgttccgaccttcccgg

SEQ ID NO: 100546 - DNA, 467 bp, Homo sapiens
  misc_feature: GYAE6OF02G4T61.12.25.C03.1.454.CMB.1.raw
  modified_base (438)..(438): a, c, t, g, unknown or other
  misc_feature (438)..(438): n is a, c, g, or t
  modified_base (440)..(444): a, c, t, g, unknown or other
  misc_feature (440)..(444): n is a, c, g, or t
  modified_base (446)..(467): a, c, t, g, unknown or other
  misc_feature (446)..(467): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtccttgactacgtgggcctgggaactcgtggtccaccgtctcctcagcctccaccaagggcccatccggtcttccccctggccgccctgcctccgaggcgccacctccgagacgccacgacggccggcccgtgggcctcggccgtggtaccgaaaggtaccttaccttccgtacgtcgttactcgtggacgcgggtctcggcgaaggcgacagtagntnnnnnannnnnnnnnnnnnnnnnnnnnn

SEQ ID NO: 100547 - DNA, 599 bp, Homo sapiens
  misc_feature: GYAE6OF02HQ4IG.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctgggcctcagtaaggtctcctgcgaggcttctggttacacctttctcaggtatactattgcctgggtgcgacaggcccctggacaagggcttgagtggagtggggtggatcaacgtacgagacgtggtggcacagactatgcacgaggggctccgagggcacgactcgacatcgaaccacacgacacatcagccgaaacacgagtaccaactagtagggagttcggacggacgccgtgacgactcgtcggaaccgaccgggccggtaccgttaagttacttacgtaggtcgacggaagtacggtacgtaggccggtacgttccgttccgtttagaccttacggtcgggccgttacgggaccttcggtacggtcctacccggttctcccgg

SEQ ID NO: 100548 - DNA, 758 bp, Homo sapiens
  misc_feature: GYAE6OF02IZ8ER.12.25.C03.1.454.CMB.1.raw
  modified_base (503)..(503): a, c, t, g, unknown or other
  misc_feature (503)..(503): n is a, c, g, or t
tcagatacgacgtacacgaccggtgctcgatttagtagtgtagatttgggtttggggacccaaaaccacacccctccttgggagaatcccctagatcacagctcctcaccatggactgggcctggagcctcctttttcttggtggcagccgcaacaggtgcccactcccaggttcagctggtgcagtcgtggggctgagagtagaagaagccgtggggcctgaagtaaaggtctccgtggcgaggtcttcgtgggttaactcctttcgtactaggttaactacttattggtccgtggggtcgtcgacgcggccctggaacgaagggcttggaggtggtagtggggtaggtagtacgacggtcgtacgttaactaagtggtaaacctagaacggtactaagtcgacaacgaagtaaacggttaccgaaggacgaagacggtcaaccgagtacgaactacaacgtaaccacgactaccgaacgacgacaacgacgtaccctaaanagtacgggaagtccggtaagacgggacgtaaccgttaggaacgtagtccgtaggaccggtaaccggaccggtaccggtttaacgtaacgtttacggtagttaccgggtaaccgttaagggttaagggttttacggtaggttaacgtttaacgttttaaggttacggtaagggtttacggttacggttacctttacggttaccgttttaccggttttacgggtttcccggttaccccgggtcgggtaaaccccggg

SEQ ID NO: 100549 - DNA, 576 bp, Homo sapiens
  misc_feature: GYAE6OF02GTCKA.12.25.C03.1.454.CMB.1.raw
  modified_base (403)..(403): a, c, t, g, unknown or other
  misc_feature (403)..(403): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacaccttttctcaggtatactattgcctgggtgcgacaggcccctggacaagggcttgagtggatggggtgatcgaacgtacagacgtgggtcggcacgagactatgcacggacggggctccgagggcagactcaccatcgaccacacgacacancagacgaacacgagtacaacagtaggagttcggcggagccgtgacgatcgtggacgacggcggtaccgtattacgttgtgtcgacggagtacgtacgacggtcgtcgttcgttcctttagaccgtacggtcgggtaccgtagggtacctgttccggtaccttccgtcctcccg

SEQ ID NO: 100550 - DNA, 848 bp, Homo sapiens
  misc_feature: GYAE6OF02IDQDG.12.25.C03.1.454.CMB.1.raw
tcagatacgacgtacacgaccggtgctcgatttagtagtgtagatttgggtttggggacccaaaaaaccacacccctccttgggagaatcccctagatcacagctcctcaccatggactgggcctggagccttcctttttcttggtggcagccgcaacaggtgcccactcccaggttcagctggtgcagtctggggctgagatgaagaagccgtgggcctcgaagtaaggtctctgcgaggtcttcgtgttacctacctttctcgaggtatactattgccgtgggtcgcgacgacggtccccgtggacgaagggtcttggagtggagtggggtgatacgaacgtacacgtacgtggtcggacacgagacttagtcgacgacgacggggacctccggagggcaacgtacctaccgaacctaacgtacgaacccaacgaccggtaacaaccgtacgtaccgaacggaacccgaaacctacgtaacggtaaccaaacggtagttaacggggtaacgggtttccgggaaccgggtacggttacccgttacgggaaccgttacgtttaccggacggggtaaacccggtaacccggggtacccgggttacccgtttaacgtttaaccgttttaacccggttgggttaccggggtaaccggtaaaggtaaaccgggttttaaccgggtaacccgggtacccgggtttacccggtttttacccgggtttaaccccgttttacggggtaaaccccggtttaacgggggtcccgggggttaacccgggttaccggggttaacgtttacccggggtttccgggttacccccttaccccgggttccctttaacccccggg

SEQ ID NO: 100551 - DNA, 496 bp, Homo sapiens
  misc_feature: GYAE6OF02INQXS.12.25.C03.1.454.CMB.1.raw
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (461)..(462): a, c, t, g, unknown or other
  misc_feature (461)..(462): n is a, c, g, or t
  modified_base (464)..(496): a, c, t, g, unknown or other
  misc_feature (464)..(496): n is a, c, g, or t
tcagatacgacgtacacgaccggtgctcgatttagtagtgtagatttgggtttgggggggaagaggaagactgacggtcctgccacagactatgcacaggggctccagggcagactcaccatgaccacagacacatcagcgaacacagtcaacatggagttgcggagcctgcgatctgacgacgcggccgtatacttactgtgcgagagtacgtagcggctcgtccttgactacgtgggcctgggaactctggtcaccgtctcctcagcctccacaggcccatcggtctcccctgccncctgctccaggtnccacctccgagacgcacagccggtcccgtgggctcgcccgttgggtaccgaaaacgggtcctaacctttcccgtacggttccgtaattccgtggacggccgggtcgtagggccgaaacgggcgaacctaagttacgagtcagctagcganngnnnnnnnnnnnnnnnnnnnnnnnnnnnnnnnnn

SEQ ID NO: 100552 - DNA, 613 bp, Homo sapiens
  misc_feature: GYAE6OF02I90UA.12.25.C03.1.454.CMB.1.raw
  modified_base (259)..(259): a, c, t, g, unknown or other
  misc_feature (259)..(259): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttctttggtggcagccgcaacaggtgcccactcccaggttcagctggtgcagtctggggctgagatgaagaagcctggggcctcagtaaaggtctcctgcgaggcttctggttacacctttctnaggtatactattgcctgggtgcgacacggcccctggacaagggcttggagtggagtggggtggatcaacgtacagacgtggtggcagagcttatgcacgagggggcctaccggagggcacgactcacatacgaacccacgagacacatcacgacaacacaagtacaacagtaggacgttgcggacgcgtaggcgtagtcctaggaccgacggccggaccgttatacgttcgtagtcgacggacgtaaggtacgtacggacggtcgttccggttcccgtttagtaccgttaacgggttcggggacccggttaggggaaccttccgggtacggttccctacccggttccttccccg

SEQ ID NO: 100553 - DNA, 510 bp, Homo sapiens
  misc_feature: GYAE6OF02IBSXL.12.25.C03.1.454.CMB.1.raw
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (474)..(474): a, c, t, g, unknown or other
  misc_feature (474)..(474): n is a, c, g, or t
  modified_base (478)..(510): a, c, t, g, unknown or other
  misc_feature (478)..(510): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtatgtagcggctcgttcctttgactactggggcctagggaactcgtggtcaccgtctcctcacgcctcccaaccaacggggccccagttccggtccctttccccccgngggcccgccccgtagccctaccgagggacncccacccgtccgaagacgcctacgacgccgggccctgggccctgccctgggtacaaagggtactacccttcctaacggttctagtccgtggacggcgggctacgggacaaagggtccgactacgtagcngacnnnnnnnnnnnnnnnnnnnnnnnnnnnnnnnnn

SEQ ID NO: 100554 - DNA, 606 bp, Homo sapiens
  misc_feature: GYAE6OF02GT2WI.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctcagtaaaggtctcctgcgaggcttctggttacacctttctcaggtatacttattgcctgggtgcgacacggcccctggacgaagggcttgaggtggagtggggtggatcgaacgtacagtacgtggtggcaacgaggactagtcgacgacggacggggtcctccggaggggcaaggacctacaccgagtcgaccacagtaccacatcgacgacgaacacacgtacaacgtagtaggaggttcggacggagtccctaggcgatcgtaggaccgcggaccggtccgtaatacttacgtgtcgagagtaagtcgtagcgtcgttccggttcttacggacctacggtcgggtacgtcgggtactcggtacggtaccctacggttccctcccg

SEQ ID NO: 100555 - DNA, 661 bp, Homo sapiens
  misc_feature: GYAE6OF02FUW9F.12.25.C03.1.454.CMB.1.raw
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctgggcctcagtaaagtctcctgcgaggcttctggttacacctttctcaggtatactattgcctgggtgcgacaggcccctggaccaagggcttggagtggagtggggtggatcgaacgtacagacgtggtggcacgagactagtgcacgaggggctcgagggcagactcaccatacgaccacagacacactcagaccaacacacgtacaacngtggagttcggcggacnccgtgcgtagtccgtagaccggtacggccgtacccggttattacgtttaccgtggttacgaccgtaaggttaacggttaaccgtagggtccgggtacctttcccgggtttccgttttacggaacccgtttacccggggttacgggggttaaccccggttagggggttaaacccttttcccgggttaccgggttacccttacccccgggtttactccccccgg

SEQ ID NO: 100556 - DNA, 716 bp, Homo sapiens
  misc_feature: GYAE6OF02F66SG.12.25.C03.1.454.CMB.1.raw
  modified_base (200)..(200): a, c, t, g, unknown or other
  misc_feature (200)..(200): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtcgtggggctgganagtgaaagagccgtgggcctgaggtaagtctcgtgcgagtccttgtcggttacctacctttcacgtaggtactacttattgccgtggggtcgcgacgaccggccccgttggaacgagggtccttggcggtaggtaggtgggggtgtaactcgtaaacgtgaaggtcgtagggtcggacaacgacgtaactgtcgacgacggtaggggtcctacggagggtcacgtaccgtaccaccgagcgtaacccgaacgtacggaacctaacgacgttacgaacgggaactaaacccgacgtaacgtaacaacgtcgtagggtaacggttcgacggacgtccgtagacgtacgtaccgacgtaccgacgggtccgtacggttataccgttacgtacgttcgacgtaaggtaaccgttacggtcgtccggttacgttacccgtttcgttacgaaaccggttcgggttaacgggtacccgttaggaaccgtttccggttaggtacccgtaccgttcctaacccgg

SEQ ID NO: 100557 - DNA, 760 bp, Homo sapiens
  misc_feature: GYAE6OF02H6OIV.12.25.C03.1.454.CMB.1.raw
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagcgcaacaggtgcccactcccaggttcagctggtgcagtctggggctgagatgaagaagcgtggggcctcgaagtaaggtctcctgcgaggcttcgtggttactacctttcncgtaggtatactattcgccgtgggtcgcgacgccgggcccccggagagggcttggngtggaggtggggtggactacgtaacgtacgaggtaccggtgggtcggaccgaacaacggtactagtcggaccgacggagggggtcctaccggaggggcaacggacctaccgaacagtaccgaacccgaacaacgacacagtaccgaggaccaacaacgtaacgtaaccaacgtaggttacgggtagttcgggacgggtaacgtccgttaggaccgtacgttcgacgggaccggtacccgggtaccgggtacccgttaaatttacggtttaccggtggtaccgggacggtaacgggacgggttaacgacggggtcccggtccgttttaccgttttacccgggtttaagacccgggtttacgggtcccggggggttacccttacgggggtaacccttccgggttacccgggttaccctacccggttttacccgtacccgtacccgg

SEQ ID NO: 100558 - DNA, 492 bp, Homo sapiens
  misc_feature: GYAE6OF02GH6LG.12.25.C03.1.454.CMB.1.raw
  modified_base (307)..(307): a, c, t, g, unknown or other
  misc_feature (307)..(307): n is a, c, g, or t
  modified_base (452)..(452): a, c, t, g, unknown or other
  misc_feature (452)..(452): n is a, c, g, or t
  modified_base (454)..(456): a, c, t, g, unknown or other
  misc_feature (454)..(456): n is a, c, g, or t
  modified_base (459)..(460): a, c, t, g, unknown or other
  misc_feature (459)..(460): n is a, c, g, or t
  modified_base (462)..(492): a, c, t, g, unknown or other
  misc_feature (462)..(492): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttggcggagcctgcgatctgaccgacgcggccgtatattactgtgcgagagtacgtagcggctcgtcctttgactacgtggggcctgggaactcgtggtccaccgttctcctcacgcctccaccagggccccatccgtccttcccccgnggccgccctcgctcccgaggacgccaccctccggagacgccacacggccgcccgtgggcctcgccgtcggtcgaacggtaccttaaccttcctaccgttcgtacttccgtaggacgcgggcctgggacgaacggcgcaagttagntnnncgnngnnnnnnnnnnnnnnnnnnnnnnnnnnnnnnn

SEQ ID NO: 100559 - DNA, 662 bp, Homo sapiens
  misc_feature: GYAE6OF02GIXU5.12.25.C03.1.454.CMB.1.raw
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctgagtaaaggtctcctgcgaggcttctggttacacctttctcaggttatactattgccttgggtgcgacgaggcccctggacaaggggcttggaggtggagtgggggtggatcgaaacgtacagtactgggtggcacgagaactagtgacacgacggggctaccgagggcagactcacatcgaccanagacacatcagacgaactacacgtacaaacngtagggtagttggcggacgtccgtgaccgtatcgtacgaccggaccggaccggtacgtaagttactttaacgtggttacgacggaggtaacgttacgggtacgaccgggtcctttaccggttcccgttttacggaaccgttaccggggttaccgggggtaccggtttacgggggaaaccctttccgggttaccgggtacccgttaccccggtttcccttaccccgg

SEQ ID NO: 100560 - DNA, 670 bp, Homo sapiens
  misc_feature: GYAE6OF02F90AQ.12.25.C03.1.454.CMB.1.raw
  modified_base (337)..(337): a, c, t, g, unknown or other
  misc_feature (337)..(337): n is a, c, g, or t
tcagatacgacgtacacgaccggtgctcgatttagtagtgtagatttgggtttggggacccaaaaaccacacccctccttgggagaatcccctagatcacagctcctcaccatggactgggcctggagcctcctttttcttggtggcagccgcaacaggtgcccactcccaggttcagctggtgcagtctggggctgagatgaagagcctggggcctcagtaaaggtctcctgcgaggcttctggttactacctttctcaggtatactattgccgtgggtgccgacacggccccgtggacaagggcttggagtggagtggggtgatcgaacgtacgngacgtggtaggcagagacgtatgacaggacggggctcggagggcagactcacatagaccacgacgacacatcgagacgaaacacaacgtacaacgtagtcggacggttcgacgggacgtccgtagacgtactacgttcggaaccggaccggtaccgggtaccgtttacgtaacgttttacgtcggtcgtaacgggtaggtaacgggttaccggtacggtaccgggtccgttcccggtttaccgtttacggtaacccggttaccggttacgggggtacccgttacgggggtaacctttccggttacggtaccccgtacccggttccgtaccccg

SEQ ID NO: 100561 - DNA, 560 bp, Homo sapiens
  misc_feature: GYAE6OF02HS3QC.12.25.C03.1.454.CMB.1.raw
  modified_base (504)..(504): a, c, t, g, unknown or other
  misc_feature (504)..(504): n is a, c, g, or t
  modified_base (508)..(510): a, c, t, g, unknown or other
  misc_feature (508)..(510): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(521): a, c, t, g, unknown or other
  misc_feature (520)..(521): n is a, c, g, or t
  modified_base (524)..(525): a, c, t, g, unknown or other
  misc_feature (524)..(525): n is a, c, g, or t
  modified_base (529)..(529): a, c, t, g, unknown or other
  misc_feature (529)..(529): n is a, c, g, or t
  modified_base (532)..(533): a, c, t, g, unknown or other
  misc_feature (532)..(533): n is a, c, g, or t
  modified_base (535)..(537): a, c, t, g, unknown or other
  misc_feature (535)..(537): n is a, c, g, or t
  modified_base (539)..(539): a, c, t, g, unknown or other
  misc_feature (539)..(539): n is a, c, g, or t
  modified_base (541)..(543): a, c, t, g, unknown or other
  misc_feature (541)..(543): n is a, c, g, or t
  modified_base (545)..(549): a, c, t, g, unknown or other
  misc_feature (545)..(549): n is a, c, g, or t
  modified_base (551)..(556): a, c, t, g, unknown or other
  misc_feature (551)..(556): n is a, c, g, or t
  modified_base (558)..(560): a, c, t, g, unknown or other
  misc_feature (558)..(560): n is a, c, g, or t
tcagatacgacgtacacgaccggtgctcgatttagtagtgtagatttgggtttggggggaagaggaagactgacggtcctgccacagactatgcacaggggctccagggcagactcaccatgaccacagacacatcagcgaacacagtcaacatggagttgcggagcctgtgatctgacgacgcggccgtatattactgtgcgagagtacgtagcggctcgtcctttgactacgtggggcctgggactcgtggtcaccgtctcctcagcctccaccaacgggcccatcggtccttcccccgtcggcccgtcccctcgcctccgaggacgccacccgtccgagacgacacgacggccgggccccgtcggggcctcggcccgttgggttaccgaaacgggtacccttaacccgtttccctaaccggttccgttacttcgtcggaacgggcccggggtccgtacggggaccctaaacggggacccggactaaacgttcggactcgcncgannnancgcncnanncgnngtcngcnncnnncncnnncnnnnncnnnnnncnnn

SEQ ID NO: 100562 - DNA, 655 bp, Homo sapiens
  misc_feature: GYAE6OF02GGVY9.12.25.C03.1.454.CMB.1.raw
  modified_base (281)..(281): a, c, t, g, unknown or other
  misc_feature (281)..(281): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctccttttcttggtggcagccgcaacaggtgcccactcccaggttcagctggtgcagtctggggctggagatgaagaagcctggggcctcagtaaaggtctcctgcgaggcttctggttacacctttctcaggtatactattgcctgggtncgacaggcccctggacaagggcttgagtggatggggtgatcgaacgtacagacgtggtggcagagactatgcacgaggggctccgaggggcagactcaccagtcgaacccacacgacacatcgaagaccgaacacgagtaccaaactagtagggtagttggacgggaacgtcccgtgacgtagttccgacggtaccgacgggccggtaccgttaacttacgtttaacggtcggttacgaccggtaaggtaacggttacggtaccggcggttccgttacccggtttccgtttacggtaaccgtaccgggttcgggggtacccgtttacggggaacctttccggttacgggtacccgtaccccggttcttaccccg

SEQ ID NO: 100563 - DNA, 910 bp, Homo sapiens
  misc_feature: GYAE6OF02IOXU2.12.25.C03.1.454.CMB.1.raw
tcagatacgacgtacacgaccggtgctcgatttagtagtgtagatttgggtttggggacccaaaaaccacacccctccttgggagaatcccctagatcacagctcctcaccatggactgggcctggagccttcctttttcttggtggcagccgcaacaggtcgcccacctcccaggttcagctggtgcacgtcgtggggctgagatagaaggaacgccgtggggcctacgaagttaaacggtcctccgtggacggacggtcgtttactacggtttaacctaccttttacctacgaaggttaacttaaacttacgtttcggtcccgttaggggttacgaccggtaacgtaaccgggaccccgttagggaaccggtaaagggtccgtttaggtaaacgggttcgggtaacgggttacgggggggttaggtaacgttaaccgtaaaaccgggttaacgacggttacggttacggggtacgggaacctaacggtaaacggtaacttaacgtccggacgtaacgggacgggggtacctaccggaaggggaccgtaacgtaccgttaccaaccgacgtaacgaaccgaacgaacggaacctaacgtacgtaaccgaaccggaaccgaaaaccgaaccgttaaacggtaaaccctaaacgtaaagggttacggggttaaccggttcgggaaccgggtacggttacccgtagggaaccgttacgtacggtacggaccggtaccgggttaccggtaacgttaacgtttagtttaccggtagtacgggtaacgtaagggtaccggttaaacgtcgggtaccgtccgtttaccggttttaaccttacggtaacgttacggggtacggttacccgtaacgggttaccttccgggtaccggtaccttacccggtcccttaccg

SEQ ID NO: 100564 - DNA, 562 bp, Homo sapiens
  misc_feature: GYAE6OF02FJMOX.12.25.C03.1.454.CMB.1.raw
  modified_base (200)..(200): a, c, t, g, unknown or other
  misc_feature (200)..(200): n is a, c, g, or t
  modified_base (474)..(474): a, c, t, g, unknown or other
  misc_feature (474)..(474): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (518)..(520): a, c, t, g, unknown or other
  misc_feature (518)..(520): n is a, c, g, or t
  modified_base (522)..(522): a, c, t, g, unknown or other
  misc_feature (522)..(522): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (542)..(543): a, c, t, g, unknown or other
  misc_feature (542)..(543): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
tcagatacgacgtacacgaccggtgctcgatttagtagtgtagatttgggtttggggggaagaggaagactgacggtcctgccacagactatgcacaggggctccagggcagactcacatgaccacagacacatcagcgaacacagtcaacatggaagttgcggagcctagcgatctgacgacgcggccgttatattacngtgcgagacgtacgtacgcggctcgtcctttgactacgtgggcctgggactcgtggcacgtctcctcagtcctcaccagggcccatcggtctcccctggcacctcctccagacgcacctcgtgggggacacgtacggcggtcccctcggggcctacgcccgttgggtacaaacggggtacctaacctttacccggtaacgtttccggtaactccggttacggacgggtccggggtaccctgggccgtaaacgggtcggcctaagtaaccggtgntcgctatcgggatgaacgctgcatcncttgaagcnctctcntcnnncncgtagancgngcgtgacacnngacacncanacacgngacg

SEQ ID NO: 100565 - DNA, 495 bp, Homo sapiens
  misc_feature: GYAE6OF02F4623.12.25.C03.1.454.CMB.1.raw
  modified_base (254)..(254): a, c, t, g, unknown or other
  misc_feature (254)..(254): n is a, c, g, or t
  modified_base (335)..(335): a, c, t, g, unknown or other
  misc_feature (335)..(335): n is a, c, g, or t
  modified_base (465)..(495): a, c, t, g, unknown or other
  misc_feature (465)..(495): n is a, c, g, or t
tcagatacgacgtacacgaccggtgctcgatttagtagtgtagatttgggtttgggggggaagaggaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgttcctttgactacgtcggggcctgggaacctntggtccaccgtctcctcacgcctccaccgaacggcccatcggtccttcccccgtggccgcccctgccctccgaggacgccncccgtccgagacgcgaccaggcccggcccgtaggggctcgcccgtggaccgaacggtaccttacctccgtacgttcgtatcgtaggacggccggggtcgtacgggccgaaacgggccgactaagtacggnnnnnnnnnnnnnnnnnnnnnnnnnnnnnnn

SEQ ID NO: 100566 - DNA, 715 bp, Homo sapiens
  misc_feature: GYAE6OF02FP218.12.25.C03.1.454.CMB.1.raw
  modified_base (201)..(201): a, c, t, g, unknown or other
  misc_feature (201)..(201): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagntgaagagccgtgggcctcagtaaaggtctcctgcgaggcttctggttacacctttctctaggtatactattgccgtggtgcgacacggccctggacgaaggcttgagtggagtgggggtggtatacgaacgtacgagtacgtggtgacacgagtactagtgcacggacggggctaccgagggacgacgactacacatcgaaccacgacgtacacatacgacgaacgtaaccgactaacggtacaaaccgaggttacggacgtttacgggacggaccggttaccgtggaccggtacttcggacggaaccgggccgggtacccgggaaccgtttaacgtttacgtttaacggtcggttacggtaaccggaacggtaagggttaacccggtacggtcccgggttacgtttcccggttttcgttacccggtttaaccgtacggggttaccggggtaccggttaaccgggtaaccgtttccgggtaccggttacccggttacccggttccctaccccgg

SEQ ID NO: 100567 - DNA, 751 bp, Homo sapiens
  misc_feature: GYAE6OF02INGY4.12.25.C03.1.454.CMB.1.raw
tcagatacgacgtacacgaccggtgctcgatttagtagtgtagatttgggtttggggacccaaaaccacacccctccttgggagaatccctagatcacaggctcctcacactggactgggcctggagccttccttttcttggtggcagccgcaacaggtgcccactcccaggttcagctggtgcagtctgggacctgagatgagagcctgggccttcagtaaacggtctacctgacggacggctttctggttaccacctttctcgtacggtatactaacgttgcctagggtcgacgtacgacgggtcccccgtggacctaaacgggctttacgacgtagggagtttcgggggtagtacgtacgtacgtaccgagacgttgggtcggactacgacgactacgttcggcaacggtacggggccttaccggaacggggttcacggacctcggaacacgtacgaacctacgagaccaacgtactcggaacaccggtaaacaacgagtaccgtaaagtacgtaggtacgttaaggcccggaaacggtccttaagggccaatttccggacgggaccgacgttccggaccttaaggttacttaccgtgggtaccgaccggtaaacgtacgtaacgtcgggccgtaccgggtttaccgtttccccggtttaagcccggttttaaacccgggggggttaaaccccgtgggggtttaacccttcggttaccgggcccggttaccccggttacttcccccgg

SEQ ID NO: 100568 - DNA, 622 bp, Homo sapiens
  misc_feature: GYAE6OF02GXBVU.12.25.C03.1.454.CMB.1.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (489)..(489): a, c, t, g, unknown or other
  misc_feature (489)..(489): n is a, c, g, or t
tcagatacgacgtacacgaccggtgctcgatttagtagtgtagatttgggtttggggacccgaaaaaccacacccctccttgggagaatcccctagatcacagctccgtcaccatggactgggcctggagcctcctttctggtgcagccgcaacaggtgcccactcccaggttcagctggtgcagtctgggctgagatgaagagcctgggcctcaggtaaagtctcctgcgaggcttcnggttaccactttncaggtntacctattgcctgggtgcgtacaggcccctgactaagggcttgacgtggaatggggtagatacaacgttacaggtacctaggtgactacagactagtgacacgaggggccttccaggggccagacctcggacctagtcaacctacgacacgtacatccaacggacgaaaccgactaacgtacaaaccgtaatcgggtaagttccgggacggagtacccgtgacgacgttcncggtaacgccggtcggtaccgtagtaacttacgtgttcgacgacgtagtacgttgcggtactccggtcttacgacgttaccggtcgggtaccttaggggacccttcgtcggtcccgttaacccgcttacccgg

SEQ ID NO: 100569 - DNA, 721 bp, Homo sapiens
  misc_feature: GYAE6OF02H0TC2.12.25.C03.1.454.CMB.1.raw
tcagatacgacgtacacgaccggtgctcgatttagtagtgtagatttgggtttgggggacccaaaaaccacacccctccttgggagaatcccctagatcacagctcctcaccatggactgggcctgggagcccttcctttttcttgggttggcagccggcaacagggtgccccactccgaggttcagctgggttgcagtctggggctgagatgaagaagccgtggggcctcgaagtaaggtctccgtgcgaggtcttctggttactactttctcaggtatactatcgccgtggtcgcgacacggcccgtagacgaggtcgtgaggtggagtgggtggatcgaacgtacgaggacgtgggtgacacgagactagtgaccgagacggggtcctccggacggacacgacctacgaacacgtacacgaacgacgaaacgaactacgtacgaacgacgtaaccaacgacgtaaaccgaagtacggtagggtaacgtaggacggcgtacgtcggtaccgtacgttaccggaggacccggtacgggtaccggttaccggttaacgttaacgttacgttacgggttagaccgggtaagggttaccgtaaacgggttcggaccgttaccgttccgggtttaacctttcgggtaccgttacgggttaccggggttaccgttaacggggtaccgtttccggttaacggttcccgtacccggttactccccgg

SEQ ID NO: 100570 - DNA, 744 bp, Homo sapiens
  misc_feature: GYAE6OF02HKFCY.12.25.C03.1.454.CMB.1.raw
  modified_base (458)..(458): a, c, t, g, unknown or other
  misc_feature (458)..(458): n is a, c, g, or t
tcagatacgacgtacacgaccggtgctcgatttagtagtgtagatttgggtttggggacccaaaaaaccacacccctccttgggagaatcccctagatcacagctcctcaccatggactggcctggagcctcttttctggtgcagccgcaacaggtgcccactcccaggttcagctggtgctagtcgtggggctagagatgaaagagccgtgggcctacgaagtaacggtctacctggacgaggtcttcgtaggttacctaccgttttcacgtaggttactacttagttcgccgtagggtacgacgtacgaccggtaccccgtaggaacgaacggtcttgaggtcggaggttaggggtagactaccgaacggtacagtacgtggtacgacaacgtaagacttagcgcacggacggcctacggacgacacgtactacaccgtataccgaacaccgtaanaccgactactacggaaacgtcaaaccgttacgacgtaactaaacgtaggtacggttaggtaccgggacgtaccggttacggtacctacggtacgtttaccggacggaacccgggtccggtacccgtagtttaaacgttccgttagggtacggaccgtaaggtacgttaacgggtaacgtttaccggcgttacccgttttcgtaaccggttaccggtacggtacggttacccgggtacgtacgggttaccttacggtacccggttccgttaacccggtcgtaccccg

SEQ ID NO: 100571 - DNA, 803 bp, Homo sapiens
  misc_feature: GYAE6OF02IW9V3.12.25.C03.1.454.CMB.1.raw
tcagatacgacgtacacgaccggtgctcgatttagtagtgtagatttgggtttggggacccaaaaaaccacacccctccttgggagaatcccctagatcacagctcctcaccatggactgggcctggagcctccttttcttggtggcagccgcaacaggtgcccactcccaggttcagctggtgcagtcgtgggctgagatgaagagccgtgggcctagaagtaaggtctccgtgacgaggtcttcgtggttactacctttctcgagtatactatcgcgtggtacgcgacgcggtccccgtaggaaccgaagggtcttaggacggttggaggttggggtagactaccggtaacggtacaaggtaccgtgggtacggaccaacgtaacggtaacttaggtacgacgaacgggacggggtccctaccgggtaagggccctaacgacctaccgacctacgtaccgaacccctaacgaacgaacccgtaactacgtaaccaacggaaccgaaaccgacgttaacgacgaaacgtaggtacgggtagtccgggaacggtccgtaccgtaggtacccgtacgttacgcgggtaaccggtacccggggaccgttaccgttaaacggttacttacggtacggtaggttaaccggtaaacggttaacgttacggggaacgttccccggttaccgtttacccgggtttaacccgtttaaggtacccggtttaacggggtccgggtaaccccggttaacgggtaaccgtttcccgggtaacccgggtccccctttaccgttccccgtaacccgg

SEQ ID NO: 100572 - DNA, 470 bp, Homo sapiens
  misc_feature: GYAE6OF02JKP9N.12.25.C03.1.454.CMB.1.raw
  modified_base (335)..(335): a, c, t, g, unknown or other
  misc_feature (335)..(335): n is a, c, g, or t
  modified_base (403)..(403): a, c, t, g, unknown or other
  misc_feature (403)..(403): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (443)..(470): a, c, t, g, unknown or other
  misc_feature (443)..(470): n is a, c, g, or t
tcagatacgacgtacacgaccggtgctcgatttagtagtgtagatttgggtttgggggggaaagaggaagactgacggtcctgccacagactatgcacaggggctccagggcagactcaccatgaccacagacacatcagcgaacacagtcaacatggagttgcggagcctgcgatctgacgacgcggccgtatattactcgtgcgagagtacgtagcggcttcgtccttgactacgtggggcctgggaactcgtggtccaccgtctccctcacgccctccaaccgacgggccccatccggtccttcccccgtggccgccctcgcctccgaggcncctacctccgagacgcacgacggccgccgtggctcgcgtgacaggcttactccgtacgcgttactcgnggtcgcgggcgtcggacgtacggcgacagtgtancnacgnnnnnnnnnnnnnnnnnnnnnnnnnnnn

SEQ ID NO: 100573 - DNA, 754 bp, Homo sapiens
  misc_feature: GYAE6OF02FMLR0.12.25.C03.1.454.CMB.1.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (349)..(349): a, c, t, g, unknown or other
  misc_feature (349)..(349): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatgaagaagcctggggcctnagtaaaggtctcctgcgagcttctggttacncctttctcaggtatactattgccgtgggtgcgacacggcccctggaccaagggcttgaggtggagtggggtagatacgaacgtacagacgtggtgcanagactagtgacacgacggggctaccggagggacacgtactacccacgtaagtacgtaccccaacgaacgaacgaaaccgtacgtaccgaacgtaccgggaaaacctaaccggaacgttaccgaaaacgtagttacgggacgggtttacgaccggggtacggtacccggtacggaccgttacgtccgtacggaaccggtaaccggcccgggttaaccgtttagtaacctttacgtagggttaccggtaaccggtaaacggttaggttaacccgggtaggtcccgggttaccggttacccggttttccggttacggttaacccgttaccgggtaaccgggggttcccggttaacgggttaacccgttccggttaccgggttaccccttaccccggttccttaccccg

SEQ ID NO: 100574 - DNA, 669 bp, Homo sapiens
  misc_feature: GYAE6OF02ILYE3.12.25.C03.1.454.CMB.1.raw
  modified_base (533)..(533): a, c, t, g, unknown or other
  misc_feature (533)..(533): n is a, c, g, or t
  modified_base (547)..(547): a, c, t, g, unknown or other
  misc_feature (547)..(547): n is a, c, g, or t
  modified_base (558)..(558): a, c, t, g, unknown or other
  misc_feature (558)..(558): n is a, c, g, or t
tcagatacgacgtacacgaccggtgctcgatttagtagtgtagatttgggtttggggggaagaggagactgacggtcctgccacagactatgcacagggctccagggcagactcaccatgaccacagacacatcagcgaacacagtcaacatggagttgcggagcctgcgatctgacgacgcggccgtatattactgtgcgagagtacgtagcggtctcgttcctttgactacgtggggcctgggactcgtggtcaccgtctcctcacgccctaccaccgaacgggcccctaagtccggttacccttccccccgtcgggcccggtcccctcggtacccgtccgacggacgtccctacccgtaccgaagtacgactaacgtaacggccggtcccgtacgggccttccgccgtcggtaaccgtaacggtacccttacgtttacccgttacggttaccgtagttaccgtaggtacgggtcccgggtacgtaccgggacggtaacggtccggctaaacgtaggctacgtacgcgagngttcgacggtaacncgtaacgtccncgacgtacgtgtacgtctacgtacgtacgtaacgacgtacgtcgtacgtacgtacgtacgtcgtacgtcgtacgtacgtacgtcgtcgtacgtacgtacgtacgtacgacg

SEQ ID NO: 100575 - DNA, 694 bp, Homo sapiens
  misc_feature: GYAE6OF02I5L32.12.25.C03.1.454.CMB.1.raw
  modified_base (100)..(100): a, c, t, g, unknown or other
  misc_feature (100)..(100): n is a, c, g, or t
  modified_base (195)..(195): a, c, t, g, unknown or other
  misc_feature (195)..(195): n is a, c, g, or t
  modified_base (476)..(476): a, c, t, g, unknown or other
  misc_feature (476)..(476): n is a, c, g, or t
  modified_base (576)..(576): a, c, t, g, unknown or other
  misc_feature (576)..(576): n is a, c, g, or t
tcagatacgacgtacacgaccggtgctcgatttagtagtgtagatttgggtttggggacccaaaaaccacacccctccttgggagaatcccctagatcanagctcctcaccatggactggcctggagcctccttttctggtggcagccgcaacaggtgcccactcccagttcagctggtgcagtctgggctgagntgaagaagccgtggggcctacgaggtaaacggtcctccgtagcgaggtctttcgtggttactacctttctcaggttactactattgccgtggtcgcgacacggcccctggacgaagggcttaggaggtggagttggggtgacgtaccgaacggtacaggacgtggtcggacacagtactagtgacgtacggagggggtcctaccggacggggtaccaggtaaccctccgaaccgacgtacgaacccacgaacgaaccacgtactccgaacggacgaaaccncgtaactaccgtaaactagtagggtaggtcggtaccggacgtccgtggacgtacgtcgtacggaaccggaccggtccgggaccgtttaatacgtttacgnggttacgccggaaggtaccggtagtacggccgtcgttcgtttaccttcggtaacgttccgggtcgggttaccgtacggggtaccctgggttcccggtaccttcccggttaccgtcccg

SEQ ID NO: 100576 - DNA, 693 bp, Homo sapiens
  misc_feature: GYAE6OF02JCCU1.12.25.C03.1.454.CMB.1.raw
  modified_base (220)..(220): a, c, t, g, unknown or other
  misc_feature (220)..(220): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
  modified_base (558)..(558): a, c, t, g, unknown or other
  misc_feature (558)..(558): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
  modified_base (579)..(579): a, c, t, g, unknown or other
  misc_feature (579)..(579): n is a, c, g, or t
  modified_base (592)..(592): a, c, t, g, unknown or other
  misc_feature (592)..(592): n is a, c, g, or t
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
  modified_base (685)..(685): a, c, t, g, unknown or other
  misc_feature (685)..(685): n is a, c, g, or t
tcagatacgacgtacacgaccggtgctcgatttagtagtgtagatttgggtttggggacccaaaaaccacacccctccttgggagaatcccctagatcacagctcctcaccatggacgtcgggccttggacgccttccctttttcttgggtacggcaccggccggacaaactagggtccgcccctaccttcccccgagggtttccaaggtccttagggtncgtaacgttcgtgggggcttagggaagtatgaaaggacgtccggtcggggcctagtaaggtaaacgtcctccgtggcgtacgtcgttcgtacgttaacctcctttcagtacgtattactattcgccgtagggtcaccggtacgaccggttccccgagacgtaacggggcttaggtaacggtggaggttagggggcgtacgtacgtaaaacggtccgttaaggccggtttaggcgacccggtaanacgtaatcggacgtnaacgggcggtcacccggagggcctaggaccctgaaccgttagacacccagtacacctagctacgaacgaccagacccanacctaagntaaggntaccggngactcgcgacgtnacgtcgatacggcgactgttnacgntgagtacgtaagccgtatcggaccgtattcggaagtccgcggtaccgggtgcgacgtcctaggccctntcggtacc

SEQ ID NO: 100577 - DNA, 800 bp, Homo sapiens
  misc_feature: GYAE6OF02I0LJ5.12.25.C03.1.454.CMB.1.raw
  modified_base (185)..(185): a, c, t, g, unknown or other
  misc_feature (185)..(185): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtncgagtcgtgggtctggagatagaaggaagccgtgggtcctagaagtaaaggtcttcctaggcgtaggtcttacgtgttacctaccgtttctacgaaggtatacttaatcgtccgtagggtgacgaccgacggtccccgtagaaaccgtaggggtactttaggaacggttagggtacggttgggggtacgtaacgtaccgttaaccgtaacgaacggtacggtgggtacggaaccaacgtagaaccgtttaggactaccgtacgggaacgggtaccgtaaccgacgggactacgaccgtacaacgtagtaccggaactacgaacgtaaccgacgtaagtaccgaacggacctaaaacgacgtaacgtaacaaccgtaagttgggggtaaatttcgggaacgtacggtaccgttacggtacgtaacgttccggagtaacccggaacggcccgggttaaccttaagtttaccgtttaacggcggtacgggtaaagaggttaacccgtaaacggttacgggtccggttaaccttaccggggtttacttagttaaacccggtacggtcggggtaacgtaacggttaccgccgtttaacggtccccgtacgttccgtaccg

SEQ ID NO: 100578 - DNA, 704 bp, Homo sapiens
  misc_feature: GYAE6OF02GUOPT.12.25.C03.1.454.CMB.1.raw
  modified_base (269)..(269): a, c, t, g, unknown or other
  misc_feature (269)..(269): n is a, c, g, or t
  modified_base (346)..(346): a, c, t, g, unknown or other
  misc_feature (346)..(346): n is a, c, g, or t
  modified_base (412)..(412): a, c, t, g, unknown or other
  misc_feature (412)..(412): n is a, c, g, or t
  modified_base (595)..(595): a, c, t, g, unknown or other
  misc_feature (595)..(595): n is a, c, g, or t
tcagatacgacgtacacgaccggtgctcgatttagtagtgtagatttgggtttggggacccaaaaaaccacacccctccttgggagaatcccctagatcacagctcctcaccatggactgggcctggagcctcctttttcttggtggcagccgcaacaggtgcccactcccaggttcagctggtgcagtctggggctgagatagaagacgccgtgggacctcgaagtaaaggtcctccgtgcgaggtccttcgtggttactacctttcncgaggtacttactattcgtccgtgggtcgccgacgaccggtccccgtggacgaaggtctggagtggagtggggtagntacgaacgtacgaggtacgtgggtcgacgacgtacgtactagtcgaccgacggacgggtcaccggngggcagacctacgacctagtaccaccacgtacgacaactacaccgacgaaccgaacacgtactaacccgaaagtaggtacggttaggtccggacggtaccggtcgtcggtacgtacgtcgtaccggaccgtacggccgttacgttaagtaacgttaacgttacggttcgtaaggcgtaaaggngttacggacggttccgtacgtttcccggttacgtttaccgacggtttaccgggaccgggttaccgttaccgggttacttccgggtacgttacccggtacccgtttcccg

SEQ ID NO: 100579 - DNA, 185 bp, Homo sapiens
  misc_feature: GYAE6OF01D58GH.23.37.D04.1.454.CMB.1.raw
  modified_base (183)..(185): a, c, t, g, unknown or other
  misc_feature (183)..(185): n is a, c, g, or t
tcagacgcgagtatcacgaccggtgctcgatttagtagcatactgttgggtttgggggaagaggaagactgacggtcctcccaggagttcaggtgctgggcaccttgggcacagcggccctgggctgcctggtcaaggactacttccatactcgcgtctgagcgggctggcaaggcgcatagnnn

SEQ ID NO: 100580 - DNA, 516 bp, Homo sapiens
  misc_feature: GYAE6OF01DJLLH.23.37.D04.1.454.CMB.1.raw
  modified_base (443)..(443): a, c, t, g, unknown or other
  misc_feature (443)..(443): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggctgggacagacttcactctcaccatcccgcagccctagcgcctgaagtactttgcggttttatactgtacaacaacgtaccaactggcctccgtnttggacgttcggaccaagggaccaaggtgaaatcaaacgactgtgctgcacatctgtcttcatcttccgctac

SEQ ID NO: 100581 - DNA, 190 bp, Homo sapiens
  misc_feature: GYAE6OF01BAXWX.23.37.D04.1.454.CMB.1.raw
  modified_base (188)..(190): a, c, t, g, unknown or other
  misc_feature (188)..(190): n is a, c, g, or t
tcagacgcgagtatcacgaccggtgctcgatttagtagcatactgtctcctcagcttccaccaagggcccatcggtcttcccctggcgccctgctccaggagcacctctgggggcacagcggccctgggctgcctggtcaaggactacttccatactcgcgtctgagcgggctggcaaggcgcatagnnn

SEQ ID NO: 100582 - DNA, 507 bp, Homo sapiens
  misc_feature: GYAE6OF01AFL24.23.37.D04.1.454.CMB.1.raw
  modified_base (360)..(360): a, c, t, g, unknown or other
  misc_feature (360)..(360): n is a, c, g, or t
  modified_base (432)..(432): a, c, t, g, unknown or other
  misc_feature (432)..(432): n is a, c, g, or t
tcagacgcgagtatcacgaccggtgctcgatttagtagcatactgttgggtttgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacacgggccactggcatccccgaggcaggttcagtggcagtggctcgtgggacngacttcactctcacgatcagcagtgtcgaccctgacgtattttgctagtttattactgtcagcaacgtggcncctggcctagtccaccgttcggccaagggctcgacgtggagagtcgaaacgactggtgctcgcacatctgtcttc

SEQ ID NO: 100583 - DNA, 162 bp, Homo sapiens
  misc_feature: GYAE6OF01DBQ5G.23.37.D04.1.454.CMB.1.raw
  modified_base (160)..(162): a, c, t, g, unknown or other
  misc_feature (160)..(162): n is a, c, g, or t
tcagacgcgagtatcacgaccggtgctcgatttagtagcatactgttgggtttgggggaggtgtgtcacaagatttgggctctgggcacagcggccctgggctgcctggtcaaggactacttccatactcgcgtctgagcgggctggcaaggcgcatagnnn

SEQ ID NO: 100584 - DNA, 520 bp, Homo sapiens
  misc_feature: GYAE6OF01BXTJX.23.37.D04.1.454.CMB.1.raw
  modified_base (361)..(361): a, c, t, g, unknown or other
  misc_feature (361)..(361): n is a, c, g, or t
  modified_base (490)..(490): a, c, t, g, unknown or other
  misc_feature (490)..(490): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtgcagtgggtctgggacagcttnactctcaccatccgcagcctaagacgcctagaagtactttgacggttttattacgtgtacaaactacgtaccaactggcctcgtctaggtacgtcgaccaaggacaaggtagaaactcgaaacgactgnggctgcacatctgtcttcatcctccgctac

SEQ ID NO: 100585 - DNA, 525 bp, Homo sapiens
  misc_feature: GYAE6OF01BPCG5.23.37.D04.1.454.CMB.1.raw
  modified_base (501)..(501): a, c, t, g, unknown or other
  misc_feature (501)..(501): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtgcagtgggtctgggacaggacttcactctcaccatccgcagcctagacgcctagaacgtactttggcggttttatactgtacaacaacgtaccaactcggccctcgtcttggacgttcggccaagggaccaaggtcgaaatcgaaacgtactagtggctgcncatctgtcttcatcctcccgctac

SEQ ID NO: 100586 - DNA, 524 bp, Homo sapiens
  misc_feature: GYAE6OF01B3WN2.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatccgcagcctagagcctgaagtactttgcggtttattactgtcaacaacgtaccaactcggcctcgtcttcggacgttcggcaagggaccaaggtagaaatacgaaacgactagtggactgacaccgatctcgtcttcatccttccgctac

SEQ ID NO: 100587 - DNA, 526 bp, Homo sapiens
  misc_feature: GYAE6OF01A8T8P.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacagacttcactctcaccatccgcagcctagagcctgaacgtactttgcggttttaattactgtaccaaacaacgtaccaactcggcctcgtcttggacgttcggaccgaagggaccaaggtacggaaatcgaaacgactgtggctgcacatctgtcttcatcctccgctac

SEQ ID NO: 100588 - DNA, 558 bp, Homo sapiens
  misc_feature: GYAE6OF01DY7A4.23.37.D04.1.454.CMB.1.raw
  modified_base (555)..(555): a, c, t, g, unknown or other
  misc_feature (555)..(555): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggctgctcatctatgatgcatccagcagggccactggcatcccagccaggttcagtggcaggtgggtctgggacagacttcactctcaccatccgacacgcctagacgcctagaaagtactttggaccggttttaattacgtgtaccaaacgtaaccgtaccaacgtcggaccttccgtcttgggaccgttcggaccgaaaggaccgtaaggtaggaaactacgaaacgtacgtgtcggctagacacatcttcgtacttctatcttcccgntac

SEQ ID NO: 100589 - DNA, 689 bp, Homo sapiens
  misc_feature: GYAE6OF01BQS5A.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagtcaccctctcttgcagggccagtcaagacattaggaactacttagcctggtaccaacagaagcctggccaggctcccaggctgctcatctatgatgcatccagcagggccatggcatcccagccaggttcagtggcagtgggtctgggacagacttcactctcaccatccgcacgcctagacgccctagaacgtacgttttgaccggttttaattaccgttggttaccaaaaccgtaacccggttaacccaaaccgtttcgggtacccctttacccgggttccgttttacggggtacccggttttaccggggaccccgtaaacggggggtaacccctaaagggggttacggaaaaacgttacccgaaaaaccggtaaccgttacgggttacgggacctttacggacccgtaaacccgtacgtttaccgttacggtttaccctttaccgtaactttccccgtttaccccccggtccgttaaaccg

SEQ ID NO: 100590 - DNA, 596 bp, Homo sapiens
  misc_feature: GYAE6OF01DAI4I.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggcctgctcatctatgatgcatccagcagggccacgtgcactcccagcctaggttcaggtggcgtaggtgggtcgtgggactagtaccttcactctaccaccacgtccgacacgtacctaggacgtccgtaagtaacgttacgtttggtacgttttaactacgtacgtaaccaaacgtaccgtaacctacgtccggtcccttcggttcgtacgggtacgtccggaacgacggacgtaaggtagaactacgaaacgtagtggtgctagaccacctagttccgttcgttcctactaccgttccctcccgctacg

SEQ ID NO: 100591 - DNA, 511 bp, Homo sapiens
  misc_feature: GYAE6OF01A1W6H.23.37.D04.1.454.CMB.1.raw
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcagtgggtctgggacaggacttcactctcaccatcccgcagcctagagcctgaagactttgcggtttattactgtcaacaacgtaccaactgcctcgtcttggacgttcgccaaggaccaaggtgaaatcaaacgacngtgctgcncatctgtcttcatcttcccgctac

SEQ ID NO: 100592 - DNA, 557 bp, Homo sapiens
  misc_feature: GYAE6OF01E1RDT.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcactcccagccaggttcagtggcaggtgggtctgggacagacttcactctcaccatccgcacgcctagacgcctagaacgtactttggcgttttaattactgtacaaacacgtacccaatcgcctcgtcttcggacgttcggaccgaagggaccaagggtacggaaataccgaaacgtaacgtaggtacggtctagacaccagttcctgttaccttacacttcccttcccgcctac

SEQ ID NO: 100593 - DNA, 547 bp, Homo sapiens
  misc_feature: GYAE6OF01ERRUR.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcaggtgggtctgggacagcttcactctcaccatcccgcacgcctagacgcctagaacgtactttggtacggttttattacgtgtaccaactaaccgtaccaactcggccctcgtcgttcggaccgttcggaccgaacgggaccaagggtacgaaatacgaaacgacgtgtcggctgaccacatctcgtcttcatccttcccgctac

SEQ ID NO: 100594 - DNA, 631 bp, Homo sapiens
  misc_feature: GYAE6OF01BVKCG.23.37.D04.1.454.CMB.1.raw
  modified_base (203)..(203): a, c, t, g, unknown or other
  misc_feature (203)..(203): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaanagccaccctctcttgcagggccagtcaagacattaggaactacttagcctggtaccaacagaagcctggccaggctcccaggctgctcatctatgatgcatccagcgagggccacgtggcactcccagccaggttcagtgcagtgggtctgggacagactcactctcacctatccgcacgcctagacgtcctagtaacgtacgtttggtacggttttaacttacgtacgtacaaaccgtaaccgtacccgtaaactcgggtacccttccgttcgttacgggtaccgttccgggaccgtaacggggtacctaagggtacggtaaaacgtaccgtaaaacggtaccgttaggtacggtaccgtacggacctaaccgtacgttccgttacgttacctttacgtaaccttcccgtttaccccgccgttaacg

SEQ ID NO: 100595 - DNA, 608 bp, Homo sapiens
  misc_feature: GYAE6OF01EPVD9.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccacgtggcatcccagccaggttcagtggcagtgggtctgggacagacttcactctcaccatccgcagccctagacgcctgaagtactttgtcggtttattacgtgtacaaactaacgtaccaacttcggcccttccgtcgtttaggaccggttccggaccgaaaggggtacccgaagggttaggaaaacttaccgaaaacggtaaaccgttagggtacggaccgttacggaccctaccgtacgttccttacggttccctttactacctttcccgtttcccccggcccttaaccg

SEQ ID NO: 100596 - DNA, 643 bp, Homo sapiens
  misc_feature: GYAE6OF01C2V9S.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttcgtccccaaggggaaacgagccaccctctcttgcagggccagtcaagacattaaggaactacttagcctggtaccaacagaagcctggccaggcctccaggctgctcatctatgatgcatccagcgagggccacgtggcactccagccaggttcagtcggacaggtcgggtctgggacaggtacttcactctacacctatcccgacacgtcctaggacgccgtagaacgtactttagggtcgttttaattacgtgtaaccaaaccgtaaaccgtaccgaaaccgttcgggtacccttccgttcgttacgggtaccggttaccgggtaccgaaacggggaacccaaagggtacggtaaaaactaccggaaaaaccgtacggttaggtacgggccttaagggacctaacccgtactcgttacggttcctttacacctttcccttccccgaccttaacg

SEQ ID NO: 100597 - DNA, 548 bp, Homo sapiens
  misc_feature: GYAE6OF01BCFRB.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaagagccaccctctcttgcagggccagtcaagacattaggaactacttagcctggtaccaacagaagcctggccaggctcccaggctgctcatctatgatgcatccagcagggccatggcatcccagccaggttcagtggcaggtgggtctgggacagacttcactctcaccatccgcagcctagacgcctagaagtactttgacggtttatacgtgtacaacacgtaccaatcggacctcgtctggacgttcgaccaagggaccaaggtaggaaactcgaaacgtactggtacggcttaggaccacgtactcgttcgtacctttcgaattccctttccccgcctaacg

SEQ ID NO: 100598 - DNA, 547 bp, Homo sapiens
  misc_feature: GYAE6OF01B5N05.23.37.D04.1.454.CMB.1.raw
  modified_base (516)..(516): a, c, t, g, unknown or other
  misc_feature (516)..(516): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccagtggcatcccagccaggttcaggtggcagtgggtctgggacagacttcactctcaccatcccgcacgcctagacgcctagaacgtacgtttgacgttttatactgtacaactaacgtaccaacgtcgcctcgtcttaggacgttccggacgaagggacctaagggtacgaaactaccaaacgactaggtcgcgtagaccncatctcgttcttacacttccttcccgcgtac

SEQ ID NO: 100599 - DNA, 537 bp, Homo sapiens
  misc_feature: GYAE6OF01CK87A.23.37.D04.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctccagagaccaccggagaaattgtgttgacacagtctccagccaccctgtctttgtccccaggggaaagngccaccctntcttgcagggccagtcaagacattaggaactacttagcctggtaccaacagaagcctggccaggctccaggctgctcatctatgatgcatccagcaggccatgcatccagccaggtcagtgcagtggtctgggacagtacttcactctcaccatccgacaggtccctagacgcctagaacgtcgtttgacggtttatactgtacaaactacgtaccaactggcctcgttcgtacggacgttcggaccaagggccaagtcgtaggaaatccgaaaacgtacgtggtcggctagcaccattcctagttcttacattccgtcccgtac

SEQ ID NO: 100600 - DNA, 570 bp, Homo sapiens
  misc_feature: GYAE6OF01EAOA8.23.37.D04.1.454.CMB.1.raw
  modified_base (374)..(374): a, c, t, g, unknown or other
  misc_feature (374)..(374): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcaggtgggtctgggacagacttcactctcaccntccgcagcctagactctagaagtctttgcggttttattactgtaccaaactaacgtaccaacgtcggccctccgttcttcgggaccgtttcgggaccctaaggggacccaagggtcggaaactccgaaaacgacgtggtacgggccttagacctaccattccgttgttcctttaccactttcccttccccgctaac

SEQ ID NO: 100601 - DNA, 644 bp, Homo sapiens
  misc_feature: GYAE6OF01DCAP6.23.37.D04.1.454.CMB.1.raw
  modified_base (386)..(386): a, c, t, g, unknown or other
  misc_feature (386)..(386): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctaggtaccaacagaagcctggccaggctcccgaggctgctcatctatgatgcatccagcagggccacgtggcactcccagccaggttcaggtggcaggtgggtctgggacagtcttcactctacaccatcccgnacgcctagacgcctaggaagtacgtttggacggttttaatacgtacgttacaaacgtaacgtaaccaacgtcggtacccttccggttcgttacgggtaccggtttaccgggaccgtaaacggggtacctaaaggggtacgaaaacgttaccgaaaaacggtaccgttagggtacgggtaccttacggaccctaacccgtacgttaccgtttacgttacctttacctaacctttccccgtttcccccgaccgttaaccg

SEQ ID NO: 100602 - DNA, 522 bp, Homo sapiens
  misc_feature: GYAE6OF01B4QN5.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtgcaggtgggtctgggacagacttcactctcaccatccgcagcctagacgcctgaagtctttgcgtttatactgtacaactacgtaccaactcggcctcgtcttcggacgttcggccgaagggaccaagggtgaaactcgaaacgtactgtggctagcacatcctgtctcatcttcccgctacg

SEQ ID NO: 100603 - DNA, 546 bp, Homo sapiens
  misc_feature: GYAE6OF01CTWT5.23.37.D04.1.454.CMB.1.raw
  modified_base (263)..(263): a, c, t, g, unknown or other
  misc_feature (263)..(263): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacngaagcctggccaggctcccaggctgctcatctatgatgcatccagcagggccactggcatcccagccaggttcagtggcagtgggtctgggacagacttcactctcaccatccgcacgcctagacgcctaggaaacgtactttgacggttttattacgtgttactaaacaacgttacccaacgtcggcccttccgtcttgggaccgtttcgggacctaagggaccctaagggtggaaactcgaaacgactgtggctgcacatctgtcttcatcttcccgctac

SEQ ID NO: 100604 - DNA, 594 bp, Homo sapiens
  misc_feature: GYAE6OF01BVC9V.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccatggcatcccagccaggttcagtggcagtgggtctgggacagcttcactctcaccatccgcagcctagacgtcctagaacgtactttgcggttttaattacgttgtacaaactaacgtaacccaacgtcggtcccttccggtcttcgggaccgttccgggaccgaacggggtacccaagggtacggaaattaccgaaaacggtaccgtggtacggcctaggacctacccgattccgttacggttcctttaccgactttcccttcccccggccttaaccg

SEQ ID NO: 100605 - DNA, 527 bp, Homo sapiens
  misc_feature: GYAE6OF01B9QMB.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcaggccagtcaagacattaggaactacttagcctggtaccaacagaagcctggccaggctcccaggctgctcatctatgatgcatccagcagggccatggcatcccagccaggttcagtggcagtgggctgggacagacttcactctcaccatccgcacgcctagacgcctgaacgtactttgcggttttaatactgtacaacaacgtaccaacgtcggcccttcgtcttggaccgttcggaccaagggaccaaggtacgaaactacgaaacgactgtggctgacacatctcgtctcatcctccgctac

SEQ ID NO: 100606 - DNA, 659 bp, Homo sapiens
  misc_feature: GYAE6OF01DHA92.23.37.D04.1.454.CMB.1.raw
  modified_base (653)..(653): a, c, t, g, unknown or other
  misc_feature (653)..(653): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccaccctgtctttcgtccccgaaggggaaagacgcccaccctctcttgcgagggccagtcaagacattaggaactacttagcctagtaccaacagaacgcctggccaggcctcccaggcctgcctcatctatgatgctatccagcgacggccacgtgcactcccagcctaggttcaggtcggctaggtcgggtctagggactaggtacctttcgaccttacctccgaaccctagtccccgactacgtcccgtaaggacgtcccgtaaggtaaacgttaccgttttggtaacggtttttaacttaccgttcgtaaccaaaccgtaaacgtaccctaacgtcgtcccttaccggttcgttcgggtaccgttcgggaccgtaaacgggtacccaaagggtacgaaaactacggtaaaacgacgtcggtacggcctagacctaccgtacgttcgtacgttccttacacttcccttccccgnttaccg

SEQ ID NO: 100607 - DNA, 543 bp, Homo sapiens
  misc_feature: GYAE6OF01ASFM9.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccagtggcatcccagccaggttcaggtggcaggtgggtctgggacagtacttcactctacacctatcccgcacgcctagcgcctagaacgtctttgacgttttatctgtacaacacgtaccaactcgcctcgtctcggcgttcgacgaagggaccaaggtagaaactcgaaacgtactggtaggctagccaacctagtcttacgttcttactacttcccttcccgctacg

SEQ ID NO: 100608 - DNA, 526 bp, Homo sapiens
  misc_feature: GYAE6OF01D9CWJ.23.37.D04.1.454.CMB.1.raw
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (522)..(522): a, c, t, g, unknown or other
  misc_feature (522)..(522): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcaggtgcaggtgggtctgggacagacttcactctcaccntccgnacgcctagngcctagaagtctttggcgtttattactgtacaactaacgtaccaactcgccttcgtcttggacgttcggaccaagggccaaggtaggaaatacgaaacgacgtagtgctagccacatctagtctacatcctccnctac

SEQ ID NO: 100609 - DNA, 542 bp, Homo sapiens
  misc_feature: GYAE6OF01C8KIW.23.37.D04.1.454.CMB.1.raw
  modified_base (371)..(371): a, c, t, g, unknown or other
  misc_feature (371)..(371): n is a, c, g, or t
  modified_base (511)..(511): a, c, t, g, unknown or other
  misc_feature (511)..(511): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaaggggaaagagcccaccctctcttgcagggccagtcaagacattagaactacttagcctggtaccaacagaagcctggccaggcctcccaggctgctcatctatgatgcatccagcgagggccagtggcactcccagccaggttcagtggcaggtggctgggacagacttcactcncaccatccgcacgcctagacgtccgtagtaagtacgtttgtacgtttattactgtacaacaacgtaccaacgtcggtcctcgtcgttcggaccgttcggaccgaagggaccaagggtgaaatacaaacgacgtgtaggcngcaccatctgtcttacacttcctccgtctac

SEQ ID NO: 100610 - DNA, 529 bp, Homo sapiens
  misc_feature: GYAE6OF01CS1UK.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggctgctcatctatgatgcatccagcagggccactggcatcccagccaggttcagtggcaggtgggtctgggacagacttcactctcaccatccgcacgcctagacgcctgaacgtctttgacgtttatactgtacaacacgtaccaactcggcctcgtcgttggacgttcggaccgaagggaccaagggtcgaaactcgaaacgactggtcggctgacacatctgtcttcattcctcccgctac

SEQ ID NO: 100611 - DNA, 660 bp, Homo sapiens
  misc_feature: GYAE6OF01CJ93X.23.37.D04.1.454.CMB.1.raw
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
tcagacgcgagtatcacgaccggtgctcgatttagtagcatactgttgggtttgggggagggaactgctccacgttagggtaccccagagggaaccatggtaagccccagctcagcttctcttcctcctgctactctggctcccagtaggaccaccggagaaattggttgtttgacacagttactccagccaccctgtctttgtccccaggggaaanagccaccctctcgttgcagggccagtcaaggacattaggaactactagcctggtaccaacngaacgcctggccaggcctcccaggtctgctcatctatgatgcactccaggcgacgggccaacgtggcactccccgagtcctaggttacaggttcggctaaggtgggtctgggactagacttcactctcaccgtatcccgactacgcctagacgccctaggaaacgtacctttaggaccgttttaataccgtacgtaccaaacctaacgtaccctaacgtcggcccttcgtccgttacggaccggtttaccggaccgtaaacgggaccgaagggttacgaaaacgtccgtaaaaccgtacgttacggtacggtccgtaggacccgtaaccgtagttaccgttacgttaccgttcgtaacgttcccgtttccccgccgttaacg

SEQ ID NO: 100612 - DNA, 536 bp, Homo sapiens
  misc_feature: GYAE6OF01DGW89.23.37.D04.1.454.CMB.1.raw
  modified_base (385)..(385): a, c, t, g, unknown or other
  misc_feature (385)..(385): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctccaggctgctcatctatgatgcatccagcagggccacgtggcatcccagccaggttcagtggcaggtgggtctgggacaggtacttcactctcaccactcccganacgcctagacgcctagaacgtactttgacggttttatactgtaccaacactacactcgcctcgtctggacgttcgggacaagggaccaaggtacgaaataccgaaacgactggacggctgccacattctgtccttacattcctcccgctac

SEQ ID NO: 100613 - DNA, 606 bp, Homo sapiens
  misc_feature: GYAE6OF01DA6Z9.23.37.D04.1.454.CMB.1.raw
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (379)..(379): a, c, t, g, unknown or other
  misc_feature (379)..(379): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaanagaagcctggccaggcctcccaggctgctcatctangatgcatccagcagggccagtggcactcccagccaggttcaggtcgctaggtcgggtctggggacaggtacttcacgttcncaccactccgcacgcctagacgcctagaacgttactttacggtacggttttaattcgtagtacctaaactaaccgtaccctaacgtcggtcccttccggttcgttacgggaccgtttccgggaccgtaacgggaccgtaagggtacggtaaactacgaaaccgtacgtaggtcggactacggaccacctacgtcttacgttccttacacttcccttcccgcttaacg

SEQ ID NO: 100614 - DNA, 572 bp, Homo sapiens
  misc_feature: GYAE6OF01B47S4.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtccccagccaccctgtctttgtcccacggggaaagagccaccctctcttgcagggccagtcaagacattaggaactacttagcctggtaccaacaagaagcctggccacggctcccaggctgctcatctatgatgcatccagcacgggccactggcactcccagcccaggttcagtgggctaggtggggtcgtagggacagtactcactcctcaccactccgcagcctagacgcctagaagtactttcgtacggtttatactgtacaactaacgtaccaagtcgccttccgtacttcggtacggttccggccaaaggggacctaagggtaggaaactaccgaaaggtaactggtcggctcgacaccctatcgttgtccttacacttccttccccgctaattacc

SEQ ID NO: 100615 - DNA, 761 bp, Homo sapiens
  misc_feature: GYAE6OF01BY45J.23.37.D04.1.454.CMB.1.raw
  modified_base (259)..(259): a, c, t, g, unknown or other
  misc_feature (259)..(259): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccacctgtctttgtccccaggggaaagagccaccctctcttgcaggccagtcaagcattaggaactacttagcctggtaccaanagaagcctggccaggctcccaggctgctcatctatgatgcatccagcagggccagtggcactcccagcccgaggttcaggtcggcgtaggttcggggtcgtacggggactaacggtactttccgacttcctaccaaccctacgtccccgaccgtaacgaccccttaggaaccgtcccgttaggaaacgttaccgttttcggtacgggttttttaattaccgttaggttaaccaaaacccgttaaaccgttaacccgaaaccgtttcgggtccccctttacccggtaccgttttaccggggtaacccgtttaccggggaaccccgtaaacgggggtaacccgtaaaaggggtacgggaaaaactttaacccggaaaaaaccgggtaaacgtttagggtaccgggtaccgttacggtaaccccgaaaccccgtaagtttacccggtttacggtttaccccttttaccgtaaccttttccccgtttccccccggtaccttaaccg

SEQ ID NO: 100616 - DNA, 574 bp, Homo sapiens
  misc_feature: GYAE6OF01CGN3W.23.37.D04.1.454.CMB.1.raw
  modified_base (387)..(387): a, c, t, g, unknown or other
  misc_feature (387)..(387): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggcctcccaggctgctcatctatgatgcatcccagccgagggccacgtggcactcccagcctaggttcaggtcggcagggtcgggtctggggacagacttcactctcacctntccgcacgcctaggcgcctagaacgtactttgtacggttttatactgtaccaaacgtaaccgtacctaacgtcggtcccttccggttcgttcgggaccggttccgggacccgtaaacgggacctaagggtacgaaataccgaaacgacgtggtaggcctgccacntctgtcttnactcctcccgcta

SEQ ID NO: 100617 - DNA, 673 bp, Homo sapiens
  misc_feature: GYAE6OF01B3CQJ.23.37.D04.1.454.CMB.1.raw
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccagccaggttcagtggcaggtgggtctggggacagacttcactctcaccatcccgcacgcctaggacgccctaggaaacgtacgttttggacggtttttaattaccttggtaacctaaaccgtaaaccggttacccaaacgttcggtacccctttaccggttcgtttacgggtacccggtttaccgggaccccgaaagggggtaacccctaaaggggttacgggaaaaaccttccgaaaaaccggtaacgttacgggtacgggtaccgttacggaccctaacccgtaacgtttccgttacggtttaccctttacgaacccttttcccgttcccccggccctttaaccg

SEQ ID NO: 100618 - DNA, 602 bp, Homo sapiens
  misc_feature: GYAE6OF01BZOVV.23.37.D04.1.454.CMB.1.raw
  modified_base (203)..(203): a, c, t, g, unknown or other
  misc_feature (203)..(203): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaangccaccctctcttgcagggccagtcaagacattaggaactacttagcctggtaccaacagaagcctggccaggcctcccaggctgctcatctatgatgcatccagcgagggccacgtggcactcccagccaggttcagtgcaggtgggtctggacagtactcactcncaccatccgnacgcctagacgcgtagaacgtacgttgtacggtttatacgttgtacaacgtaacgtaacctaacgtcggtcccttcgtcgttacgggtaccgtttaccggacccgtaaaggggaacccgtaaagggtacggaaaacgtacgaaaaacggtacgtacggtaggaccgtaggacctaccgtattccgttacgttccttactacctttcccttccccgtcctacg

SEQ ID NO: 100619 - DNA, 776 bp, Homo sapiens
  misc_feature: GYAE6OF01ETX3L.23.37.D04.1.454.CMB.1.raw
  modified_base (206)..(206): a, c, t, g, unknown or other
  misc_feature (206)..(206): n is a, c, g, or t
  modified_base (266)..(266): a, c, t, g, unknown or other
  misc_feature (266)..(266): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagcccaccctgtctttcgtccccgaggggaaanacgccaccctctcttgcagggccagtcaagacattaggaactactagcctaggtaccaanagaacgcctggccaggcctcccgaggtctgctctatctatgatgcactccagcgacgggccacgtcggcactccagtcctaggttccaggtcggcgtagggtcgggtcgacgggacacgtactcacctctaccaccgtactcccgacacgtccgtacgacgtaccgtaggtaacgttacgtttagggttaccgttttaacgttcgtacgttaaccgtaaaacctaacccgggttaaccctaaacccggtttcccggtaccccgtttacccgggtttacccggtttaccgggggttaacccggtttacccggggaaacccggtaaaaccggggtaaccccggttaaagggggtaaaccggtaaaaaccgttaaacccggaaaaacgggttaccgttaacgggttaccggggtacccgttaacggacccgttaaacccgttacgtttacccggtttccgttaacccttttaccgttaacccgtttccccgtttacccccgcctttaaaccgg

SEQ ID NO: 100620 - DNA, 564 bp, Homo sapiens
  misc_feature: GYAE6OF01EX2I6.23.37.D04.1.454.CMB.1.raw
  modified_base (328)..(328): a, c, t, g, unknown or other
  misc_feature (328)..(328): n is a, c, g, or t
tcagacgcgagtatcacgaccggtgctcgatttagtagcatactgttgggtttgggggaggaactgctcagttaggacccagagggaaccatggaagccccagctcagcttctcttcctcctgctactctggctcccagagaccaccggagaaattgtgttgacacagtctccagccaccctgtctttgtccccaggggaaagagccaccctctcttgcagggccagtcaagacattaggaactacttagcctggtaccaacagaagcctggccaggctcccaggctgctcatctatgatgcatccagcagggccactggcatcccanccaggttcagtggcagtggtctgggacagacttcactctcaccatcccgcacgccctagacgtcctagaacgtactttggcggttttaattacgtgttaccaaactaacgtacccaacgttcggacccttcggtcgttacgggaccgtttcggaccgtaaaggggacctaagggtacggaaactcgaaaaccgactggtggctgctaccagtctgtcttcattcccttcccgctac
